United States Patent 7,868,149 (PLANT GENOME SEQUENCE AND USES THEREOF) - sequence listing, part 96

SEQ ID NO: 50458 - DNA, 35740 bp, Oryza sativa
  unsure (1)..(35740): unsure at all n locations
tgaaaatgcgaattataaaaaaattttatataagacggacagttaaaattggatacggaaacccagggtttaccttttttttttttggacggaggaagtacgtattaaacgaagtgtgatactgacctcaccttccacccacagcgcaaccccgttccactaatgattccagtagtcaaatttttactatttacacatccaccagatagcccaccatatatagacagtttcgtgtagtaaatttttaactaatcactttcatttacagttaacttatcataaacagtgtgatatttattttagagttattgttttactcgatttgttgatgccataaattttttttatattattctgtttcaatattttcgcaaaaattaaatgtttgttattttgtttttaggaaccaactttttctaatttcaattttacttttattttttagatgcttcttgtttcaaatatccaagaattaaatgtttggggaacaaacttttttattgtctattattgaacaagtcaggtttttttaaccgttatcgagataacccttgtgtgttgtactccaatttatttagcatattgagttattttttagctcagcacgcaatgaattgataattacgagccattttttattcctttttttattaaataaatgatttttacttgtcaaatacatcatgtcgaaccataatcaatttgccttcaagttaaatattaacttgtcatcctaagttaaatttttactgatcaaataaatcctatcaaaccttcatcaaattgccatcaagtgaaacgataactcatgcttctatgttaaattttactactactcgcacccacgtagatgcaacgatagtaattttttttaccacactaactatgagtatttgtagcataggtaacaaaccagtgaaccaccgcttcgtatccagccattatcccttaagttttttccgaatctagaacagcatcctcaaattccaggcagcggcggatgagactctaagatccgtcgatggcgacggactccgaccagcacaactttgcggcgctctgaagggatgtgcttcatgctctgctcgaccacggcgaccacgtctgctttatccagttcccgcagcagttcgagggcatcgaccccagcgaccggcaacccaacctcgtttcgacgtctctatgcgcgtcatggacggactccaggggtggttgagtcttctgccgcgcacctgaattacagcgctttccaggagaccgaaacaaaaacgatgagctgatgaaagccgcactaatattttggaccaatcttacccctctctgatggacggtcagatttaattggtagctcatgttacctcctcaacaactgttgctcccacttgaatgggttgacgacatatccctcatcatcatgtttactcaggccaagaagcccagtgctcttagtggttagttgttgctagctagttgctgcattcatgtggtttgttggtgctctacatgtcttaccaagttgagggtgaaactaacatatgctcctatatcatattaattagtattatatatgtggctggctgattgtatattggcatcatggcctgtattgtcccctgtaacatggcatttgcataatgcttggatcaacttggattagtggatgcaagtagctcaggaagccaaattatatccctgtgattaatttatgttgttggtgcatgtttctccaccacgaattggcttcatcgtttttgtttgggtcattttcagtttctttgtttttttacttgacacgagcattgtaatcatagttagtctaattaaaatatatgtacagcgtaaaggagatcgaaccggtatgtaacttctatataagatggaacgaggggaacaacaacaaacaacaatttcattacacacagaggtgagctaggttggagtcaaagctaaggagaagaggaaaaggaggtcagggagagggaggtcatggtaatggaaagcgccccagagaagttgaagctgctgctgggggtgctggcgctgcagtgctgcctcgcggggttccatattgtgtccagggcagccctcaacatgggcatcagcaagatcgtcttcaccgtctaccgcaactgcatcgccttggcattgctcataccttttgcatacttccttgaaaagtgagctcagacatacctcttcgattcaattcgttgccatttatgcatgaaattcgaaattctcagctaaattgtacttatattgagatttagaagggaaaaagaaacatctattctgtgtgcctgtgagaatacatttttcctttacattctatttatcttgctatgtttgtttttgtcctgtctgttataagctgactatacattttatcttacatctgtaggaaaaatagaccacccctcaccttctctttgctggcccagctcttctttctggcattctgcgggtaagttcgatgcacattgcactgaaagataaatagattgcttgagattatgtataatgaccatatgctttgctttatcaggataacatgcaaccagggtttctatcttcttggtttgcactacctgtctccaacctatgcttctgctatccaaaatacagtaccagcaataacctttgccttggctgcttctctgaggtaatccagcaataatgtcattatcatttaggcacttcattaacttttgctactcattgaagctatcaatcaaaacttggtaatatttcttttttttaaaaaaaagtgctcctagttagtaacaagaacaataacagtaatagcagtaacatattgtattttgaatgcacatctgtgttcatgaaaagaagactgaacaaagctaaaagcttaattggttaacattagttcgtacgtttctgtgctaatctggtgtctctaccttttattctttctatggttaattaataggcttgagcaagtaaacataaacaagaggtatgggatggcaaaagtgattggcacagttgtaagcgtagggggagcaactgtcattactctctacaaagggacaccactgatgaacttcaagtcatcctatattttgggagccaacactgtgtctcaaaatgtagttttgaattggagtgtgggttgccttttcctccttggcaattgcattgcctggtctggatggatggtacttcaggtgtctactcttacttgaactcaacatatatagccagccgcttatgactaattaagtttcctgatagtttgttccatctacgtatactatacatgatgcacgctacatcgtctctagttgaaatatgctcttttaatttgtgtagaccccagtcttgaagaaatacccagccaggttgtcaatgcttgcgctgaccctggcattcgggctggtacaattcttggccatagcagcattctgggagaatgacattgggaagtggaggcttcattctggagaagagctcttcacaatcctctacgctgtaattttcatttatccatattccatatttccataacgtttacgtgtttcatcgtaattaagtacaccgcagtggtacttcaagatttgttgcacaaaaataaattggtagcaacaattttgtaaattacatgtatatattccaagaaagcggcaaacataatttccttgaccatttccattcatcttgtcttcagggtctagttgcttcaggggttgctttatctcttcagatctggtgcattgacaggggtggtgctctgttcactgctatcttccaacctgtacaaactgtcatggtggctataatggctgccgtcattcttggcgatctactatacacaggagggtaaggaaaaacaaatgtaacctgcaagaaaaacattccatacagaacgaataatgattatgcacatctgaaaagaaaaaatgatgagcattcaggctcatccatgattagtctaaaacattccaattgttggagctaagattttttctcatttacaattatcaggatcattggagctgtccttatagtgattggcctctaccttgtgttgtggggtaaaaacgaggagaagaaaagcaacagtaaccaaccagatttgtcaaggcatctcctcagtgaagagtcttctcgaccaacgactgtgacaagtgatgttccataaaagcagtaaccaaccatcactgctattataaaatgcacaagtatagaattaatgtgcaaggtgatgcaagtgtggattgataggggtttttctaggttatatctagtttaggaataatatagttatattttcatgcttggttctaatatacaattctattttcaacatgctgttgagtagtagttgattgcaccaaaaagagaccaaagatgttggatgattttatattgtttgctacatacgattatcatctttggtctcagttctactactcaattaataggagtgtatgtagcaaacaatataaaatcatcaaattaaatgataatcgtatgtgattgaatagataccgacctatagtatctacgcttctaaagcattatgtcttcactaggctgagttcttcaggtgactttcccaactcaccttcatttttcatgtgcacattttccaaacggttaaactatgtgttattttaaaaatattttatgcgaaggttgctttaaaaaattatattaatctattttcaagtttttttaagctagtacttaattaatcatacattaataaacaccacgcttcccaaacgcagccttacgcatgtaacagtcccttgcgagttccatctaccatttgtgctagttttaaatttgcctaatttagaaattatatgttctcttttattcgcaaaaatttgcttcgtgaaagttttataaattaaaaaggtttaattttggggggtattaaaagggtttaattcgactaattaattagatagcacccaattattaattgaagttattttatcttatttgatgttctaaagtggagcttattccattaatcctgaaaattctcagaattccattgtttcaaatacaaaatatttcaaaaaggtccctatccttttctctattttttttctcttccttcattcctcttttccattcttccatttggcaacccacgagatgggaaatcctggcctgatccgtgccgtatccccaggaaagctctcacgtgtcaactagtcaggaggataatgtaccaaatgttgctgcaatggctgatatagatcgtcaattggagaaaaagacagcggccttgagagagaatgttccctcgttatgtgcctgcaacctaaaaaattataaaataattaaaaatatggatcaatttatgttatcactacagaaataatcaaattggacatctattcccagttaaaattttattttattttatttttatttttaggtcgaatttgaacattcacattttcatgtttgtgtagtgatcgatcttatcaatttatttttaaaggatgactttctaggtgtcattgtgtagtcatgctagcacctacacttttagttctcagctactgccacacctcctttcttaggcacaacctgaactgggttaacccactcgctatacggcacaagatagattatcccgacgtgtaggagtttcatgacctcttttttcatgacttctctcaccgcattatttagccttcgttgtggctctcgagagtgcgcacaagaacgatataaacggatacgatgtgtgcagagagccacactaatccccttgagatcttaaagtgagtagcctagaacagaatgatgcttttctagcacagctgtgagtcaggaggtctcatcatcagtcaacttgtcacttatgatgacgggtcaacttgtcacttatgatgacgggtgactctgtattaccatgcagaaaaaacatagcgtaggcctaaaggcaaagacttgagctcaatcggaggtcatgaagacggatcggttttgggtaactcgatcatgtcttcaaaatcgtcctcttcctcaacaaatgcaatggcatcatcttcaaggagggattcagggactcaaatggagagacaaccaacatgttttcaattggctcagactcgggaacaggttccgtcaaggagtttttcgaccttgagatcgggaaggaaaatgacaatttatcgagtttgatgtcgagaactccggttctcggcacatctaagaagagtttttctatagaatggcctattatgagggcgaagtcatagacttcgaacacatggaaatcaaggatgaccttgacatcattgtgcctgattggcgctctgcggatagccctatacccttcgatggtagaaccgaacggttcttaaaaggttttgtctgtgggtgctaacagttcgtcccaaaaccgatataatgtatgatgcaaagctttgtctttaggcctgtgggtgcaaacagttcctaaaaaggatgccaatataatgtttgcactgctagtgggatcattaaaaagagtttgcaccatggcctctctcatgagacagggaatggttaaggacggggagctaatccgaattgcttcagatgaaagctccacctcccttaactactcttcactcatgatggtagctagttgatgaactacctctttaaggaaattttcctcgagaggttcattccaactacgtgggactggtggtctcttttgcacagaatagtttgaggtgtttccatagtcttcaaaaagatcacccttaaactggaatgggatatccgaaggctgaatttcttcttccttcatttcccatggttcggttgagcattcaatggttgaatcttaagatatgaaggttacaagctccgattcaacgattgaaggctcgtcttgtgtatgctcgatttcctgaaaggtttcgcaacgaacgaaaaaggtattctccaagatatgatccaggagttccctaccttccatcattattttgtgtgcgaacgaacctccggcggaaatatcaggatacatggaaaactccttgtctaaatccaaataggattgttgtactaacacatggtcaagtagagacaagtctgagttggcttgagttaacaaggaaaatcgatcctaggaaacaccaacggattgcttcttattttgctaaaaattgagaaccacaccacggagagaagctacatgggttaatgggaagaaagcaaggcagaacctactttcaactccacccattcaccgtatagttttctcaccgtatgggtgtaccattgtttcaccccttctgtaagagaaaagggaaacaacttccatcgtgaggtgccttgtgcaatgcctgcaattatcaggcatgaacacagttgctcaaatttcacgcagatgatcatagtgattttcgctttcgcatccagagaaggattgtccctgaaccatcgctataaatctaggactaagttcatagctagatgtatgaattggttttgaagaaggggtagctcacagaacttggcccttggagctatgaatacacaccaatgagaagatatctaactcacgtaaattaattaaacaacataaaagaattttgaacacttactttataaaaggaagcatctgctgaggtacaaggaagaagaaggctgacaatcccggcgtgtcggtgaaatgggaacggggtacccaattccccggcaaaacaattacaagtaaagtaaatggcatgcttaaaccattctaaaaaataaaatgctaccccagggtgatgtaggtgggggcccacctttatctgtttgcgggataagaatgtaacctaaggtatgcctcggacccggtcttgtcctgggtcccaggctcaccttagctcatctaggttacaatactgctcagtgaagagaagtgttgagacctataaaagctatgtcttaagaatgtaatctaaggtctgccttggacccggctttgtcctgggtcccgggcacgccttagtccttgtaagtcctatgctatccagtaggaggagcgtagagacatacaaggtctacatcttagaagatataaaactaaggtctgcctcagtcccggcctcgtcctgggaccggggacaccttagcccttgtagtttccgcattcttctgcaaagaagagcgtcgaaacatacaaaataaatacattatctactcatcaaagacatcttcgagaatcttgcccaagaatagatgaattatcatcacaaaaagcgcaagggcgcgacctcaggatcgtctggggagatgggcgtgctccacagggctgttgtgaagcagtcctctccgccataaatgaaacatgtttatggggagccccagccagttgttgacggttgtcataaaccagttccgacaaccaatataactataataaaagagaattagctatgcttataatgcatatttgttttagattaatatagttccacttgtacttggagaataatttgttgcaagaattaagcaaataaaataatgaaaaaataaggaaaactcactcctaagtaagcatatggataaggagggcccacatgtcaggtgtaaccatccggaaaccaccttaactgtcacaaccgataacaggacccacctgtcggtaccctagccaaacatggaggcctgctgggccggcccacgttcggccgaacactagtggcgacggctcagcccggccttacacgtggacatccaggattgctcgctgatggcggttgtggggcagaaggtcattttgccttctcagaaaccgtcataccgaccctataaatggaggagctcatttaacttcacaacacactcaagcaagctcaaggttcctctcatactttattttagtagttttagtgctaagcggagtagtatagaatagttctcggggtcctcagagcttccagaagagtttcggtatggctctaatagcttttctaccctcttctataatactttcagaattaatgaaatacacttctttatatattctcggtactttagttagtataggtattgctcttactttacatttgtgtcggtataattgtgtgagtagcctactagagaggtgcaatggtgtgggtttagtgtccgatttatcggttgctttatatcatctacagaggtgtagagtagtatttattaatgtaagtatggtgcttagattactaaatatcactatctaggcatatatgctgcgggacagtagaggtgcgccgctgacggtgatagctcagtataggtattcctccatgttaatatatattcctaagacaaattcctgaggagggtactcctccatattcaaccccggttggatgaccatgacaggttgtcgtaagaaactcggcaacctgggatggtctctcgaaacaccaggaggggtattggccacataattgtatactagcaaatgtagactagagtttgagtgtatattagaagtataggaaatgagttctttctatctcttctcccacttagtttagaattattcatatgagggaatctataagcttcgcttcttgtcactctacccttatattaaattaacccctgcttagactttgatgaaagcaagtaatatatatgtgtatatattagcatggttctctctttcataattttaccttggattaaataaatataatacattggaatacttccggatgaaatgctataatggtatatctgtgcgcttgcggattacttaggtaaccataaatatacctggactatttctgatgaaccctgagttccactcggcactcaaggctgttgttggcccgatctttcagtgagttgagataactacgatttagtagaaacgttgacgatccaactacaaccgtacaagacattgtgttgcgcctttgcgatcgatacacctctccgtgggttgttgatcttgccggtgcagatcaaccttattcctgcaagcaaatcgaagaaacaagcaagaacatgataaaagcgatctaaattgcaaataggaatgaatacacacgataagttggggtttcaaatacaagcagacggacggtctagccgacacgcgcgctgcaaggaagtagcaatggctaaactttcatctaaacaaaacccaaaaaactctaaagtggtacctaactatttaaggaggtgggaggacgacctaacgggaccctagggtcgttctccacctggttggggcgcaccccacatgggccccacttgggccggggtcccagacgaagttacaagcccataggcccattataggtgacgcagcaccttctttttgtgatttcggccgactgggatggaatttggcgatgaagctggatccattggaaagatgactccgagagctttccatcaagtactcatggacccaaaatggagctcgcatgcatatttggcggccttttgaagtccacactgtagcaggtggccgaactggattgcagaacttggacggcttgatcttgatgtgaactacggttgtatctatagtagccatggtcacatcaatttctacatcattgctaggaatgaatatttctactaatgtcattaagaaataccaacaccagtttgaagttgaaaggacatggacaagaggtattggttaagcacgaagatggaatcctcttgatgagtggaacagcggtactgatggtttgcatggagatctcatggttgccaagaattgagaggaagaagagaacttcttttgataataggaagaagaaagatagacgaagaagaaaacgacattgaaggctagctacagtctgtcaggttgggtcgtgttggtgcctttagagctaaccttccggtccttttgaacgactcaaatcggctacagctaaagttgcagtcactataacaactactacaactgatcctaatccctgtgcagcccgtgtcaagagcgatccagaaagacgagacaggttacaagaacagggaccgaggaatgcatttggatggtgaattggtgagtgagctcccacaaaacctcttggcatccggattcctgtcgtcgtcgttcacccttaacccccgcttgttgtaacccgttggtcccgctttataagcataggccgtgtttagttccacccaaattcccaacttgccatcatatcacattgcatcgaaaactttcctactcacgtaaagtaccaactttttctccaaactaccaactttctcccaactttccaacttctccaccatctaaacacacccatagtgtaaaacagaccatcggtgatacatttcacactactacatctaacaacagatagcattatattttggtactcttctcttctcttgttcaatcaccaacacccttctatctgatcccatgcaatccctccattcttattagattccacatcctccaaactacattttgtagtactactcccaaaatactactacaagagagcagaaaaacagagaggagggaatgcgcctcctaactcgcatttacagatcaatgagaaactccacccttgaaactcagacttgttacatccaaaggaagagaacctagcatcttcaaccactatctagtcgaccgatcacgcaaattaagtacatgatatggtgttcctggtaattacctgggctccatgatcaataagtatgttactcagttggtgtgcccatggggcagcagcttgagggcctccatgaaagtgttcttgagcctgcccaaatgtggccgcacattctgcttgtctaggtagaccatcttgagagcgttccagccctgcttgtggatggagtaggggtccttgagcaccgggtcgtccttggggtattgctcgctcagcgtcgtctcgtcgagctggatcatatattcgaggtagtggatctgcatgtcggccgccggctccttgaacgtgccgcgggcgagccattccaggccaccatacggcaccacctggatgagcacggcgccggcagggaggaacaccatgttggtcagccctgcgccgtgcacgcccaccatcacgtccgccgagttcaccagccgggcgaacttggacacgtccgtgctgatgtccggctcgcccaaacgcacgtagaagcccaggctcatggccatgtccgccatggcacgctcgttcaggaacgcacgggagttgcgccgcgagatgatcagcagtcgtgggcggcgccggatgtcccaccggtcgccgctgggctcagccacagcgcgctccagcccgagcgctccacgcaacatcgtgcggaagtccaccatggagtaccccgacggcgttctggacgggtccaccccgagctccttgtggaacgtcggcccgaccaccacgctccggtaacatcggacctcgtcatcattgtcgatgtcaaccaattcgtacttgctgagccgctggaagatttgcatgtacctgttcgtccaccacgacttgaagctgctcaccaggaactgaacctcgccagcgaagcggtgtgcggtgatgaacgccgggatgagcacgtccgtgtagtcgtggaacgggttgcccgtgaacccgccggtggagagcacgaacgcggtggccgaactgttaaccgtgcaatgcggcaccgccgggtatgtgtcggcggtggagaggggccgaagcgcccactccttgacgtgcgacagcgcgaaggcatcgtgcttccggcagtacggcttcaccttccactcctgctccagtgggctgatgtggatggtctggctgcggccgtgcacgcggacgtcgccggtggcctcgcacgtgtccgaccgccggcttgactcgtaacacaccggcttagtcaggtggtccgtggccgtggtggacgctgctgcaacagctgcgctgcttgcgccaccgccaccgccaccagctgtggtgtctccagccttgggctgcgtttcttcttcctcttctgctgctgctgcagcaaaaaaataaaaaaaaatcgcgagtaaatagacggacaaaaatatcaatagtagctacccctgagcgtttatttcctcttctgcacattaaaggccacccaaattgttcagatctgaactaatttccgtaattcctttggacattgaatcataaatcattgatgcatttttgtgcgcacaagttacaagaaatggcctaaaatttcagagctcgaaccgtagagcggaaacgggagaagatttagtgcaatactgcaatcttgataaatgaaggacgaaatttactctcaaatccatacggtcagctccctacatccgtacatgctactaaatcgaaatactaataaatctatatcactcgaagatgcaggagaggaggaaactcgtgcttaccagctgatgctgcagcctcatcggcggcctcgagggtctccatcttcacactccccttcctcatcgcctcctgctcctctgttttgatggcttcccctggcttccctgcagcacccagcaggaagacgataagaaaaaacaacacagcttagatcagtaatcaaatcaccggcagcctaagaaccaaaaagcagaccagaccaccatggccggccggatgcgaaaggcagtcaagctgagccgacgaagaagagcggagcataccgatgggggagaaccttgccctgacgagggagagcacaagtagggatcccagcataaacgctatcagtgccgcattccccagcctcctaccgtctcccctggtcaggttcctgttagacttcatcgccttccccctcccctctcctccttcttcaagactgaatatttggatggttcatgagggaaaatccgagtcttataccactagcaatggaagcatgagctggtgttgaacagggcaaagaggttgaaatggtagtgtgttgacccggtgacagccacggctcaacacacaaacaagggtactactacaagaaaggggaggaagaagaagaataaagggaggacttgtataggaagagaagggaggacagagatgagagcgcgtcaaaagggacgcaagccaagcggtagcctgcagcagcagcccgagctaatatacttgttcctgaaatctattttggagactactctcgattttgtcttaactagcaacggctaaacacgaaaaaacatgaaaaagtccagctgctacatggcactatatgcatgcctttttttagaacgtggctccacagctagtgctagctagtttgtctaaaccagctaccactccatttatgaaagatattatccacatatactttaaatacaattttctcttaaattacttatccgatctacgatccgattgcaccgttgtgtttatagcaattaaatctttataacaagatctcacatgattatattttaatgaaaaattataaattacttttataatatatctaaattacttttagattttactaaattacttcttagacatgtaaaagtaaattcaatgaagcctaaaagtaatttacatatattatagaagtaatttataacaaaaagaaattaactttaatgaatgtcttttttaattggatgtgactacacagttagtggtagctagtttgtattctatctagtatctcctttcaacttgaaaaatacaatagtatctttttttctcattctacatgaaaaacaaaaatgaaaggaaaaaaacaattgatgattaaacagatttacagagagttacttttgaaccatgcaaaagttacttccaattaacattgaagttacttttaaaaattgttaaacttatgtgtgttgatctgtgctgattaaatttaatttctagataaagtcatatttttatccctacaacgaatttacttctaatgtcgtgacaaaattacttctgttttgttttaagttatttttataatatatgtaaattacttttagacttttatatgtctaagaagtaatttagtcaactctaaaaataacttatatatatatatgtgtgtgtgtgtgtgataaaagtaacttagtaatttacaaatataaatattttttcatcgtaatataatcatgtaagatcttgttatgaagatttaattgtaacgaacttagtggtgtaatcggattatagatcggataagtaattcgagagaaaactttatttgaagaggaaaaggatgtacatatatagtaaaaaaacgtaaaatctatttggaggggcatctggattttatctttaactatccggttatcccaacagtaacatcacacagttaccaacactacagagctgccgttgtcgctgtttctttttaagcttatctttgttggattagtgattagttttattgcttcaaggcagatgacagtgttagaaaaagcactaggcccagaaagagattcctgttcttagcgccggtgaaataccttcaaaataataatgtgcccaattcactaaatcactctctccaaaataataatatgatactttctagtagtatcaatatgaacactaggaagtgtcccataagaccatactcccatccatctaaaatcccttatattatgggataaagagagtacttagatgcaatggaatgtgtccatgagacgagttcagtttctggacttaaacgctattttctaagttataagcaaatagacacgcctgcacaagtgtaatactccttccatccaaaatataagaatatagaaccgtcccaaaatacagtttacttgcccagattcgtagtaatagaaaatgtcctatctgatactacgttcttatattttagaagggagggagcatgtgcatttgtgcatcctgagttgtataaaaataagagtaaagtgtacggacggtctttaaacttatagggttgtgtcatctaagtccctaaactctcaaaatgcatatctaagttccagaacttgtcatagtatgtcatctaggtcccaaatcgccaaaactccttcaggaccatacgttgtgttgatgtggcatgccacacggatatgatgtggcattattttgactgacaaatgttacccatttaaattttttcctttttctttttttcttatctttttcccctttattctcctttctccgtgacccgggtagaagaaaggaaaaaaagaagaatgagaagaaaacggaaaagaaaaagaaaaataaaagaagaaaaaaaagaaaaggacacgtcacgtccatgtggcatgtcacatcagcgccacgtaggatcttagaggagatgtatcgatttgggacctagatgatacactttgacaatttctggaacctgaatatgcattttaagagtttagcgacctagatgacacaaccctacaagattaaggatcaccaatacactttactctaaaaataataatgcattggcatgttttgtctagaaaaagactttaacaactaaactgatggtgcgacctgatgctaagccagtcaagcaaaaactgtggagattcacaccagatcgaaaataggccatatgagaataattggacaaacttgtcaaggccggcttcatccgagaagtactccacccagagtggcttgccaacccggttatggtccgtaaagccaacgggaaatggagaatgtgcttggatttcaccgacctcaacaagccgtgacccaaggattacttccctcttcctcgaatagaccaattggtggcttcgatagccggttgcgagttgttaagcttccttgacgcttactccagataccatcaaatcaacatggcaaaagatgatgaggagaagacgccattcatcacaccctttagtgttttctgctacaccaagatgccttttggattaatcagcgcaagcaacacatatcagcgtgagatccaaggggctcttggtgaccaactcggatgaaatgttgaggcctacatcgatgatgtcgtggtcaagacaaagacgcgtgacacactaattgatgacctcagagaaacattcaataacctccgacgacatcgcctcaagttaaacctagagaagtgcacgtttggagtaccatctgagaagcaaaccctgagaagatcaaggccatcgagaacatgaaatcacccaccagactcaaagaagtgtagaagttgaccggatgtatagcagtacttagccgcttcgtagccaggatagccagaatgggagaacgagcacagcctttcttcgctttactcaaaaagcaagacaaattcgagtggactcaggactccgagaacgcatttctcgcgctcaagcgctacctgtcaaatccccctgtacttgttgccccacaacctaacgaagagctctatctatacatcgctgccacaccatattctgtgtgtactattatcgtcgtcgaaagggaaaaggtgcaacacccaacatactatgtaagcgaagccctccatgatgcaaaagccaagtacccacatattcaaaagctgctctatgttatagtcatgacatcaaggaagcttggtcactacttttaggcacacaaagtcacagttgtctcttcttttcccttgggagaagtcgtcaggaacaaagacgttattggccgcattgcaaagtgggtagtcgagctcagtcaatttgaagtccactttgtgccaagaacatccatcacatcccaagttctcgctgatttcgtagctgactagactattcccaagaatagaacaagcagccagactgataatgagacatggaccatggcattcgacggtgcactcaacaaccaaggagtaggagccggatttattttgacttctccaacaggagatcaattcaaacatgcaatccacctaaacttcctcacaacaaacaacatagtagagtatgaaggactcctcattggtattcgagcagccgttgcactcggggttaaacgattgattgtgagaggggactcagaattagtcgcaaaccaagtgtagaaggattacaaatgcaccaatcccgagttggctaattacctcgctgaagtcaagaaactagaacgaaactttgacggcatcgaggttccacacgtttatcgcaaggataacatcgaaccagatgacttagcacgacgggcatccaaaagagaacctcttgaacctggaaccttcttagatgccctgataaaaccattcgtaaaagagtcgcacgacgaaagtaccatagccaataccgacaactcctcgagggctcaatgatgaggacacaactagctcgaatataaccatgactaccttatgtattaatcaaccaaaggtgcatatggtctatattagatttacatgttatatatttgaacaaacgttgctacaaagtgagtttcgtgtgtttttgtttgcagaggtacttgcttgggcgaaggaaaagagaccgagcgtaacaaatgcatggataatcaaagaagttgattggggaccaaatcaagaccttctccaagtctacttctacctcaccgcgtcacttttggtccaaagaagacaagagataaaattatacacgttttggattcggattcgggcctcctaatagaatcaaattcaaatggacctatccgctaatatagaaggaattttggggcccatgagtacttgttggaaagcttatggagtctactttcagatggtttttgtcccacataaaaattcctatcgagctgcctggaatctgcaaagcaagccatgtatctcatccagtccgaatctgatttatgttttgggccttataattgtgtagtgggcttagcccaaggtggtgtttgccctaggacaaccttaggacgtccctaatcatacttaatcagtagctgtcatcgtttagagtcgggtttttcttagattaatctgtcaagaacagtttcgccgctagatcggtttgtagaaccccaaattcgagtgcttaatcattcatatgcaattgtgttgcaatctatcttgttcttgcttgtgttctttgattcgcatacagagattagtcttcttggcgaggtcaactatgtttcggcacggttgataaccagaggagacgtggtgctacgattgcgaggctcagtagcgtgttcgtttagaagcaagatcgagttgtgtcacgactccgtgcaaatctactgtttatcaatacctgtcggaagagcgggacctaacatcctcatcagggagaagaaggaatttaattaaatttagtctcgatcattactttggatttattaaaattgcctcctttgataaattccactaaaaatcatgttattgtatttaaacacgaggaactaaaaaaaaatccaccatgcaaattccacttattaattgcattggtgaattagaggtagctccaggttaaattaaataatttcttcgggtgatttattactaaatttgaggctaaggaaaaaggggaaatttcaaggtgtgacaaatactgcctatgactcatggggtggtgcttttgttggaggttggattatatctttcctcatttaatgtttctactcttcctatttaaaagaatgctgctctaagaaactggaatgttttatgttggaatgttagagggctgaattctcatgataagtggttagccatccggaatacggtggaagaatgtggatgtgcaattttttctttgcaagagacaaaaaggagtacttttcatcattcttacattaagaaattgatcctaagggatttaacaaatttgctttttctccttctgtggatgcttctgggggcatccttgtaagttggaatatttctattttttatggtcctgttgagactgttgagagatttgcagttcagattaaatttacatcaaatcactttggtgtggtttggtctcttgtgtctgtttatggtccctgtgctgggagtgagagggatgactttgtgttgtggcttcataatctcaatatttcggtcgatcagctatggttgcttcttggagatgtctatttttatcgctcagtcactaaaaggaataggcctggtgctgacatgaatgatatttttttaatgaaatcattagtgatcttagccttgttgaattgcccattaagggtagggcttttaccttgagtagcccttacttgagcagctagattggtttttcacttccactgactggactttaaagtttccaaatactttggtgaaacctttagcaagatcagtctctgaccatactccttgtgttgttcaaattggcactaatattccaaaagctaatatcttcagaattgaaaatttctaggtggagcatgagggcgttttttgaccttgttcattcaatttggcagaatcatgtccatttttcacggtggcagtggatggaggacttcccacgcgtgacggcaacgaccgacgacggcggtgtacttcccgcacgacgtcggcgatgaccggcggtggcagaggtaaggtttctttctttttttttcaatctttgagctattcttcgggatccgagaccccttcttcttcctccttcctaaccccactagatctacttctaggatggctctgataccattgttagaaactaaggtttcctaggtgcggatctaggggcttaactagctagctcatgggagtagtagggattgtcttagagagtgaacagggaaggagagagggagagaaaggcataccggcatcggtgttggagcttgacacagccatggggagggtgtggtggcgtgtagatgttcctgagctcggtgatgtcggtgtgaacgacggcggtagcgatggtgagaccatgaggaatcccctctcttcagcactttcccggatccgtggcagttttagggtttgtagggagtcaagtgcatggtgaaaaaccttggcccgcgtgcccggtcaactcccctttttattgtagcgatgcatgagaggggctcacagccatggataggatagcacccccgaccagggcgcatgcagcggagtgggttcctgattccccggagatcccaactaacagttcataatggatctcctgatgccaatagttttgatgtggcagattcctaaatattctgcttctagccttgatgttcttgcactgaatatacattggaaaatttcttatagcttctggcactgaattaattccaggtaggtcataatgttatgtttccacgtgttttccaatgtccaatttcagatttttacagctgagagagagagagagaaatatttggtcgtgtttatagtacatactaggtaaaaccccgtacattgctgcgggaatttagtatgataacaataaaaaaaataacgtgtaagatagctagataacatcagactaagtaaattaatgtggtttatgataatttaaatttaaatagtatgtagaatggtgattcaaatgtaaaaaataagatgctatgactttatggaagaagaaaaatagagagatagtttggactatagattaatcatctaaaggctaaaaacaattgatgtgatatgacttaattagaggaaaaaaggagaaagataatttggactatagattaattatttaagtactaactaagtgaggatgaagtatataggatatcataaaacataataaagatatacattgaaacattatgtgaattatgttggatgataatttaacatgtttgtatttgaaaagctcttaaattataaaaactataaagatatagcatgtttgcatgatgtttaaatgtgatgattgctaatggatgatgatgtagcatcttgttaattagtggatgatgatgtggcatctttgcaggttaagcttaatgagttagtggggggtaactttatagtaagataagatatgcagttggtaatattaattagaggcaccttcatttcctgccttttttaatgttaagccgcacttgctgcctagccgacgatgcaggggtttatgggtgatgggtgaaaacttggatttcaaggagatggctgagatcgtcaggagtgggattgtcgtacacatttgaacctttgtttcccaacgctttcactttcctagatttgtggatcattagcgcggcagttttttttcccatagagtgtgtgaaatcagctctcaactgcactatacctggtgattctgttagtcatttcagatgttgcatctgcctggtattcagaaaacgaacagagcatggcatttggtgttgcattagagaagagtccgatgggtttatctactaagaatgcatggaaaattttatcaacgaataataataatatcactggtggagaaaccatctttggccggtcgacccaaatccacaatagtttcggttccattaaaaaccgggactaaaaaggatttttagtcccggtttataagagcaacgggactatttgatcatttttagtccggttcacatgttctcagggctcctgcgatcttactcccaaccgggactaaagatcctaactttagtcccggttggtgttaccaaccgggagtaaagatcccaggggtctttagccccggttggtgttaccaagcaggactaaagatcaatccctttatatatgtcttcttcctcctccagctcgagccaagcttcgaaattcttcatacaagaggggaggtcatgcgaaaatttcttgtgaatttattttagttattatatacaaatcggaggtgtctgattagcaacttcattctccaatgttttttgttgtcatattacatttggagctatgttttatacacattattgtctctaaaactttgttagaagttgatgagagagaaaatttgtgtagggaagaagaatatattgaaattttgtttatttacaattttataaaaagtttttataaaatagttgagaaggaaaatatattgaaaattaatctaaaaaaatagaaaacaaactaaattgaaaactaaaagaagtgcaacacattaaatattattttaaaactttaaaaataatttcaaaaagaataatttgtggcattattttataattattgtatgaataatgatatgtcattattgtatgactgtttagtgggtttcactttcgttgaatatttttacgatttttttgcatttcatgtagatggatcggcaatgcatgtacgcggaccggcggtcgcaagagtttattgacggcgtgcattattttttgagagcggccgatgctaacaagcataagggttttatttgttgtcgtgcaataagtgcaagaaccagaaggaatattcatttccacttgtttgagtcggggttcatgcctggctataattgttagacatcgcacggagagctaggggttcaaatgaaagaagaggaagtggaagacgggaacattccggactgggctcagtacgctggatttgaaggaaatagaatgggcgggtggacggggatgttgacgataacgatggtgcggatgatcttggtcagatgctgcaggacgccaaggaggactgcaaaagtgaaaaggcagcccataaattggagcctttataagaggaccacagaacgtcgttgtacccaggttgcgaacaggggcacaaaaagttaggtaccactctagaattcttgcaatggaaggcaaaaaattatgttagtgacaaggcatttggcgatttattgaaactcgtcaagaacattcttccggagggaaacaaattgcccgagacaacgtatgaggctaagaagatagtctgctctctaggactggaagttcagaagatacacgcgtgtccgaacgattgtatcctctatcgcggtgaggagtacgagaacctagaaacatgccctgtatgtaaagcactatgatacaagattagatgagatgatccaggtgaagttgacgggtagccaacgaaaaagagaattcctgctaaggtgatgtggtatttccctataataccacggctaagtcgtttgttcagtaacagggggcatgctagaatgatgcattggcacacagaagaacatcaacaggacaggatgctgagacaccccgccgatggtttgcagtggcaaaacatcgacagaacatttaaagactttggagaagacgcacgaaacataaggttcggtttaagtacggatggcatgaatccttttggagagatgagcagcggccatagcacttggcctattacgatgtgtatctacaaccttcctatttgcacccaaatttagcacctatggacgaaataggggaaaattgcaaaagtttggaaagtgatgggtttccttcacagggccggtcagaccacaagtgtgtgggcggtctaaccggctagtagggccggtctgactgcaggtatgtgggcagtcagaccatcagggtccgagtccgagtctgttttcgtcgggtctcgggtttccttactcgggaaggcgtgtttcgtgtttcctttggtttctatcccgagttggatgtggaggagggcctgtagagggcaagaccaacccctatttaagggacaagcccggttcattgtaaaacccccaaatacaatctacttgaatcgttcttttactatgttttctactttaccctagttttagtccatctttgtcagtttgcgccgtaaaccgtccgccgccgctgcgagagtgcgacacctctttgtaggtttgacctgaaaaccttccgttttgcccacgagacgggtagttatctagaatcagctccgctagccggtttagttatcaaaacctatctaggtttagctttttgctagatcgaggtggttggcgactctagaatcaccgcaaggcataaggtgctgtgatcgtgaacttgtcaaaaaagttgccaacacaatttttggcgactccactaggattcgatctattcggccatattacggccgaatttggtttgatctagccgtttcgtcaaatcgagggtttcggccaaacggccgaaatcaatctatctatatattgccctcgttgcattgttttcccatctagccgagtgtttcggctatacagccgaaaccgatctatacgagcgcacgtcgagtcgtcgagacagcaacaagcagccggcagcatcttgctgtaaacggcctgaaaattagaaacttaatcttattcaatttgctatctatacgtatactgaaaagaaaaagatcaggctaccagaaccgatcgatctacatacagtaggcaaaactgaattggtttctgttagtacatacattagcacatctagcgaggagaattaaaaaaaaatcaaagccgattcatattgtttcggctgttagtgtgagacatcgattttctgaatttttgcttacacacgaggagacaagcaattctgttttagttgcacacacgtttgttatacttaaggaaatcaaaaccgtatattaatttattcggtcaaagatttcggctataagctatatggccgaaattaatcaaggaatttcttcatcaactatgacgagtgggaacggttacaacaatattactacacaatgcattaggactgatcaagacgtcataaaaggaaactagtttcactaaaggtaaactctgattcacccaacccatactttgctattcaaaaggttaatgatcattgtgtagatgcatatgctatttctagttttgctcctatataatatgcttataatgctatggggtcaatgggtaattatacagctgattacacaggaatcggctatatgcaaaacctagctaacggtatgaccggtcgtgacaccggtctaaccgcatcctatgctggtcagaccgtgcctaccatagccggtcacatcgtgccctattctggccagatcggacctcttgtggccggtctgatcgcaccacttatcaccggttagaccaggccatgggccggtcagaccggttccctaggagtttctccaggttttcataccacgactagcagtactgattttaattattattcatcacctgttaatactgttagtcatgctattccacatatccctaatgcctacaatgatactaataggggatatcctcccgatactaggtatggccaatataattatattgcgctgcaacaaccacctcttaggccaccaaatacaccaccagatccacataggcctaaagatatgaaggagttaattattatcattattaggaatacatttggggttgaagcggaggatcgtgctagggagtatcaaaagccatatcctgatttttatgacatgatcccacatcctcgtggttatagaattcctgaatttaccaagtttagtggtgaggatagtaagaccacatgggagcatgtagatcaattctaagcgcaatgtggtgagactagtaatatggatacatgcaaattgcgcttgtttcctttatctttgtttggtactgcttttacatggtttacttctttaccggcaaattttatttttacctgggctcaattagaacaaaaatttcatgattatttttgcactggtaaaactgagcttaggttgtctgatttaacattggttaggcaaaaatacaatgaatctgttgctgaatatattaagagatttagggatgttaaaaaccgatgttttagtttgaaaataactgacaaagatttggccgacattgcatatgatggattgcttgattctattaaagagaaattgaatggccagatatttcttgatgttgatcatgtgttgcatgaagctcaggctcagaaaagccgagtggatgacaatagcttacaagctagtttagatgaaagtgcaatatcatgtatagccgaaccaagcgatggttcggattgtgttaataatttgtgcaatgatgccataacgattatagccgaaccaaatgttggttcggattgtcttgctagcttggataataatgcaacaaccattatagccaaaccaagagacggttcggattgtattactagtttagataatgatggaatagccgaaccaagtgatggttcggattgtgttggtagtttagacaataacaccattgaagatataaccgaactaaatgacggttcggattgcatcacaaatgaaagtgaaatagcattgtcacctaagaccgaatcacaaatcggtcatgtggatgttggaaaagatgatgataatgtcttacgggatagtagtgaaatagaattcaaagtagctatgcatatatatcaaaggtcgtatcctgaacacgtagattcggtcccatacccgcaaggatttgaggtgcccaacttcacaaaattcacagatgaagatgctagaacaacaatggagtatattggccaatttattgaacagtgtgataaggccggtagtgatgatttgcttaagttaaaattaacttcctctttctttgtcaaactttgcatctacatggtatagtttacttgctcctaattcaatttctacaaggttacaaatggagcatgagtttcataattatttcaaagatgcaagcttgatggagcaaagaccgattgattcctcattggtcacttgtgaaactatttcagttacatctatgcctaagaccagaatttttagtgatcctttccctaatagtcctattgatgttgacaaaaagaaagggaaaaatgttattattggggatcctcggcccaagactaggatcaataatgcgaaggccaaagatcataaagttgcaaaggatgagtcatctagttcctaaaagaccaaaaagccgaagctcacttttgagatgcttatggctaaatacaagaaaggattagccagtcaacgatttaataatcaaactagtgattcaaaaagaccaagatcatgtcgcaggaaaagatttggtcaaacaccaaagcaatcggagtcatcaactatacaaactccatgcaaacctccggttgtgatgccatggtatccacatccaatgtcaccgtttggttatccttttatgtattacgtgccatggatgcctcaaccacctatgctgtgtcatcaaggatggaaggaatcacctaggtcagtaccaagtcattcatttaactcaagacaagaccgtttcccacaaaagaatcggtctggtggatcaaaggtgaaaaaggtgaagaaggtgtgggtgaagaaagaagccaaagctccggaggtcgttgctatcaaggaggagtctcaagatgttcatgtacctactggagatgcggtggaaactatacaagtggagaagactgaagccgacgccgtaactgtcaacattggcggtctaaccaagacagctggccagtctgaccgccagactacggctggtctgattgaccatcctagacggtctgaccgacggcttgtggtcggtctgaccgggccgaaaggctggtctgactggggggcaatggagaagagtgggaaaaatgagagcagcacaggagcttccacttcgaccaaaaatatcaagaatcattgcatagctcctagaagacaaccatagccgaagtggatacctttcggcttatctcgctctcaaaaaaaagaaaagaaaaggaggccgaagatgtggagaacaaaacatatcataatttagagcctcaaacaacacctaagcgagtgtggagacctaaagtagtaaaagttaagagaccggtgatttcccatagaagtaacaaatctaatttgatgagagaagaatcaccggtcattagagataagtctccttcacatgatgctgtgggtgttcgtgcggtgttcatcttgccttcgaaatcgtgcagtcgagaaagccaattttgcttggggggcaagacattattatgcttatgaaggaaccaagagaagatgaacggcgaaggatacaacatcacaactttgagccgccgtttgttggatgctaaggcaaggtatgggtttattgtgttcattatcatattatatgcgtatgccatgttattagaacattgcttgctatctagcacatgtgtgtttttgcttatcaaatacatattatacatacatgttgcaaatgccagttctaagtagtggaattggtaggttggcatataatttgtttgaagtatgatttggctcatgagtctttgatatttatttanagccaaatcgtatgtgtttttatggatcaccatataagatatagatttcatatttattacaccatgaaagtcttgcttattagtaattcggctaatgtcaatggtcaatgtgatgatttgctctagagttgttttctttagggacattggcattgttaatattttgcatacatgctcaagccgattacttacatttgtagtttattggaatctatgcatttggtacatatgactttggtgattcattattgatcatacttcaattggctaagtgttttgatgccatgatgattattgtttcaaaagccacttgaattagtattcatctagacatattagttggatattacaattttttatatttctagagagaagaaattttggtccaatttgatacacaaagcatctggctataatgtgaagagaagctatatattaaaaaagccgatgcttgatttcaaaagtttggacgaaattggcaaagttttagattgggggcggtctgaccggcacatcacggccggtctgaccggtggtgacctacggtctgaccggctttgcatggccggtctgaccgggtagatggagtggtctgactggcattgcgtggccggtccgaccgattgtgggcagagagctggggggcacgtcacaattgatttagaggccaaatgaattgtaaattcggacatttgtgcccaggaataataaggaggttggatttctttgataaaatatttgaaagaccctagtcttaaggttgatcggaagattcggcggcaagcattcaaatacactttgcttgatagagaattatatcaccgaaaaatagatggaatactttttttatcaatctaaggttgctatgggagaagtacatgaaggaatttgtggaactcatcaatcggcccgtaggatgggttggttgcttaggtgagtaggattttattggccgaaagtgattgtttcgaatactatggaggatgtgaagtttgttaatggatcggcaatgttcaattagcgcctaccgccatgttgaatcctatcattaaactatggccattccgaggttgggctttggatttcattggtcaaatttatccttcgtcatcaaaagggcattggttcgtgctagtcgcaatggattacttcactaagtgggccgaagccgtgccgctcgagaatattacttgtacggaggtaattgactttattttgaagcatattgagaatagattcggtattcctcaaacattaaaggagcttcttttatgtccaaggaagtgagaagttttgccgaatcttatgatattaagttgttgagttcttctctttactacgctcaggctaatggataagccgagtcgagtaataaaacattgttgaaattgtcgttttgccagttgaggtaaatcttggctctcttcggtatttcaagcaagacgacttgtcagttaaagattacaagaccttgatgggagacaattttgaagatgtcatcgacaagcgtttgaagactttgaaagagatggagacacttcaagatgtgtttttagagagcaatcaatgggaaatacttaaagaaatacttttctagcgtttggttagatgcttaggaagtcccgtggccggtaattggattatcgtcctcagacaacatgttctatgcttttagattcacgatgttcattataaaggtagggggcatgtgtttacacccaaatttggcacctatggacgaaataggagaaaattgccaaagtttggaaagtgacgggtttccttcatagggccggtcagaccacgggtgtgtgggtggtctgaccggctagtagggccggtcagaccgccagggttcgagtccaagtctgttttcgttgggtctcgggtttccttgctcgggaaggcatgtttcgtgtttcctttggtttctatcccaaattggatgtggaggagggcctgtagagggcaagaccaacccctatttaagggacaaggccggttcattgtaaaacccctgaatacaatctacttgaatcgttcttttactatgttttctactttaccctagttttagtccatctttgtcgttttgcgccataaactgtccgccgccgctgcgagagtgcgacacctctttgtaggtttgtcctgaaaatcttccgttttgcccacgagacgggtagttatctagaatcagctccgctagctggtttagttatcaaaacccatctagatttagctttttgctagatcgaggtggttggcgactctagaatcaccgcaaggcataaggtgctacgatcgtgattgtcaacttgtcacaaaaagttgccaacacttcccccttagctatgcatgaagaggaagtacataatgatgctgattattattcaaggcccaaagcaacgtggtaacgatattgatgtgtacctaagaccactggtcgaagatctgaaactgctatggaagaaaggtgtccccgtgtgggatgaggataaacaggaggaatttaacctacgagtgctgctgttcgtaaccatcaacgattggcctacacttaacaatctatccgggcagtcaaacaaggggtacaaggcttgcactctattagtacaaagcttacaaaagaggaaaggaaagctactagagccatacccgaactcttccgaaggcttccggactccgatttctattctattcctactccactagcttaagactactaaactaaacttgagagaatatgagagagctttgcttggattgtgtgtggaggaagtgagaatgagacctccttttatagcttgagaatgacggttgtggcggttggaatggtcgggaataccctccaactgccatagggagtcgatctcagccgtccaggagaaccttggatcaaatggtgccgcggtgggttcggccaaaccatgggctgggccggcctggcccaaaattggcaggtggccacctctactgctctcatccacagacttgtaaattttggcccagtttatcgtgtcaattctgagttcttggcccattcatgcataagtctgatcctctacatcgtccgattgatttatcgtctggtttgatctcgattctcctccactttatggttattctctgcaacaggttagtaaacctaatactagtagaatattattatcttaacataaatatgcattgcaagaataactagttctcctttattttggtaatattgacggttgaaactgatcgctaacgaccatcaacacactcactgtatggatgaaactaaaagtacgtgtctgaagcattgcagaaatgttgtgtacatgggccatcgtcgatttcttgttgcaaaccaccatgtacggaggaaaggcaagcacttcgaacataaggcaggccaccgtactaagcctaaacatcacagtgggaaagcaatgtttgttatggtgaaagatcttaaagtagtgtttggaaaggggcttggcagccaacctacagagagcgaagatgataacgaggcggtgtggaagaagaactctattttttgggagttaccatattaggaagtcttggacgtccgccacacaatcgacatgatgcacctcactaagaacctttgcgtaaacctgctggaattcctaggtgtatatgggaagtcaaaagatacaatggaagcacgtaatgatctgaagcatatggaacaacacgacgaccttcccttggaaccaaaggagaaacgaagccattacttgagtccagccagctacactcttagcaaggcacagaaggaaaatatgtttgaatgcttggagaacatcaaggtaccgtctggatactcctcgaatataaagcgaataataagcatgaaggagaagaagttcacaaacctaaagtctcatgactgtcacgtgttgatgacatagctgctacctgttataattcggtgtatccttcccaacaatgtccgggcaatactaacaaagctatgtgttttcatgaacgcaatttcacagaagatcatcgatccggatagattagaaacccttcaaaataatgtggtacaatgtcttgtcagctttgagttgatattttcaccttcatttttcaatataatgacgcatctgctttgtcaccttgtcaaagagatcggtattttcgggcctatgtacctacacaacatgattcctttcgagaggtacatgggtgttctaaagaagtactccctccgtattttaatgcatgacgccgttgactttttgacaaatgttttacctttcgtcttattaaaaaaatttatgtaattatgatttattttattgtgacttgatttatcatcaaatgttctttaagcatgacataagtatttttatatttgcataaaaatattgaataaaacgagtggtcaaatgttggtcaaaaagtcaatggcgtcatacattaaaatacggagggaggatgttcgtaaccgtgctcgtccggaggcaagcattgccaaggggtatgaaacagaggaggtcattgaattctatgtagaatttattgaagaccttcgcccaatagaggtgctcgaatcacgccatgaagggagagtacggggaaaggggactctcggaaggaaagcaataatgatcgtagacaacaatttattccgtaaagcacatttcactgttttgcaacaatctttattggtggctccttacacgaggagcacttggctctagttcgcgctagaaacatcagtaagtccgatgcatgaattacacgccatcacattgatactttccccgcgtggctgcaacaacatcttatgggtaaagagacgattaaccaacaactagccttcctagtgaggggactatcgggctcgatcaggacattctaaggatatgagatcaatgggtacacattctacacgagagcccaagaaataaagagtacgaaccataacagtgttgttcgtatcgatgccatgagacacgatggtacaactggcacgtattacagtgccatcgagaacatatatgggaatttgactatggacctctaaaggtccctctgtttcggtgccaatgggttaggcgccaatgggttaggctgaccagtgaaggcgtaatgattgataacagtgggatgacaatggttgaccttaacaaggttggtgtaacaccccaggtaaccacatacctagagtgccacacaaaaatatactcaaaaccactaactcccaagatttttaaaaatttcggcagtctcccctataatacggacatccatggcaacaattataagataactcaacaacgatataatccacacaacccaaaccattctagctccataaattccacgtgaaaatagggacggaaactttaaatgtcctttataagttctacgcaaaacttatgctaaacataatcatagtttaaaactaaatttcaatagtgtgcaacaataatgtgtagtctaaaggtgcaactcccgccccatgccgatcaatgtcattaggtacctaaaaaccaaattaaacacaagagtgagtaacgaatactcagcaagtacaatattgaactagtaaaacatatacaggtttaatgcaataagaaaccaatacgaaaggttggatttactttattctaaaacaaagaagccaaaagatagtagttcccttcgggcaggtatgaatatcctcatagcattaccggtaagccgagaaagcgtgatcagcgcttctcaaaaatcatgaataaagatccaaattgcactcctatgactacacatggtacttgaataatgtaaaccaaacaatcggaagaatgaagcatgaataagtgaaacatgaatatgtagcataataccaaaaccacacagttaataataggaagcttcgaataataattgtgtaagtgaaactgaaaagtaacacagtttatccatcatacaagtccgtcttgtacttaccttaactccttcgataatccgactaaactcttccaacattagaaccctccacacatgtgaagcaaaactacacataaaccataatactcaactaatgatagttatgagggatatttactaaaatcgagacctggaacatataaaccttttaccgatttgtattaaatattctatagttgttttattactgttttatgcgtaattcacaaaccgtctaacggaatctagcaaataatacaacttcggacatctagacaaaatttcctacatctttcatgttgggcacaaactcagattaagcctctattggtctcagattaagtaaatctaattactgtcccagttaaaacagatccggtcagcagtactgtttcttttgtttctcctaaaccatttattggaaacgagcgaaaccagtggcgttagaaagatatcgacattgactacaaattttatttaggacaattaatctgaatccttacggtgtaataccagatttgaaaatactattgtcagcccataaacaacaagtaaaaacacccgaccggcaatccgatcgattcccacgtgaaaattgaactaccatggatcaagaccagttacccttacaaaggagaaaaacaaatttgaggtgaatttgtggaatcctagaaaatccccaattttgcttctgtttccccttttcttcttttaccctcctgcttcctgtgccctgaaccctctcttccctcattgtcaccaccaccaacagc

SEQ ID NO: 50459 - DNA, 23716 bp, Oryza sativa
caccaccgccagagacgccaccgccgccccaccgccaccgccatcgattcttgctaccatcctcaccaccgccatcatcatcctcccccaccgcgctgctttcgattcccctgaccgccccgcgtagccgccgccatcgtttctccccgacgccctcgccatcctcctcgccacagccatcacggtcgcgccagcgacgccaccgccgccccaccgccccgacgccctatccgtcctcctcgctgccgccatcgccgccccaccgacgcactctccgtcctcgtcaccgccgccaccgccgccccaccgccagcgacaccaccgccagcgatgccaccgccgccccactgccactgccatcgattcttgctgccatcctcaccaccgccatcatcatcctcccccaccgcgctgctttcgattcccctgaccgccccgcgtagccaccgccatcgttcctccccgacgccctcgccatcctcctcaccacagccatcgctgtcctccaccagctccctcccccactgccgtcctcgccgccgcctgtcgccgtcctcacccaccagcttcgacgccgtccatcctccccgctgccctcactgtcctcctccaccagtgccatcctcctccaccgcgccgctatcctacaagaaaaatgaatttgtgatttagaagtaaaataaatgcgtacaatatcactgacccttgaagtcagatgtgatacatctttgagtgttgatcttataatgctggctataatccaatgtcagatgttatatgttgcttgctcatggatacaaagcagtggatttataatgtcgacggcaatgcagcttaatgtacaatctgtttttatatacatctgttcatgtggatttactattgtgaaatctgcttgcgatttttcttcatttctttctgatctaccaaactgagatcatatttacatttgtctgaatcagattttctttctgttatcagatgaaaagttcaaaagcaaactaatcagagaatttcttcttgcaggtaacaagcctgccgccaggccttggttctggggttctcctccaccattccagtcttcgccgacactgcccgtgcctccatccaccgccgccggattggaactgcgcttgtgcgccgccttcgtgccgcctttgtgagccaatttcttcatattctttgcagctcatcaatgcctcgtttcaaaacaaaagattcattacctattataccctaagagctcccctttagcaattggttatatacttttcagtaatgaattttcaacatgaacagatggatgtacaaattatatgccgtaagagcatttggattcctgtttaccatgcaactctgaataggttttgcacatgcttatggatactccatgcatgagctattttagctgcacatgtacccctccagtttgagcttttatccactaattaattattttataaacatgcatggattttgcagtacagatatttggagcttttacagttacaagggtacagaaaaatccatatgggaaacaccttaacagaacaatttgtaatgctatttcttcagtacaaattgggaaacacaatggaatatcctatgttttttttatttgatcttcctgctgatggatcccctgcaggctgctgtaatcggttttcgttgagaggttctttagttagctaaaccttagcattgttagacttgctaatttatatgatgacattgtggccttttatactgtacagctggcttacacacattaagatatggataacaatattgggggctccacaccaacatcgttaagaagatcatgtgagtttttttatcgctctatttaagggcaaattattcagtgcattaagatgtgttttgcatgctgatttcgaatgatttcctccctcaggcccttttgctgatattaataatgcgagtgctggggattcgcccaaaaaacgtaacaatattggggtcttcacaccaacatcgttaacaaaatcaagtgagtttttttatcggtttacatatgtgactaatattcagtccattcatatgtgacttgcatattgatttcgcaatatttcctccctcagccccgtttgccgatattactaatacgagcgcgggggaatcacgtataaacaatgtgcctcaaaaggaaaatatgcaaagtatgaatccgaaatgtaaaatatgcaagttatgattttccattttctacctactagagttaacattaacataatttgcatgtgtgcacagaactgcaagaagatggtgctaaactcagcgcattagaattaagaaggaagcgtgctagagagaggtatgcatcaatgagcccaaagaaaaaggaggcgaggaaaatgaaggcccgtgtgtacaagcaattgaaggaggatgaatactcaggtttaactcaaacaactactaattatgtcaaaggttcctacataatcacaattatatgccaaaccagtttttaatattgttgcatgtgggcagctccacttggtgatattacaaatgttagtgttgatgatttaagaagatgccacgtaaatgattgttctacactgcagcaaggatcaaaccatgcattattacagcccgttgataggactggacctggtaacatcttcattcttacatttatcttgcacaaacaatatggtgatacagttgttttgaaagtaatgttctacgttccaacaggaagtgatcaacaacacatgatcacacctcggtgtctaccatttacagtgatcaacaatgtagctcagtatgataatgtggatcacactggatcccctttcagctgcatacttcaaggtgcaacacaaaacagccatacactacctgcaaatacaggtaaattcgtagtttttgcctgaatgaaattttgtgttcatactaatggttattattaccaatcgaacagtagtcaatatgcttgattaaaaatgtatgagattcagatcataactaatgttgcaaatattttttaagaaaaaaattgatgtattgtaaaacaatgcaaaaaccaaaaaaattaattaatatgttgaatacacatggtcacccattgacatagtacttacgttggacaactttttaaagaatgtactcaatctcatgcatttagccagcattttatctaaatggactgtaatgttaacattgattaattgtagtggagaaatgtgcggtacattattgtttcacatactccctttattccataatataaggcacaactactttttacaattgttttataatataaggcatacatgcatgtatgtcattaactaacacatcttctccactaaaatattattatttaaactctccaccaatatctctaattttattgggtgcatacattatatatattagattaatccaaactatggggtgagtgtattattatgttggaaaacaaataaggcggtcatgacgaccagggaacaaatcgaagataccaaagacagtgatgacgatgttgttatattgggtagtcatcaccagaaattcggctctaaaagggacatcaatgaaagtaaagaagtaaccgaaaaatatagttcactactctccgtggtatctacgatgagtaaacaagagttgatgagcggccttttgcagtacatccaacagatgaattgtgccgaagccatggagtaagccactgcaatgcattgtatacacaaacgtaattcaaacatgcattaacttattttctttgattgacaagaaaatataagtacaaagttcaaggccgcactttattagcttgagtctcaaacagcttcaatcaatactaaagaaggatgagccattggaaagtgattgcttcaacatggctatacgaaagttcatgtatgaaaaaatccagacaattcataaaactaaagaagcaatatcgaatcattgcctggacttgcaattttgggtaagtacttaaaatctaatgctcatgtcattctctattgctcatgttattatctacaatcacaatatcgaatatattgattattgcttatgtaattgaaccattttttaaatcatgtagagcgctagtggctttggtaaagacccggtccaccatgacaacgtacatcttgaaaagaccattggtagttggtcggaaattcattacaaactttcacattgcaaagcggtaagatcactaagatttgatcctatatggtcgtgttttatatattatcttgacagttgatcttttgtagattcttataccagtacgccatgctcgaagctttatcgtgctcatagtggaccaataaagtcaaacactctatgtattagacccaaatccacttatgccagaatataaaaataacccaaacatgagatacaccagaaaactgataactatttgtgaccactttaacaaagctatgaggaaggcatgccctggctctaggtggaatgaagacatcaacttgtggaggcaagtatttgtcaataatccggttttcgacaggtaagttatcttctaaaaactcgttcaaaccaataaatttaattctgtagtgcaagggtagctaactatcaaatttccttaggagtttatcgggttttgttgttcatctcttcatgtgtacatggaaaaataaagaaccacatttgtcggctattaatgtaagtcgtgataggcattgattatacatataatacattattttatatttaccaatatttaacttattataaatacatgtgcaggatagtgacgagctaaggaaacttttttttgctaaatctactgatgtaccaacaaaatgagtgtgaaagcaatattcctaacggcgcacaagattttctgaagtgtataaaaaatgcacaacattagggtagttatttaactatatggagtgatttaatttgaggtgatcatccattagaattaccgtatctagaaatgctggatgttccatattttttgcttgtgctttatttgtatgacatcatcaaattttcatagctgtcttctatctatgttgctttttataatttaataaacgccatgagattgttttatgcgccaaaaaggttgcactacacttctataatgataacatatatcttgctttcaaattaatctcaaaacaactatgacttgtagtttcttttcgatgccagattttatcccccgtgatcaacaaaattccctgtagcaacgcacgggcaccctactagttatatatgattattagaatttttaacaattttaaatcttgcatgtggtaattacatatgattattagaatttttaacaattttaaatcatgcatatgatatttatatatgcttataagagtttaaaaaaattttaaatcatgcgtttgttaactatatatgattattataatttttaacaatttaaaatctttcatatgctaattatatatgattattagaattttaatgcattataaatctagtatttgttaattatatgtcatccacataatttactacatattttaatctattttaaatgttttgtcattaattttgtgattttaaatcattttaatgcattatttactattacgttaaacccatatgtaatgaaaataaataagcactgttattatctttagtcccggttcttaaccctaaccggttcaaaaaagaacttggaaatagcgggaaaagatcttttcccggttggtggctataaccggttattaccaaccgggactaaagatcgtctctttagtcccggttggtgagaacaaccgggactaaagaaatctttagtcccggttggtgagaacaaccgggactaaagaaatctttactcctggttgtagctgttggtatttcttctttactcctggttgtagctgttggtatttcttctttactatataattcccagcaatagcactagaaataatcctggtatattacagttactgatgtgatccgcaagtacacgtatataccattgcaacatttcacccgggagtattccaaggtatcatatttattttatcccaaggaaaaatatgataagagagtactatgctaatagtttatactttacttgtatacatcaaggtctatgcacgggtaagttaagcttaagggtagagtgacagacagctgaggatttagctaactcctacatctcctaattatagctaagtggtagtagtttaaatatgttccatttctgtacttctagtatacaacatcttagtatactctaactagtatacactatgttgtataacccctttaacaatgcagcattgctaagccgtaactcagctatgccctcacgatgcatcgcaaagttaccccgggttgctgagttttttacaacaacctgacataaccctccaaccgaagtaggatacataggtgtatccaaccccagtaaattgtatgtagaaatataaacggcggggaagacgtccgtactaagctatcaccatcagcggcctgctactctcccggcgaacatacctctaaataatgatgagtgataacctaaaccctatgcttaagttactacttattactctacagccttgcaatcggtgcagagcatctgggtcctcgggccatagctctcgacctagccagagcagacttatgacccggtaatcagatattataccagcatcaatgcaaatcccagaaggtttaaccacacagattatactacttatgaataaactaagactgatactcatactctatgattggaataaagtaccaaacttgtataaagaagaatattatatttataaatggaagtcttacaaagaagaaaggaaaagctatagaacctttactgaactcctcgaggcctccgcggacttggaactattctaactctactccactaacactaatactaacattgtagagagctttgatccttgcttgagtgtgtgttgaaagtgaatgaggtgaggtccttttataggcaggtatgacggttgtagagcatggtaattgtcggaaataccccacaaccgccatcaggagttcgtccagagcgtccacaccaaaccccatcctgaacggctgtgatggggaaccatgatatggcctaaacggcccaatttttggcaggccgactccttgtttgctcctcaatccaaaacatggaattttgggcttaattgatcatgtcttttctgagttctcagcccatctatctataagtctgatcctcggcagcacctgattgatcgtttgtctattttctgtcgattctcctcatttatatgtgcttctcctgcatacatgttagtagcaaagtatatagtggaagtagatattttatttggaatttgtgcattgcaagcatagctagtcttcatactttggttaatattgatggtcgaaactggtcgataatgaccgtcaacaaggacattatggaagtcacagccgcgccacagccgccgccgccgctgccacaggccgccgccgccgccatcgataccgacgccgccacagccgccatgcccctgccgccgccctgtcgacgccgccatagccgcggccactgccgtcgcctctgctgatgccgccactgccgccgtgccactgcctctgccggcggccaccagtgaatgaacgtgaacgaacgagaaaaagatcatgaacgaacgagaaaatgagtggaacgaacgtgaacgaacgatagaaatgttagaacgtacgtgaacgaacgagaacgacagaacgaacgagaaaatgagtggaacggacgtgaacgaacgatagaaacgacgcacacgccgccccgcaccgcggccgcgccaatgccgccgccgccaatgccgccgccgccatcacctctgccgacgctgtcatagccgccgcaccactgtcgccgcctctgccgacgcggccacagccgccgtgccacagtcgcggccactgccgctgcctatgctgacgccaccagtcgccgcgcctctgcctctgcctctgccggccgccgcccgtgaatgaacgtgaacgaacaagaaaacgaacatgaacgaacgagaaaacgagtggaacgaacgtgaacgaacgatagaaacgttagaacgtacgtgaacgaacgatggagacagaacgagaacgatagaacgaacgtgaatgaacgagaaaacaagtggaacggatgtgaacgaacaagaaaacgagtggaacggacgtgaacgaacgatagaaacgatagaacgtatgttaacgaacgaacgagaacgatagaacgaacattaccgaacgatagaacgggacacctcgttaacgaacgatttaagttacatttatattagaacaatttagactaatacatttgtttgcattttactgaaaaatacatggtcaagcactggtcgtcaccgttgctcaagcctaagtggtatcaagccctcggaggaatttgctcaggcaagtgacattaacgatcaaacgtgattcaatattgttttgaattgtaacaatcgtttgtgcccaaattaaaattgttattacattgtaataataagttgtatttaacatacacccgacataagtcaatatatgattattagagtttaaaccaattttaaatcttggacgatgtaaattgttctcgatgtattgaagatccatataatccaattgttgtgtggcatatgttaattatgtatgattattagagtttaaaacaattttaaatcatgcttatgttaattatatatgaatattataatttaaaacaattttaaatcatgcttatgttaattatatatgaatattagaattttaaacaattttaaattatgcatatgttaattatatttgattattacaatttttaacaattttgaataaagcatatggtaaatatacatgattattagagttgttattacattgtaatagtaagttgtatttatcatacacccgacataagttgtaaataacatacgcctgcaaatatttcttgtatgaacagatggctgatcgcgatgacgaacagatacaatacgacacgatcgtagagggaagcagccagtactagaacaaagaagaggggaacgaggatccgaaccagtaactaaacgaggaggggaacgaggaggaggagggtagtggaagtcaaccctccgctagacagaagagggcacgcggacaacgaggtgctgtgaagaagattgagggtcggcacatcataactgaagtggacaaagacagctgaccaagtgccccgtcagatgcagcctggaatttcgtacgacacagcggttgggttgtgagggataacatgcctgtcagcacggtgtactggcgcagaataaggacacacggggattttgaatgttttgtcccagattcagagaaagagatgctgtggaccataatgctcgagacgttcacgctccatgagggtacggaagacaaagtgaaagagtggactctgaagaaagtgactgaacagtttcagaactacaagggagacctctacaagaaatgcatcatgaaagggcagacaatgaacttcaactcattcccgaagctcagggatcattgggatgactttgttgcttacaagacagggtaacaagggcaagcgcagatcgaccgaaacaaagcaaatcccgctaagaagaagtaccatcaccacctggggtcaggcggctatagcatcacagtgccgaagtgggaggatatcgaagccggcttgattgagagaggtatcgaaccggccatctctaaatggctggaatgatcaaagcgctggtactatgctcacggtggaacgctgaaccccgctgatggctccctggtgttcagcaatcagatacgcgaggctgccaatcgactaacggaagcagtggaagcctcttctcagggcatgtttcgaccggacagagagaaggacgagcttacgctcgctctgcagactcccgaatatccaggacaaacgcgagggaaaggcgtggttccttggaagattggattcaaggaggacatccacatgtacaggagttggatgaggagcaagagagataccgaggcgaagattgcagatctcgaagatagggtatcgaactatgagctcagtatgcaagaggaggtggcaagaaaggtggatgaaagtatggccgcacagcggagccatgagccccagccgtacattcctcctgtcatggtcagcccctcaggcaatcatagcggctgcacctcaacggggtaggtaggataacagagcatcgacgcgatgcaagctcaggatgaaaccacctgcctcgtcgatgaaatcacgcaacggacgccatgtgagctacatattccctttatgaacttatcaatcaaggtatgctcgtagttttatgatttttgacatgtacattctgcaagttgctgcttaggttgattactaatagataacctctcatcacgtgaaggtggcgtcaggaatggccattccaatggacccttgagggacttacatctgcaggccgattccacctggatactcgagggtcggagttgagctagtggaagccgtgtacgaggacctcgagttggactaccttggaggagacggcgagacgcatctacgagacacaagccacgtcattatactatggcgcaagcgctacatcatatttcttgggcgacaagcggcgtctcgtgcaccatctcctccagctcctccgcctcgtgcaccgtctcttctgcctcctacaccatctcctcaggctcctgcaccgtgtccttcggcaccttccaagttaaggtcttgccaagctccaccgcttgtccgcacaagggcaacgaagaaggcgaaagttcaagaccagccgctcgccgaaaacaaagaggaccttgatgcttatgtggtaggagaagtgaagaggcaattcaagcctcggagtctagaaaagaagatacctatagacccgagtgtgaagtacttcttcaagaaaatgtccacaacaaacaaggaggtcttaaagataacggactatgagcgaacacttaagaaagcatattacaaaatgtccaaaccagtccctcagcttggagagcaaccaaaccaagagatcgagccgttggtgaccggccaagaaattggcataaaagaattcatttctgacactgtactagctagggatcaactgcttaaaggcgcaccaatcccaacggcggaaatgaaataccaatttgaactcggtaaaccgcttgtcaagcctgagcagctgaagtccctatcaacacagatgtaccgattccatgaacggtacatggaaatgagcgccaacggtaaacagatgttcggagcaagaatcagaaactcagacttcttccaaggagaagatgttctctggatcctgttcgaggatgtcttcgacctatactatctggatgcccacgatgtctctcttctaagcacatggattttgtaagtatcattgagttagatttatttcattccttaattagctccttgtatatatgtacaccataataattccttttatcgttgtagaatgttgatttaaagggcccgacggtgaggggtttactatactggattcatcgaccctcggaaagttaacatcgaaatgatcaacaagtattagcaagacacagaggacaatctcatccatctcctgacgcagcagcatttcaagatgttcatactactgtcgtacagcacagagtgagtttttactgacttttgaacaaatttcgttcccgtacatacatgtacagtttcatatatcatctcacgcaaattgcagattccattgggtccttttacttttcgacttggaggcatgcgagtcaatgtctatgactcaatgaataaagaggagtctacttttgaccaggtttttcaactgatagacaggtaatgtcatctattccactgtcattacgaattttgctattgctactatgcagatctcggataataattaatcatagcttgcaactgcatgtagggcttgggatcggttccgtcaattggtccatgggacttggaaagaaaaacttggccggaggtttaattttccagtgagtacataatctctaattaaaatataagtgtatattaaatctctcgtcgtttctcatgtagtgtgcaaagcagacccagggaactaacttgtgcggctactacgtatgcgagtatacccactgcctatcaacccaaatctacaccacaagagagctcaatgtacgtattcaaaatttcattgcgtatcgatttcttgtttattaatttcatatattcataggttattcacatgagggacaacctcatacacaaggaatttatcacgtctgttcaagaacaactgataggattcatcaacaaactagtccttttttcttctgacataacaccaacgtcgaagtcgtagctagcgagcacatcaatgaattgtaatacatgtatatatttatatatgtacacatttactttagtgtaaatatatatgttggtaatatatgcacataaactgttaagtgctttaaattatacttgggtaattcatatatgaatttatacatatacatatgcatttgactattttgtaacatcgttactgcggaaagtagttgtgttactacacattgaccgtcgagttactatgtcgttccagcgagacaggaactaaaaaatgtataaatctcaatatttagagagcaatatctctcacgttgtatattatttttctaatccgtctgcaccgtgatgttcgtaaaaaagtgcttaacaaaactagatccatcataactattttttaacgttgttactgcgagaaagcaaacgtgttactgtacaatggttgtcctgttactgcgcaattcttacgagacgaggacagtaatgaggtgggcgtggggggaaatgagtaggcgggtttgaccaacgtttgaacggcggggggcactttgactaccctttgactgaggtgggatgtaggttttgggccctaggaagggtggggaaagtggggttgacccatgggagggggtgtagaatagttattctaggggagggttgtagaatagatttgctatatatatatactagaaaaaaatacccgtgcgttgcaacgggtgaagtctattttaatcttatcattgttatatagtttagttaagaagaaatgcactgtgagttagaaatcatgagctgcagttaggagtccaatcgtctcaagttaacatgcgagtttttttaaaaaagatttcttatatgactccttctgtatttctaaaagcgaacaaacttaaaaccgatatatatatttttagaaaatcatgagctacagttaggagtcaatcgtctcaagttagcatgcgggttttttaaaaatgatttcttatacgactccttctgtattttggaaagcgagcaaacttaaaacccgacttaaatacggatctgtattttcaaaagcaaatgaacttaaaaactgactcatacacggatgatgtaccaaagtaccggtaaaaacatcttcaacttttataatagtagagatagagatagagatagagatagagatagagatagagaagagatagagatagagaagagatagagatatttgatggtttttcatcggatatattacggtggtgatggtggtgcccaacggccaaaagcggatagccatggtgaagcaaagtgacgagccaggtcccggggagattagatcaacttctggaaggcattccatgggctgatgaatagctggatgtgggaaatattcatgggccgatatggtaaagctcccgtccatatttattggatactcacgtttgcctttctttttttcgggaaggatactcacgtttacgttcgtgaaaaaaaaaattcgatggactcgtcgcggatatgaaacagaatcagatatagatgacagtacgaaaagtaggtaaaaacatctttaatttttataatagtactagaaaaaatacccgtgcgttgcaacgggaaaaaacatgagaaatttaagaaaaggttaagaaaaatttacattatgtaattaattaaaatataaaatcgtagctatacatgtatacgatgttgaagaaaagaaaggctcataaaaatcaaggtaaatgtggaaaataaaattttccaaataagctatggctggatttaatttttattaaactctccatgattaattacactatgtgaaatttttccagtattttcagagcaccattgctaattttaataatacaaacatcattctagcatttatttaaatggaaatctaaatgaaaaccctcctttctccttgggccattttgagcccattcttctttagcccatagctgagccggcccattaacctcacttctcctcccgtccaccttggcctgtaaccgcacatccgacccatcaagcaaccacaaagtctaataagcatcccttctcctcctctcactttagtgtggtcccagtgctacagggttgtccctacctccgtccgtatatacaacgcttctaccaggtccgcaacactattccgtgcattccggcccacgcggtcgtttatgcgtttcggaatagcgtgcggcacaaccgcatgctggagaagattgcctccaaggagctcaagaccaccgccaagctcttcgagctggaggacaaggtggctcgaaaggaggaggcgtgggcctggaactcccccggcaccggcgcggcggctgcagctccccccaagtccgttccccgctctaagcggcgagataggaggaggaaaaggaagtcggcccgctccgatgacgagggccacgtccttgcggccgatgggccctcacgggccccgcacaaggaaaaagccaccggcgacaagccgagctccactgctccctccggcgagggtcgatcggcagacaagtggtcctcggtgcacaacacctattggcatagcctcgctgactgctgctcggtcaaaaacttggccgagcggttccggaaagccgatgagaagcagcagagtcgacgggagggcaaagccctcgcgacccccgccaatgaccagcgagggaggccaagaagaaggcccccgccgatgacagcgaggatctggaattctagatacctcagggaaccgtcgccactctcgacaggggggcttgtgcttacacctcccgccgcggcttcaagaccatgaggcgtgagcttttggccgccgtcccaactcacgaggcggtacggaaggcgcactggttggaagtgaaactcaccttcgaccatagcgaccatccgatagtgctcgctcgggggggggggggaggggagttggccctcgtggtctcccctaccatccacaacgtcaagatgaagtatcctagtcgacgggggggccagcctcagcatcatctccccggctgcctttaacgcgctcaaagcctaggggatgaagctccagccgtcattgccgatcatcggcgtgatctcgggacacacgtggcctctaggtcatgttgagctcctggtgccctttggcgactccaccaacttccgcaccgagcggatcgacttcaacgtggcggacctcaatctgcccagggcaggcccgcgttggtgaagttcatggctgccacccactacgcctacctccagatgaagatgccgggccccagtggccccatcattgtctttggcgatgtgaaggtcgccctggcctgcgcggagcagcgcgccgacaacttggcggcagccaccgagccgcagcccccggaggcctccgtgtcccgcgcctccaagaggcgtcttgcctcggccgacgaggtgcccgtcaaggagattccccttggcgatgatccgtccaagaccgccaaaattggcggtacgttggacgccaaataggaaagcatgctcgtctccttcctacgggcgaactccgacgtcttcgtgtggaaaccgtcggatatgcccggggtccccagggaggtgatcgagcaccgccttgccgtgcggccgggtgcacgacccatccggcaccaagccccggagaggcaagccttcacccgagaggaggtgacgcggctcctggaggccggcttcatccgagaagtcatccacctagagtggccggcaaacccggtggtcatccagaaggccaacggcaagctccggatgtgcatcgactatatggaccacaacaaggcatgccttaaggatcccttccctttaccacgcatagatcagatagtcgactccactacggggtgcgaccttttggcttttttagatacctactccgggtatcattagatccgcatggctagggaagatgaggaaaaaaactgctttcattactcctgtaggcaccttttgttatacaactatgccttttggtctcaagaacgcaggtcctacttttcagcgcatgactcgcattactttgagtaatcaaatagagcgcaatgtagaggcgtatgtcgatgacctggtcgaaaagacgcgccaccaggacacgttgttgcaggacttggccgagactttcgacagttttaagtccacgcgcatgaaactgaaccccgaaaagtgtgttcggtgtgccagcgggcaaactccttggttttctagtcttctcccgaggcataaaagctaatcccgagaaaatacgcgtgatagagaggatgcgcccaccccccagcaaacttagggatgtgcagtgcgtcacgggatgcatggccgccctaagtcgattcatatcgaggctaggagagagggtgctgcccctattcaagctcctcaaacgccccgggccgtttgtgtggacggaggaagtggagcaagctctcaatcagctaaaagcttacctcactccccccatcctggtagccccggggccagaggaaccgttgctactctacttggccgcgaccccccacgcggtgagtgccgcccttatagttgagcgcgacgaaggcgacccgcgtcgcgagcccggccatgaaaagggaccaggggcccccttgattggcgatggcccctcgtcccccgacggcccggtgcctgaagccccgaacccctgggagggtcccgaggcccccgtgggaggaatagaggctctggcgggtggccccgaggcctataatcccgacatggcccgagatccccccggggctcctgagcacgggcgccccaggccagctgcccctgacaacaaggaccggccccaccgaaaggtgcagcggcccgtctgctttgtcagcgaggcacttcgagacgtgaaaacccaatacccacaggcccaaaagatgctttacgcagtcttaatggcctcaagaaaattggccactacttccaagcgcatcaggtttccgtcgtgacctcttaccctctcggccaaatcttgtacaaccgagagggtactggtcgggtcgaaaagtgggccatcgagctcgctgagttcgacctgcacttcgaaccacggcacgtggtcaaaagccaggttctagatgacttcatcgtggagtggaccccggtggacgaccctgttccgtccaatgttccctccctcctcggagatgcgcagaagctgagaagctcgcgcgtatctctaagcagtacgagctcgtagaaggagccctctaccggcgtgccgccaacgggatactcttgaagtgtatttctcgggagcagggcgtcgagctcattgctgacgctcatcatggtgagtgcggggcccattcggcctcacgcacattggttggtaaagccttccaacaaggtttttacttgccgaccgcgttgcaagatgcccaagaatgggtctggcgatgcaaggcgtgccagttccacgccaagcaaacccaccagccgccccaagccttgcaggtcatcccgctctcttggcctttcgcggtctgggggctggacatcctaggacccttcaaagcggcccgaggcgggtattagcacctgtacgtcgccatcgacaggttcaccaagtggcccgaggcttacccggtcgtcaagatcgacaagcattccgccctcaagttcatcaggggcatcacgtcccggttcggagtgcccaaccgtatcattacagataacggtacacagttcaccagtgagctatttggcgactattgcgacgacatgggcatcaagctgtgtttcgcctcgcccgcccaccccaagagcaacgaccaagtggagcgagctaacgccgaaatcctcaaaggcctcaagaccaagacgtacaacgtcctgaagaagcactgggattcgtggctcgaggaactgccgcagtgctgtgggcgaatcggaccactccgagttgcgccacaggggaaacaccctgtttcctagtgtatggcgccgaggcggtcctaccttccaagctttccctgggtttgcctcgcgtagcgctgtacgatgaggccaaccaggatgatcttcgccgcgacgatctcgactatttggaagagcgaagaaggcgcgcggccctgcgagcgacgtgctaccagcaaagcctgcggcgctaccatcagcgccacgtccgggcccggtcactgtaagtcagcgacctcgtcctacgccgcgtacagtcgcgcttggggctgagcaagctctcaccaatgtgggaagggccatacaaagtgatcggcgttcaccgagcgggctccatttggctaaccacggaggatggcacggagttgcctaacccctggaatatcgaacacctccgtcatttctatccatagggttgcgcgttttttgctttcctggagctcggccaacctccgcacatccttcggcttgtgcgggtttggccgggggctatcactattaaatatgttgtatcttttctcttccccagcaataaacttttccgcttaagcggaggccgttgagcgccctttcttactctttcctatggctcgtcctggttcaaaggataattcgcgcttactcttgaccctaagtggcgttgggtgacctgaaaaccgccgaaagggagcctaaacgcggggcgcaccctgggctgcggcgaaccctgggggctcggaagggcctacgcatggccatccccaacccccggtcgtcgtagcctcggtctggccagacccgctgggcagctccctcggggcgatggccttgcccctcgccacctaggtgccacagaccgagcgcgaatttcccttttcaccggaacgagcccggggggggggggggtataaagggggtaagaatggcaacttaatcacaagaaagtcaattgaatacgttcgctttggttttttttttctttacttgccgcagacattcaaaggacaaagcaagaacgtaaaggtgcgaaggggaagctttatttacaaacaggatggcacgatggcctaaagtttgaagcattcactgcgagcacataacaaaataaaagaaaaaaggcggggatagtcacggagtgcccgggcccccgaggccggcgccgctgaccacctcgtcctagtcctcgctgccgtcatcgccaccaccgtcctcgctcccgctctcctcatccgaggcaagcgcgaggttgaaccgaggggccgacccctcgaagctggagacgatcgcgtcggccgcctcccggacttgctcccgagcccttgcctcggtccccgggggaaagtcctcgagcgcgcgtcacgggaagaagtcggggtcgcgagcttgatggctcgcgagaaccagctccaccgcagcccgtgccaaggaagccgacgacgacttcacggcctcgccgacctcctcctccagcctctccaaatctgcagccatcccatccagccgaagtgcatggagatgcctacccggcgccccgcgcgctccagccgttcgatggcataggagagttggccaggcccaatctcgttggtgaggcggagggccgcaatctcctcggcttggtgctgcaccaggcgtcccaggtcggcgagagtgtcttgagccgcgacgagctggctgaccaactccgcgccgccgggctacccgcctgccatcaactccttctcccgagcctccagctcggaagccctcgccgccatcgctgcgcgctcagcgcgggcgctctccagatgccgggcctcgcgcccagcgatgacctcctcacgcttggtgagttgctcgcccagccaccgcgccgccacctcgcgacggttcacctcggcctcatgtacggcaagcgcggcgtcctgttcccggcacgcctcctctcgaagccacagctcctccgcgcgacgagccaccaaagctctgcggtgagggtggtccggttgtgctcagctgcggtctcctcacggaggcgaagggaggattccgcctcggtggccgttctctcgtgggtggccaaggtggtctcgcgctggtctagcatgcgtgcccgctcctccagtgcccgggtacgctcctccagcgcccgagcatgctcctccaactcccgggctcgcagcccctgttcccggctacgcccgtcctgttcgcgctggttacggtcgaggacctcgatccgtcgacggatcatggcctcgaactcctgcatggagcgggcacgctcgtctaaggccttgcgctcggcctcgagcgccgcagtccgagcccgcagcgaggcgtcgacctccgatgcccgccgctcttaggcggccgccgcgtcgaggactccacgggcgtcttcccagatcctcggcgtgggcctcgtactgcaagcggatgtcgcccagcgtctcatccaggacgcttgaagcgatgagcgccgcctggcactcctcctgtctcccgcatgaccgagtctagcgtttcctcgcgcgcctggatctccgccagttgggcttggtgcattttgcgccccacctccaccatgtcgtccatggcgcggcgcccctcgtcaacccgcgtgcggtccgccgcgagctgtgcccactccgcctccagggccgcccgctcgtccgctagggcttgaacttgggcattgagcccctcccggacggtggaatcggcggcggcgagcacctgcaggagtggctccatgctcgcgggagttggagaagaaaaagtcgcggtccgcccccgggatgacggagtgctgctagaccccccgcgatattgggggctgctctcggccccccttccgcacggccagccctgaggacgccccagatgcagaggggaacggttgcccccgtcaccccccgccttgggccctcaggaagactcggcctcccgagtagcgctcctcgtgggtcgcgccctcgggatcgccctgggggggcgcctgtaacgtcccgccttcccccaggccaccccaggccgggtccacttacatctgatagctttcataggtcatagactgccctcacagaccaacacgccttcccccaggccaccccaggccgggtccacttacatctgatagctttcataggtcatagactgccctcacagaccaacacatgtcttttctgcacactttgtcctcactcgtgtgcacccggtaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacaccctcaccaatgttacagcgccgccgctgccatcacccgcggctggttgcacctcggctgtggcgaactcggagccagacccgccgtgtggcccgtgggccccgccagggtgctgcgaaggctccgtggcaccgggtcggccgggtcccggtcgatccggtcgcttgaattttgacccctgtgagggatcggacgccgagaccccctaggaaggaatcccgctacaggagaaccccgatcacgttaagaagaaaaagaagggggaggagcaagaggccaaggtggatagagagcaccgagtcgggcgctagcgatcctacctgcgagggggcgtttgaaggtctacttcgggggctcgatgaaactcccccggcacggctccgtttgccctatcttccggagccgcttcttcttccgtccagcctcggacgtggcggggcgtttgtggcccgctggtggatggtccgccgttcgcttagcgcgccctatgcgcgggggagaacgcggccgagattcggacacctttcgcttccctttcgggtcgcaggcccctgaggcgatccgtcactgcgtcgtactcctcgccctgcgtcatactcctcgcccagttccaaaaccgccaaccacgcggcggatcgtttgggagggccggcggggagccgaagtcgcggatgatccggcagcgcggtgtaaaaccaatccgtcttccaatcctcccacttcttgcgaaggtggctctcaatgtactgccccgccgttcctggccggggctagaagtagcatcctcccaccaccacgccttgcagtagctgtgggacgaagaaggacaggaacagccgcatcgtctgcgcaccccgacgaacatctcgcagaagtgcgcgaagatggccagcgtcatcacagcgttgggtgcgagatgctaggcatgaatttcgtagaaatccaaaacctcatggaagaacctggaaaatggcgggatcagccccaccatggcgaaggacaggaggtgcacggatcgctctgggtactgcggccgcggccgcgactcctccaccctcacgacggcgtctctggcatgatcttgcggatgaggctaaggtgcctctctgccatgatgagcgacgccgggggcacagcgtcaccagcgtcttgggccatggtgaccggcggggaaacggcgaggagtttggtgtacggaatagcgtggagtgagagaagcgttagggcttgaggagcgagtatgcgggtgagcagtcggcgagaggaaggagacgaactctccacctccctatccttttatccccgcctcgcccgcgctcgcctccttgtttcacgcccccgcggttgccccctcgattcctgcacctgcggtttcctcctcgactctcgcacccactcatcacgccgccccactgaacccgcgccccgcgtttggtgcacctgtcagcggcacattcggcgcgggccatgcgatgttcacgggcatggttaggcgggcccgctgtcggtcccgtcgcgtgcctggcaggcgggggagtcgaggcggcgtgggtgatgattctgggcgtggtctggccgaccccccgattttcgcgccctaagcgcctccatcatcggcgcagttagtggcggtcaaatcgccgttatgggcacagttagtggcggtcaaatagccgttatgactaatgcgccagcctggccgcccggcggcaaccgtctggattcctcgtcgggcccacaactcggcacgggaagtcgtgaggcgccacgtcggactgccctcggggggccaatgtccgacgcggtgccgggggctactgtcggagatatgggcccgggggtaggcaaagtgaggggaagttaccttcccatccagtcacgtggctctacagcctggccctccccccgcgcctcgcgagtcgcagaagtagccagggggcctcggggtgccacgtcacgcccctcgggctctcgcgctgcctcccccgaggccctcgtgtcacgtaccataacgaccctaaaatatatcctctaaa

SEQ ID NO: 50460 - DNA, 11161 bp, Oryza sativa
  unsure (1)..(11161): unsure at all n locations
cctcgccgatctcgtccacctctccgtttcggtcgccgaccgccggaacgccgtcgaccccgtcaacccgagccgcgccgccgcctccctccgctccgaccgccccctccgtcgtcgccgtcaccccggggtaagccgtggaccgtcgcctcctttcccccttccctcccctctctcggccgccgctccgccgcgccggtggtcgccggcggcgaccatcggggcacgggcgcgccgcctcccgccgaccgcgccggcgtggccgcccgcgtgcgcgccgagtggctgccgcgtggggcccggccgtcagccgcccgcgccctcgggtgcggctgacgtgtggggcccacggcgccgaccggtgcgagccgggtgcgcccagtccaccgtggaccgtgaggctgccgcgtgggccccactcccgtggacccggtgcgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgctgcagcttcggaagatccgctcttcgtggaggttgaagccgacgtttgggaaagcgagcaaggaaagtcacatcattcttgagcatattgaatcccagtttataaaattattttgatttaaattattgcatgatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacaccttcccctctattcaaaaccctcaaaatggttttaggctgggctcggggtgcatggttttgatagtagcacctcggccatataaggaccggtcttcgggcctctgttgcaaagcactaccatacttccacatgtctagtgggtaaggcttagtttgtggctcagtctggttataaacaaaagtacacggatggagatggacgaagtcggggtcgatggacatctctaggacaaatgaaggctacacgagctgcggcccggtagtcgagatgtcatggcacagggccggtgtcctgctgctaggggctcaatcctgcctacctgtcccgggggttccggccgtaggtggggttgggtcggtactcttgtctatggctaggatgggttggaaactatgtcacgtcttccgtccgtataccgtggtggtatgtggcacatggttacatgtgaggaagatgtgtcttgtgggtaaagatgtacacctctgatcagagtataatctattcgaatagccgcgccatcggttatgggcaagccgagcaatgtacccaagttagtgtttttaattcttaaaacctgcttaacaactaaaatgtggaatggttggcctgggttagcttgggacgagctgggacccagggtcgggttgccagttcgatctgaatcatcgtaggccttgggttaaggcaggttcatgtgggttcacggccttgattaataatattatttagctctagaatcgtgtttacaaaatagctttgagcaactaagtgtcttttaatgctgtttactgcaaaccctaaccctttatattttaacccccttgtactcccttgcatttattctacacttgtgggtgtgtcttgttgagtacggtggttgtactcagtcttgctcaattttgcccaaacccagaagaggagcccctggaagatgaaggctttggtgtctagctcgtgcctgccgtcaagcgcctgtggtcgtcgtcctagtcttccgctgtttttcgtttatcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacacctcgcccaaccgccatgtggcgggggagcgaccgggaagaagaccaagccgaaccgccatcaatgcgcgcggcgcccgaattgtccctcaccgcgtttaatgcggtaagggcagacgtgcggtgccgcccgactgacccacgtcaatcgggtgtgaccagtctgtgaccggcctgttgccggtcacgtccaattggacgggcaggcgtgcccccacgttgcctttgtatccggcaaaatggaaggtaggtatgtcccgtcccattggagcgttatccggagttccctccacgtgaggaggaccgctacaagtcttcactcatttaagagggaatgacagggctgtcccccgtgtcaggcggggggcggcgccgggtcccactcaaggacggactgcttgtttagattccgggcgaaggcacggatcgtggtccggtcaaagtaaagtgggtccctctcccgtgaaagagtaggtagaagcggcgcatgtggtatccccttgaactataaaaggaggaccttgcccgccgaaaaaggagaacgacactgagtaggcctgaactctaggaagcgaagagcaagagcgctctccggagtttaggaacccttgtaacattcaaccactaatcccacacacaggagtagggtattacgcttcatagcggcccgaacctatataatcttgttgcccatacgcgatttagaaaccctgagggcggatacacgatctcgagaggcgaaccctttcccccggccgaactcacaaaagggggatctcacgatctcccgctagagaggatcactcctcgacaattggacttacgaagaaattaacgctgaccaaacttattaagattgaattatatttttatcctatgaactgaagcaaattttcttaggtaatcatatagattgattacctgcctaagatctttaggtacctgaatgctatcagatgaggttcactccacctgaaccaatctatatacaattagccaaaattcagtattcagagtaggtttcacacttctggaatatttgcattaaatatttgacttacctaaattatttatgattagcaaaacttattctgagccgcttaaacatcaaatgttcaactgatgttattgttgctttatcttgattcaaattgttctatctaatgccttgtgccctttgactaaattgctctggtctttaccatttgttgatccatccaagcatgtcattagactgcgaaatagaacagtcaacctcttgattgaacaagtattatatttttctctctgatgggatgtatttaccaagttgatgataccaattttccagtagtcatttacgattttttttggctcatttgattattatttttcgatgctatatcacagaaagcactgtggaaaatacaagttctgaacatgctgacaaagcttcacctgctgatctgttgtgcatatggtattcctaccccactaataagaatcggtaaattcaatcatatcacagcataataggtgttaaaaagttaattggaagtctttctaactgcaatctggatgcttttgttactatagtctatttatatttgtcaactgatgctctactatcggtgcttcagagtataaggtgggagtgctgatataatgataagctgaaattgattgtatattgtatgttgcagactatatatcaagaaaatagtatggacatatggttaacctgccccaatttacttgccaaatttataatttgttcagcccaatcaatattttgtaagctagcctatgccatatcatggcttatagagaaggttcttaaaccggcatcaaagtcgtgcaaagcacgactgtatgtggctagttatatatggggtagattagattttgcacctataaatgtccggtgcttcttatgacgtcagaacacgcaaacgtccatgcgagacatttaaaaaaggaggtaaaacaagtatttttcgctttgttgtttgttctctcaaaaaaaaaatcttcgttgttttgcctttattctttttatccaccgacacccccaaacacctcccggagcatccggcggagcgctgggccctcaaggtcgggcacaagttagcagcagcatggtaaacaagcccttgtgagctggcgcgaaacatgcgggatatggagcctttcataacgccaagcacaagcacgccctccacatgtgcctgcccgtacatctcattctgctgttttaagcccaagtgtcatctcgattttagtattgctggccgctgctctgctcctggatccgatcgcattttgcatcgtgctcatgttttcgtcaatagcaaggaattgctgcttgtgtctgggctaggaggttactaggagatagtagatgggaaaggcaccaccattgcatgtgcggcaagtgattgtctctcaagtcttaattgagggagttttttttttttttctttagagcgcaattgagtgaggcatgctgttacagcatggattaccccaaccattgatgacgatagcatattccctatattaaaaaaaaactactagtaacatattccctatattagaaaacaaccaacttccggttatgaatgtgaaaataaactttgttcagatttacgattcatagtttaaagttcattttttagggacgaagcgggtacttgcgtgtctacatgtagaacaaaatagatgggcgaaaataaactgacaaaaaaataatgtggtacaggtacatcagacctaagattaattcccgaatgccaaactatactgatttcttggggttttttattttttgaactttttaattttaaaataatccatcctaaaacttatttcaaatttaaaacttttgcccgcatcacccagtttaacatgacaaaacaatactgtcactctacctcacagcaggtgtgccattgttactaatagttggcgtggccaaaaagattatttagaaataagttttgaagtgtttgtgtttaaaaataaaaatttaaaacgtttaagaaacagtaaaaatttgatttcttgctcctgctatcctactgcgacttattttgccacctactcctacctatatagttttatttactttatacaatgtatttagaaggaccaaaaatatgtcttctaatgtgcaggttcaagaggttggtcagcttagcttctaccataccacctgacacctaattacaccaaccttaccccttccagcttgcgcacgtactactcattagaggaggtacaaacatattttaagaagataaatgaggagagagaaaagcagcgagctatagatttatagccagctgtagcacgaactccaagacctagtgtgtatgataggtgggaccaagtattaatagtgtaatatataactattatattaataagctattagattggctatatataaattggaggtagtagttggctatactattaaacttgctcttagaagtggagaatcataatgaatcacacagcacaaaaaaatgatggtctctacttactcatttccaatttcttcagctatccttgctgtcaggcctggaacattcattatactttcctcaaatcatgctgtcggtagcagcttatcgatcactaatgttcatgtggatgatatttttgatagttaatacagcaatgcagaagccagatggacaaaaatttacaagtaaaaaataaattattttctatttccaatcgagaaatatgatctagatgacacatcatggatatctgagtttaaatccatgtggcagcataattttctacacattagacaaataaattaattcctgccttgctcatgtaatcagaagatggccaacaaattttactaaataaagaacggtgaaaccaaaaatttgtggacaaaaacagtgccccagcttgcaatatattagtggtttctattgattcaattgatcaagaacctccaagagtacaggcttgaatcggttgcaatcaagcttgacgttttgcttatccatgaaggtctgcctgatgaattcaaatccatgtttgtggaacgaaagaggatttgtgaagatctcatgatctaggggatattgatcagtaaggctgctttcatgtacaccaatgctatactgcttgtaacgcaggcccatttgttccgctgggttgccgaaatcaattcttgatatccagtctagtccaccccatggcacaatctgaatcaatgtagcgttttgtggcaagaacacacagttggtgagtccagcaccatggacacccatcatcacatcaacagagttgacaaccttgccaaaatgggagagatcagagctcacattggcctcttcaaccaccacctcgtaacctatctcctcagccatcgccactatctcgttaagattgagaaacattcttgtcctctgcctggatataatgagcagtcttggcttggctttgggaatctcaccaagcgcagttacaaaatccctaggcagtgagtaggtcctgcgcatgaacctattaaaatccaccattgagtagttatgtggagcttttgatgagtcaattgtgaactccatgtaagcatgaaggccaacaattgcatgcttgaagcaatgcacttgatcgtcattgttgaagtcaatcaaggggtacttggatagcttatcaaacaccaccttatacttccttgtccaccaaatagccatgtctgtgattaggaattgaacttcgccattgaattcgcttgcggttgtgaaaagagggacaagcacgtcggtgaagtcatggaatagatttccagtgtatccagtcagagcaaagaccactgcaggcacattgtgatacttgctacactcaggtgccactttgcttgatttcacggttatctctgtaatatggccgaggcagagctcgtcacctttacgagggtaaggcttaactttccatatctcctctctctttgaactggcaggttccatgtacatgacagaacttgcattgggatgaatcctaatgttgccccgcatctcacagacatttgctctgaagtttgagaaatcacatagtggtttcttgttccactcctcattatcagtttctgcaatagagtatcatcaatgaaagagcagaaacaaaagactgaatgaagcataatcagtctaatttaaggttcaatctagtagttaggaatctgaagtgtatgatgccattggtctaggataccaaaatagggttttgcatctatggccaaaatcactaaattcagatggtccattttcctgtcggcatttattgaaatctaaaatcctaacctggttccacattgtctcccttgtccgcgtccatctcaaattcatatttttcattcggtttgccatctgcagacaaagtagggccatcatacccaccaagaacttgtaagcaccagcttaacaagtaccaaaacagctagtactacaagtaaagtccaagaaacacaagaagaaacagcatctactaccttcttgcttgccattgtcagtgtcttcagcatcacggatggtataattggaaacagtcgggagggtcaccttgctatgctgtgtgtgcccctcttcctcgccgttcttattatcctcttcgcctccaccacctgcacatcccaccaccaaagtactcatacataaagcaagcatcaattgatggcgcccaaatctctcttgacctctcaagaccccgtgaatcaaagcatccagagacagagctagacaaggaaattattgacggattggaaggtgacggctcacctaacacctcagatgcagtggccgcctcctcgttcttgccttgctcgggctcactactgagtagcctcttctcctcctcactagtccctatcatcatatataacgaaaaggtcagtacgctaggcccaagatttgctgactgcagcaaggcggcaattagctctggagcttttcacctttggcggtggcgtcctcggcgccttcgtcttcgtccaccaccttgggatcctcggcggcggggaaggtatcggcggatctcctggagtcggcgtggatccgctggcggatcaggagcgagcgcggcgcatgatccaccgacagccggccgttcactgcgaactcaaagaaacgagtgaggcgcttggtgttaccatcgatccaaggatccaagaagaaaaagaagaagaagatgatgaagaagcggcgacggcatggcgtacggttgaagaggagggcgtcgggcttggagatgacgacgaaggtgagtgtgacgaggaagaagccgatgacgaggacgagcaggcgcagccgccgcgactcctgccggaggctccgcaccagcttggcgcgctcgacgggcttcatctccccctcctaaatctcctcgctcttcttgccggccgctccactcgaccgacctcgcgcccgccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccctctatttaagagagatcctatgataaagtccgactctcactctatttctaatacctattacaactccaattcctaaactgtaatcgacattgtacacatattcaacataaactctaacaaactccacgttgccctccatgctgcttgcctgaccccaaccccgatgcaccccatctccgggagccacatcgtagtgcctggtaacacctctaaccgccaagagctcgaaatctctgctacgactcctgaagaaatcctactcgatctcctccctagccgcacgccaacgagtgtcaacgtggaaaacacgcgctggcctgagagacttgctttactctagtgtaggtccaaagagatcgctttcgggttcagggtgtgccagttggtttgatcctgcaaccaacaagaaacaaagaaaacaaccaacaagaaacaaagaaaacaaagttaaatccgtaaacgataaccgatcggctgggttgccgatggcgtgtcgtttataccgggctgatgcgatacagatcataccggccatgtagtatatggagaagggataattggacgtgctctgtcggctgtagatgtcaataatatataatctatgctttgaagtactcttgaaccaagtgattaggatagatcggtcagcgcgccgagatagtataaaccacttgagtccatgaacactttaaggcagggattatatacgctcacagcatagctgacaggcaaacccaacgtgtatcggctagtaatccgataccactttataccaagatttcggtatagatcaaatatgctaaacaggaatcaatctagtgtcagggtaacctgacagactgatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50461 - DNA, 9669 bp, Oryza sativa
gtggttttacaactctagactttgggaatattctcatcacctggacaccatggaatggatggattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcagcccggtagtcgagatgtcatggcacagggccggtgtcctcctgctaggggctcaatcctgcctacctgtcccgtgggttcctgtcacaccccgaagttctcctcccaagcctaaatttaatttacaaatgaccctaagaaaataccggtgcaaagcaagagtaaacccttttaaatcaatgcaaataataatcggaattggcatgtggaatttttcttgagttctacatgtcgaaattctctaacaggatttttagtggaattttcagagccctagaaataattttaaccaattaaaattgagcaagcaatattttaattccagggaaaatcctttttcctttttctttttctttttcctcccttttcagaatgggccggtggcccattctctcctttcctccccctcctccctgctgggccggccgcaggccgaggcccagccaggccgccccgccgccctcctctccatgggtcgccgacaggtggggcccacctgtcgggtccttccccaacctcccgccgctcccgctgcgccgccgtgcccgcaaccgtcgccgcgcccacgtctccgcctccttcgggccacgtcgaccacgcccgcgcgtgcgccgcgttccccgcacccactcccctctctcacccgctcgcgcccgcgcccgagatggccgggattcgatattcgaatcccgcctctctctcctcccccacttcccacgttggccggcgaagtcccgcctctcccggccacgtccgaccctcccctcccctatttaagcttctccgtcgctccctctcactttttccccatctcgccgaactctcccgagcctcccatcgctcccgcgccgtgcaacctcttgccgccgccgtctccgctactccggccgctgctagccgccgctggggtcgccgccgcaccgcgccgtcgccgccgttgggttcgcgtggccgagatccaccccgtccacccctccttcgtcgaggttcgtcgccggagcgccattcccatcatgcgacgatgagggtcgccatgtctgccgctttcggccggcattcccgtctcctatggcccctctcttcctctctaacctctttcttttcgttctttaggtcgtcctggtcgccgtccgccgcgtgtcgacctctctccgtcgctcctcgtcgccggacgccgccgtcccctccggtgagggctccctcccctttcattttctttcccaattccccgtgcgtcgccgccgctcgcgctcgccgtcgcctttggtcgttgccgccgtccgctgccgccgcttttgcgtcgtttttgcgccgtcgcctccgccgctggatgccgtcaccggcaacgcgacgcgcgcgtgccgccgccgctagccctggccggccggtcggctttgatgccgagccgagcccggcggccgcctctatcgccgcccgtccgatcggcccgagggcgatctaggctgtcggtcccgtggaccggcggtggaccacctgcgtggtcccggtccacggtgaaccgctgtcccctgagccgttgaccagtgggccccgcttgccggcgccgcaccccctccgtgctgacgtcagccctggaaaatattgcgcaataaaatatttaaggatttttgttatagtaataaacacactgaatcttctaaaattcataactaattcatccgagctccttttaagcccattcaagtctcagtaaatcaagaaaaatgtgtagaatccattaaaaatggttttgtcccctgtttcagtagtcttatagcctgtttgcaatgtttgccttgtatgtcgctagattccggttcctccgacgctccggtgtacttcgaaatagtcgccgagattcctccagcagcagagcaaggcaagtcatgcttgtcacttgaacatgttgatcctatattgcaaatgctctattgttttctttcaaatattgcattgttttataatgttactatgggatggttacctattgtcatagccatgctactgtcgtaccatgtccctttgtcagcttggggttataacatgactagagattggactagggattgcttagccatgcttagttcaactagtgcacaatggggaaaatcctattaatgtttagactgttggttctaatggttttgttggtttagtgacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagccgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctaagggggttaggcgcagggtcctgtcacggcctctttcggatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatactaattaaatattacaactgtttaatctttcaacttctgtttataaatgctcgctttatgcaaatgaaccactccagctcttctttgataattccctgcatcatacccctattccggtatgacttgctgagtacagtgggtagtactcagtcttgctctatttttttcccaaccccagagctcgagtatgtgtcagatgaaggtttctccgaggagtaggctttgtccgtgccgtcgaggatgcctgtggagtggtggtcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcaggaatttctgggcgtgacaagttggtatcagagccgaacttgaccgtaggacaagccaaatggaaaaacctaagagccctccgaatccttttcattgcatatgttctttgcaattggatttgttccgggaaaattgggatctgttcttgtggttcaaggggaaaaatcttgatcgctcgtttaagtgagatttgtcaaaacgagtcagtctagggttttagtaaaactattgagatttattcgtcagtcagttgggatttgatgggtgaaatgcattaggtcctagctcaggaacatgggttgcaaggtatttatgttattagtgttattatagtatgtatgtaatttccccactattttatcgttatgtgagtctgtcttctttattcgctctcatgcaaaatgatctatgcataaaatttcgctcttattcgattctcttattgagtcttttattgctttatttaaatttggatttgagcatgcattgatcctactcctttgtcttctctagatggccggccaccccccccaaccaccgtggagaaggcatgatcgactttgtggcagagttggcacgcatgacgctggtggtgggctaccccaacgcgccagagtacacgactgttccaccactcagtggcgagcttcctcaccgtgttcgcctggaggtccacggctacgtgggtacctgtctagctaatatggtggttgaggcatccggaggcacagcagatcacgcctgtcaggaggcaccatacctgatgatggccagactacgggagcgccacaactacatcttccacgacacggcgtaccgatttcacccttgtcgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagagtcttcccgcgccaggaggagtccggatccgcactacaccccgcaagacgacgacggcacctgtgcgcatccagcctgcgcccaggaacccacctccgcccgcagttcccgcacctccagttccgcccgcagctccgacagttcctgcagctccagcaccagctccagctcctgttcacgtgtcagctcccacgtccgctctctccttcgctccagcatcagctgccaggggtccagccagtggcaacggaggttggttgtctgctactcccagtggcagccgcgatctcagcagcaacagctccagtagctcagagtcgggcagcggcgagacttatctgccaggctccaggagtcgctcagagggacctggtgacgagcaggaggacgccttcgactccaccgaccgcaggagctgttccgagcattaggctcgttttccattagtttatcgactgtctagcttctgcttgttagtttgtgtgtttaggttgcttgtttgggatcagttgacggtcgatatcatgtgcctctgatatggctgtctaaataaggatttttgcttgctctttaagtgttttaattcagatcagaacaattgcagtttaaattcctatgtaataaagcttagttcctgagcatctgtttttcttctttcccccgtctgcttttccctccagatggtctacaccaggaatggtagccgcgcaacaggcgagggcagcaacggcgaagagcgcactgatggggcgcatccccacagcgattccggcaatggtccgccaccacttcccgagaatccgacgctagcccatgtaatggcacatcagacccagatgatggcagccatgatgcaacagatgcagcagcaccagcagatgcaccagcggatgctgcagcacgccgaacagcagcatcagcagtttggtccccctccccctcagtccaagttgccagagtttctacgtgtcaggccacccaccttctccagcaccaccaaccatatggaggcgaatgactggctccatgccatagagaagaaactgaatctcctgcagtgcaatgaccaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaatttcgggcactccatcagggcaacgggactgtgacggagtacctccatgagttcaatcgtctcgcgcgatatgcacccgaggatgtccataccgacgccgagaagcaggaaaagttcatggcaggtctggatgatgagctgaccaaccaactgatatctggagactacgccgactttgagaggctagttgacaaggcaatccgtcaggaggatcaacgcaacaagatggacaggaagaggaaggccgctcagttcagggcacctcaggggagtcaccagaggccgcgcttcgcttccgggcagcagggtggacctaccaccatgatcgtccgccagtaccgcccgttcaaccctagcaactttccccagggcgccagaggcagtcagaaccaccatggaggtcagcccagccgcggtgcagctccacgcccaccaacggcaccggcacagtcaggcccgtccgcgcaagccaagaaggagactggaacaaaaccagggtcttgcttcaactgtggcgagcttggccacttcgctgacaaatgcccaaagcctaggcgtgccgggacaaggtttatccaggctcgtgtcaaccacgcgtccgcggaggaggctcaagcagcaccagaggttgtactgggtacgtttcctgttaactcaatccctgcaacagtactttttgattctggtgcaacgcattcgttcatttcaaagaagtttgtcgagatgcatgggttaataagagaggaacttagcacaccgatgcgggttcataccccagggaatagctccacttcggttcaattcagcccttctataacaatagaaattcaaggatcaccatttctagccaacctcattcttctcgaatccaaagacctagatgtcattcttgggatggattggctgaccaagtttaagggagtcatcgattgtgcgaatcgtaccgtcaccttgaccaacgagaagggagaaacggtagtgtacgaatcaccagacgcaccaaagcgaggggtctctttgaatcagattgaagcggaaatcccagtggacactgtggagaagaacttgaggaaattggaagatatacccatagtctgcgagtatccagaagtattccccgaagacctcactaccattgcacccaagagagagattgaattccggattgacttggcaccgggaaccgctccaatttataagagaccgtacagaatggcggctaacgaattagccgaggtcaagaagcaggttgatgagcagctgtagaaagggtacattcgaccaagtacttcaccttggggtgctccggtcatttttgtggagaaaaaggataagacgaagaggatgtgcgttgattatcgtgcactcaacgaggtcacaatcaagaacaaatatcctttgccgcgaatcgatgatttgtttgatcaactgaaaggagctaaagtgttttctaagatagacctgcgatcaagctaccaccagttgagaattcgggaggaggatattccaaagacggccttcaccactcggtacggattatatgagtgcacggttatgtcgttcggacttaccaacgcacccgcattcttcatgaatctgatgaacaaagtgttcatgaaatttctggacaagtttgttgtggtattcatcgacgacatacttatctattcaaagtccaaagaagaacatgagcaacatctccgcctggtactcgagaagttgaaggagcaccagctatacgccaagttcagcaagtgtgacttctggttgacggaagtcaaatttttgggccatgtcattacagctcagggtgtggcagttgacccatcaaacgtagagtcagttaccaaatggaccccaccgaagaccgtgtcgcagattcgaagttttctaggactggcaggttattaccgccgattcatcgaaaacttctccagaatcgcccgacccatgactcagttgcttaagaaagatgagaagtttaaatggacagttgagtgcgataagagttttgaggagctcaagaagaaattagtatccgcaccagttttaattctgcccgaccagatgaaagacttccaagtctattgcgatgcatcccgtcacggacttggatgtgtcctaatgcaagagggcaaagtggttgcgtatgcctcgcggcagttgcgtccacatgaagggaattatccaactcatgacctggaattggcagcagtggttcatgctttgaagatctggaggcactatctgattggcaaccgctgcaaagtatatacggaccataagagtctgaaatacatcttcacccaaccggacctaaatctccgacaacgaagatggttggaactaatcaaagactatgacatgagcattcactaccacccgggtaaagccaatgtggtggcagacgcgttaagcaggaaaagttactgcactgccctatgcatcgagagcatgtgtgaagaattgcggcaggagtttgagcatctcaacgtgggaattgttgaacacgggttcgtagccgctctggaggcacggcctatgctcgtggatcaagtcagagcagctcaagtaaatgattctgaaatagcagagctgaaaaagaacatgagggtcggaaaagcccgagatttccacgaagatgagcatggcacaatctggttgggagaaagattgtgtgtacctgacgacaaggaactgaaggatctaatactcaccgaggctcatcaggcccagtactccattcatccaggcagcaccaaaatgtatcaagacctcaaagaaaagttttggtgggtcagcatgagcaaagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctatctctcgagaatcatgtgtctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatacggaattctcgtacaacaacagctaccaggccagtctacaggtggcaccgtttgaagctttatacggccggaagtgccgcacacctctcttctgggagcagacaggcgagcgtcaactgttcgggacagaggtattagcggaagcagaagagaaagtcagaacaatcagggaaaggttgaggattgcccagtctcgacagaaaagttacgcggataaccgccgaagggagctcatttttgaagcaggggattacgtgtatcttcgtgtcactccgctctggggagtacaccgttttcagacgaaaggcaagttggtaccacgcttcgtgggaccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgtatacttgata

SEQ ID NO: 50462 - DNA, 4859 bp, Oryza sativa
agcccctggaagataaaggctttggtgtctagctcgtgcctgccgtcaagcgcctgtggtcgtcgccctagtctttcgctgcttttcgtttatcttcttgtgtgctgggtcttcgccgcccatgtaataaattaattaattacgcttccgcttgttaaactctgaattgtatcaacttttggtgtaccttgcctcctaggacaaggaataatgcacgcacgtaaggaacgcccgttgggttatttccggtcgtaacaagttggtatcagagcccccttgaccctaggacgagccttagatcccaagccttagcaatatttttgaaataaaaatcctttcttatttgtgaaaatcctctagtctctctctgtcctgctgcttcatttatcgccaaaatctaatctttaaaatgttgcttttctcttttgttttttttgtttgtagacggccggcagcatcaaccgtcgtggtctggacctgactggtttcgttttggagctgcgcggcatgtgcgttgtcttggggtattcgcatggagtggactaccagggcaagcaactcccggagcaggagggtgacgatgcagagccccacgctacttgggaggtcactgcagtgatcctcactggctcacccgagaggacttcgttggcagtcaccgcgggtggagattctttctccgccgcttgccagaacgccgctctcctcgccatcggcactctgcaccagcgctacccggacgagttgcagcactcgccctaccgctaccaccctcgtcgcggaggagcccgtgactacgccacctgtccgggatgctagctcggaggatgacgccaccatcatgcacctggcgcacatggctggaggcgtacgacgcggctcgtttcgacttccatcatatggtgcgtcgtgggttggtcgagaacaacatgaagatcctggagctgcgtcaggagaatctgcagctgaagaaggacctatacgcagtggaggcgcagctgtgtcagctcaagatcgcccagggagaggtatgtcgccccaagcaccgtcgcgtctgccgcagcctgaagatcaccgcccgcaagagtacctccaggcccgagcttgttcgtcagtccccggcgtggacctgcttcgtcgagacccctcgtgccgagcccgcgcccgtggttcctcaggaggagggagcctccggcgttggcagcacggaggatgcgctgctgctcaccttccgccctggcccgtcgcagaagtagacgagcagttagtagtcttgcgcgtgtgttcttctcgtttgtttttctgctagagtcgtgtggggcatggttataccggtgtgtggtataactgtgtcggagcctgtctttattttatttgtttaagcaacttgaaccttaatgaaccaatttaatagcagtaataaattcaagaattatggtagtcgtgggtggttagttttaatagtcagctttctctgtttgccgattctgtgtgggattttcagatggtgacaaccaggagaagtgctactaccggtgatggcaaccaacccgaagggtagcaaccacaacaaccatggcagcccacctccgcctcctcccccgcctccaccaccaccaccagacaccaactccatcctcacccaaatcctcgcccagcaggccaacatgatggctgctttcctccaccacatccaaaatccgccacagcataatgctccacctccaccaccacccccgcaacactctaaactcgccgagttcctccgcatccgtccgcctaccttctctagctccaataaccccgtggatgctttggattggttgcataccgtggggaaaaagttatacaccgtgcagtgcaacgatgaggagaaagtcatctttgccgctcaccaactgcaaggcccgcatctctatggtgggaccacttccaggctacgcagccagaaggacaacctattacttgggcccgcttcaccgccgctttccggaggacccatgtacccaccggagtcatggcccttaagaaaagggaattccgagagttgaagcaaggcaaccgctctatgatggagtatttgcatgagtttaacaacctggcccggtatgccccggaggatgttcgtgaagatgaggagaagcaagagaagttcttggcagggatggaccctgagctgtccgtgcgtctggtctccggggattatccggatttccagcgtttggtggacaagagcatccgcttggaagccaagcacaaggaactggagtcgcacaagcgtcgcttggcaaatttccgcaaccaacagggggctaaccaaagggtccactacaccaatccctatccagggggatcctcctcacagcagcaacaacagcagcaacctcgctccgcgccccgacctcaattcgtggtgcgcgtcccacagccgcagcagcagcagagtcagcaagggacccgtgcgtcccgtcctcctacgccagccgtgcagcctggacaaggccgcagagacgttcaaggtcagcagcgtctgtgtttcgactgcttcgagcccgggcactttgcggataaatgcccaaagccgaggcgccagcaaggccaagcgcctccccgccccaacaacggtggtaaggatgtcattcggggtcgtgtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccatggaattccttttccctcggatctaattcttctagacaccaagaacttggatatgatccttgggatgaattggttggctcaattccaaggagtagtggattgcgcaagacgcactgtcactctgtaccgagggccggaacaaccggtagttttctttgcacccccaacctctgtcggcagttcagaacttcatcagataggactgtcggaaacccccatcgtcagtgagttcagagatgtgtttccggaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagcacttccccctggggtgctcccgtgatttttgtggaaaagaaggacaagacaaagaggatgtgtgttgactacagagctctcaatgaagttactatcaaaaacaagtaccctcttccccggatcgatgatctgttcgatcagcttaaaggtgccactgtcttttcaaaaatcgatcttcgctccggatatcaccaattgcgtattcgtgaaaaagatatcccgaagatcgtgttcaccacgcgatatgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcgcaatcagaggaagaccatcagcagcatctccgtcgggtgttgggaaagttgcgggaacatcaattgtatgccaagcttagcaagtgtgagttctggttgtccgaagtcaaattcttagggcatgtgatatctgctaaaggagttgctgtggaccccgaaacagtgatcgccgtcactgattggaagcaacccaagacagtcactcaaattcgcagctttttgggtttggccgggtactaccgaagattcatcgagaatttctccaaaattgccagacccatgacgcagttgctgaagaaggaagaaaaatttgtgtggagcccgcaatgcgagaaagcattccaaactctcaaagaaaagctggtttcctcgccagtgttaatcttaccggatactcgcaaggacttcctggtgtactgtgacgcttcgcgccaaggattggggtgcgtgctcatgcaggatggtcatgtggtagcctatgcctcccggcagcttcggcctcatgaaggcaactaccctacccatgatttggagttagccgctgtggttcatgctctaaagatctggcggcactatctcattgggaatcgctgtgaaatatatactgatcataagagtttgaaatacatcttcactcagtcggatctgaatcttcggcagaggagatggttagaactcatcaaggattatgatgtgggaattcactatcatcctggtaaggccaacgtggtcgccgacgctctaagtcgaaaaagccgttgcaacactcttggcgtctgtgacattccaccggaacttaatcaacagatggaagccctgaatctaagcatagttagtcgtggattcttggctacgctggaagccaagcctaccttgctcgatcaaatcagcgaggctcagaagaatgatccagatatgcatgggatcctcaagaatatgaaacaaggtaaagccgctggtttcacagaagatgaacatggaaccctatggaacggaaatcgtgtatgcgttccggacgacaaggaacttagacagctgatacttcaggaagctcacgaaagtccttattccatccaccctggcagtacgaagatgtacttagacttgaaagaaaaatactggtgggttagtatgaagcgggaaattgcaaagtttgtggcccttt

SEQ ID NO: 50463 - DNA, 1470 bp, Oryza sativa
gatatgctgcgcgcatgcgttctagatctcgggaagacctaggataagagtctcccctatgccgagttctcctacaataacagctaccaagccagcatacaaatggcaccctacgaagcgttgtatggacgcaaatgccggacaccgctattgtgggaccaagttggggaaagccaagtgttcgggactgatatcctgagagaagttaaagcgaaaatcagaaccattcgggagaatctaaaggtggcccagtctcggcagaagagttatgcagacaaccgacgccgtgacctggaattcgcagtggatgactttgtgtaccttcgggtcacgccattgcggggcgtacacaggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgccttcgagtgccgtccgagtaggccgactcagagcaaattgaagttcgcgaagacttgacctacgtggagagaccggtgaaaatcctggacgccatggagcgcaggaccaggaaccgggtaatccgtttttgcaaagtccaatggagcaaccacgctgaggaagaagctacttgggagcgtgaagacgagctgaaggcagcccatcccgatctcttcgccagttcttccgaatctcggggtcgagattccgtttaaggggggtaggtttgtcacgtcccaaaacgaccgtaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaggttttataaaaagaaaaaaccctaaaaagtcccccttccctcccttgggccgacccggcccatctctccccccctttctctctctcctctccccgcggcccatccggcctctccccgcgcgcgcgccgctgacgggcgggcctgcccgccaccctcgctgacaattggggcccacccgtcatccccttcctcccgccgctcccgccgcctccccgcgccctagcgccgccgccgccgagaatcccgccgcctcccgccgtccccgcgtgcaataaagtggggggaattactccccgtgatcccctctgtctttcccgccatttttccctctctctctcgcgtgcaaacgggcggatttgcccccgcaaatctcgccggcgccattgatgatggccgaacctcccgcgccggtgtccttcccctccggccgctctctcccccttaaaaccctatttaaaccctccccgcacctcctccgt

SEQ ID NO: 50464 - DNA, 726 bp, Oryza sativa
attgttaaaatttctaataatcatatataattaacatacccatgatttaaagttgttttaaattctagtattcatatgtaattaacataagcaagatttaaaattgctttaaactctaataattatatataattaacatatgccatacaacaattaaattatatggatattcaatgcatccaaaacatatataatcaatacatccaaaacaatttacatcgtctacaaaacaactagggcaatacgttggcggtgacgactgaccgcacgtactttctcctcactaacgttcattccttattatcgctgcgtgagtaaggggtgttttcatttgataggaggatgctagggtcaaccgtcaccgcgaacggaggttgcccgtcaaattgatcataatcctcgtcagtcttatcctcgactccgacgatttttcttttgcctaggagaaccacgtggcgcttcggctcgtcgggccctttccccttctttcctttgctagacatgtcctttatgtaaaaaacttgcgttacatcgtccgagtatccaactgtaatgcctcgagtttcgaattaatatatttcgtggaatattagaacaaacgcacaaaagatcaatttttaaactgttgtttgaataggcgatcaggaaccgtgaatgcgtagagctcgccgagtagtgccaaatagactataagtttatagtaatcggagtctgaacgaagtcccg

SEQ ID NO: 50465 - DNA, 1232 bp, Oryza sativa
catttctggaaagcatgccgtcattaattgcagcatttgtcagaccccaccgagatagtgatgacttgtgtagtaatacttactctggtaactgtgaagatgaatactgtcatggttgttatggtatggtagataatgctggcaatgacagtgccaaatgcgtgctccttggaggtttatcagaagctaagaagttggaattgatagctggacctgaaatggtacacttacactaagatcttatcccctttgtgttatttgctgtccattatttctgtttccttccctatattcgtcatctggcattttaacattcttttgcatgattgctactgtcttggttcttaaatcatacattcactataaagattgaatgatcttctcgcctgtactttgtgcagcgtattttcagaagtgatttaagatggtgccctttgtttagcaagttgaagtctttgttactcaatgagtggtgtgttgctaataatttctgggcactagcttgtattctcgaacactcaccggttctactgaaactcactcttcaaatttccaaggtagaagtttttacagccacttcactattaatgttattgtgcatgatttgttgaagctgaaattcatctccctgctacaggaaacaaaacctatgataggggcagtagaaaattacagtgcattggtgaaaccagctgcaatatccaaacatcttaaggtagtgaaagtccactgtaaagaagttgatgaaggggtctgtgaaactgtgaagttcttgagtacattggatgtagtggttcttatcagaaggatggatcggtcgacaaatcgtaagataactgttggccctcttcattatttcaatatctctgaaatttctatttttttctctttgtgaatgaaataaagaatgactaaaattgcaaaaaagggaaaagacagagaaaggtacattttgatgtgataaagagaaaagcatgatccaatatattttgttgtcatgtatgatccatggaagtatacatagttttttcatgttgaactgagtaatataaatagaatcataatatgctgaattctaaatttgagctatatatgtcaaaaaaaaaaaaagtatttacttcaatagttttcacttcgtgttattggcacaggtttgaatgagtagttctgcacaacaacacaatttgttgacttgtgaaatagctctttattgtacatgctatctgacattg

SEQ ID NO: 50466 - DNA, 1513 bp, Oryza sativa
cctgtcagcgtcccggagaaagggggaatgagaccgggccggcccaaagtaaaagagaccgagcgcgggagggactgggccaacggcccaatagagaaaaagaaggtaaagaaaaggataaataagaaaggatttttcctgggattaaaaattgcactttggtgatttttaattggtaaaaattatttccaaggctctgaaaattccactaaaaatcctgttaacatattgtgacatgtagaatccaaaaaaacaaaaattccacatgccgattccgattattatttgcatttattaattagggaattagctctaggttaattaagataatttcttcggacggtttatttagccaatttttaaagcaagcaaaaagggggaaaacttcagggcgtgacattagctttccctaaagtggtatgcttgtagtttcctctctcattactcttaactcttcagttttaccccctttttttttttggggggggggggtggtggtgctgtaaccatatccatacctaaattgcattaacatattacttcacgcgtaagcatatttcatttgttccttagaaatcatcacgtctcaatctaatttttcctgattttcatgctatatcattaccgaatgtttcggagtttcttatattatccacctaaaaaaaatactagatagctagtaattgctgactaattcagttcggcaatcttatggatatttctctataaattagatgaacctacaaaatgataaattctatacctttttcatcatacatttactaggatatggttgctgtttgtattttaatttttttctgtatatttgttatttgatctagtgcccttgcagtttgtgtagtatcttttcaacagggatttagaattgtgccctccttttagcaagttaaagactttggtgctcaaatcatggtttgtgcctcctgacctcagtgcattaacttggtttctccaacacgcaccacttcttgaaaagcttacgcttaatctttcaaaggtattattatattctgaacatgtatacctgtgctatctaggttgtgcttgatttatttactaaaatatttgttagattcaggtacccaacaatttaggggtaatggatgacagttacaatccatgggaacaatcatttgcagctagtcatcttcaaaaagttgaaatcgagtgcaaaaatgttgatggaattgttctaaaaattttgaagatcttgaatgccaatggcgtaccactagagaatattagtattcaatgttctgactgtgagttatctataaatacccatgcttcctattactcagttacaaagccagttagcactatccatagtcaaatgttgtaagtctgacttaatcacagtatgcaacgagtatttgtgagtttaacagtatttgctaagtcatacatgcactatctattgaaacttttgtgaatgctctcctatttttacttatgctgctgccaatttgtgcaagtactatccttctattca

SEQ ID NO: 50467 - DNA, 1314 bp, Oryza sativa
  unsure (1)..(1314): unsure at all n locations
ggcgcgcgcgtgcacccgcgggtgcgcacgcggctgtcgagtggctcctcggcggtgcctctttgcccctctccccctccgtggccggcgtcaaccacggccggcgacgaggtaagattagggttagggtttcgatcttttcgatccgttggatcgtttgcttttcctttcttttggatttctttccccaaccaatctaaactctagggtggctctgataccattgttagggttgtctattggatcacctaggtttagatctagtcgggtggttctatttgcgatggatgattgaacaacaatagagaataaggaaagggtttagggatgtgaccggttgacgcgttggatgaagagcaagtcccagccatcgtcgttgtcgtcgctctgcttaacgtgggcgacgccgccgatggcggtcgtgacgaaagcggtattgaaagacagtggtgatcgtaggggatcccgcaaaggtcgtggcgggggggtggagtcttcccgtccctggttgcgccccctcgatcggttagggtttatggggtggagtggcgncgtngtnnnnnancnttgttctttgtgtngnnannnngtnnngtcctccacccctctttatatggcacagtgtgacgggggcccaccagccattggactgggcgcccccgatcagggcgcgggtcaaggcccccttgagccgttgggctcaaggggagggagatccatctaacattctcccccttgatctcactatttcctttagctttttctattccatcacagatttacatatagagtatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcctggactttgtctttcacaacatagtactttatgtcaatgtgtttggcagcaccacttgactaattgttgtgagagtacattactgtggattctttatcgcagtataactttagtggtttctcaatactatcaaccacctttaaaaccgggtatgaacttcattagccagttcacctgccccgtagcctcatggcatgctataaactcggcatacatggtagaccctgcagtggtagtatgttttgagcttttccatgaaatagctcctgctgccagggtaaacatgtatccc

SEQ ID NO: 50468 - DNA, 2188 bp, Oryza sativa
cccacacacggaggatccatagctcatacggtgttttgggcaccgatgcattctatgcattgtatgcattgttctaaaactgagaactccaatggaggaagaactacattcttaaccagtctctcaattctccccctcgaaatatggcataaacacaagtgccataatttcgatgagacatcagaagttcgctttcttttcttttgtcaacgaggacacaacattcacattctcagaaagaaataaagctgatcttgcaacacaagaccaatacattcattattataccatagttcacatttgccatttccaaaatggcaatcatatctatcaaaatccaatttggatacacttattatcaagtttctttgcaaagaaggaacataaaaacgtctggaagtaaaagtgtgaagccattcgcgagttctaggcgaagatctccagcctcaacttttgcttcaactccattggcaactctaatggatctttcacttctttgcatagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaggatgatctttcttggaatgtcttttcttgcaatgtagacactgatcttgtctcaactgtaaactgttgcttctgaggcagatgctggggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctctctttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattttggggggaaaaaacaaaactctgttgtttacgctctgtaaaattctcccgttggttcaaatttaaacagagataaaacatgttaaacaattcaaaattctattgtaatttgcatgaaaaatacaaaatacatgttcagaagcatttctcacatttatctattctctaaacaattttcacgttggttcaaattgcttagaaataaacacaatcattaaacatattgaaaatgcttccttcggccgagggacttttattaaacttcctttttttttattcggccccgagggacctaaaatgaactttttcggcctttgccagtcggcccacggccgccttgcgcgcgggcgggcgccccctcccctttccccaggccgcaacctgggcctgggccgggaaagtggctcgccgggcgctcccacatggg

SEQ ID NO: 50469 - DNA, 1406 bp, Oryza sativa
tactgcataagaaataacagaaataaaaaaaatataaggaaagatatgagagatgtagtctcaagaatacataccccactgcaggatcagctgataactccaagtgcgtagcttccgacaagccttgaagacacatgccattggtgccgtaaccagcaacaacctcatcagcacaaccaaaacaataatcatcatcatcatcatcacaaccaccagagacactcttctgacatttgtcctcacaagcttcatcgaatctaacaattgcttgtagcaaggatggcatgctttcaaggaacggagccctaccagggcagtaacttagctccaacgaaactagactcggaaaacacaaccaaatgtggtattctatagaaaattgacactgggagaggcacaatgttttcaaggatgaagacgacagtttatcgacatagatacagcaagtatccatattcagattcaccagcgatgggcagcccgacagatcaagaaaattatcatcgccactaataccttgaagctctaacctcgtgaggtgctgagagatgagagtcatgttaagcagctcgacccaatcgatcaaactgattcgtagcacccgagcttggcagcgcaaagctcgctggatccagcggacgaagagctgctctttttcaggcaagaactccgggaaattgatgttgatactgcagtaattcagaggcgcgctgctgctgcggagcgtaaaaaaagcgtccaccaagctgatgaacctgtcgcccggttcatcgtaatcccaccactccacagagaggcccggtgcttccttccagaggtggagccagcgccgggcgagcacgcacgtcgccaccgcgtcgtgcaccgggagcagcgacagcacgaggtggagcacctcgtccggcagggcgctgatgcggtccggcgccactcgctccttcttcttcatccccctggccgccgccaccgccttcctcttccggggagccaggggaggcattccgtcgaacggttcccgcgcgtgtgggtggaagtgtaagcgcggcgtcgcatcggctccgccgaatggcaccgaaatgcagccgcgcgcgcgcgtcgaacgccggaacggcagcgagatggagtctgggagatgagtttggccttgtttgctcgccgcctcgatctccgccgcttcggtcgcctcgccgcgcgcgtttacactcgcactcgcggctgcctgcctagtcgcctcgcctgctagcgcttgcatgcggacgctttgaagccagtgctagctgtactcagggttcacagttccgacgaaaaccggccgaatttcgcgaaatttcgatgtttcaacacggctcggaattaagtttcgattggaatttcgaaggttgaacagtagatttggtcgaaattca

SEQ ID NO: 50470 - DNA, 1293 bp, Oryza sativa
  unsure (1)..(1293): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctattacctcgttggatgattataacagcagtgacccatcttgtgttgatatcttccaagaagatggcttagaaggtgaattcatcatagacattggccaaggtctggataatattgtcattactgatgtagatgagatcactgatcaacaagacctgtcaacaataaataatcggagtactgatatgagtgaagacaatgacctagtatctgaagatgaagaaagtgaagacgacaatgaatcaattcctgaaatgaatgattactattaccgtcaagaagaagctgatggtttctaagtttgctgtgtgtgtgtgtgtgtgtgtgtgtatatatatatatataggtattatgtgcgcttttgttcttttgttttatgacatttatttacagaagttatttatgagtaatatttttaaaatacacaggatgacactttcaaatacaagaagctcaagaagaagctgatcatcttccaatagtcctgcaatttcaaatgagaacgatgatcccaatttagatgaagtggaagatgaggtgaattttcacttgcaaggttgttcagaacttccacctattatccccaacatagaagaccgtccactgattgaacctgaagggaaaacgtgaggtttcatcatgcaatgtgttttctagaacatagctttatctctgctgtttaaacagaagttattttgcttttgtagacaatggcatgaaattccaaccttaggaaagggaagaaggccagcaagtgttctatcctgcctactaaagaagaactatcctggcatagtccaatataaaggcaagtcagtgattgctacaacttggaatcactacaaagcagacaaggactcaaatgggagaagcaaagctgatgtggttgaagaaggtttttgggtattattatatttcttctctatttgttactcctactatcttctcattactgttttaaacatatgcagacaatttcgttttaaaataatatg

SEQ ID NO: 50471 - DNA, 1063 bp, Oryza sativa
ccacatggaaaatgggaaacatttaatgggatggttgatgatagcgaggctatggctaagatcaagagaagatctacatcttcaacagctaacaagcgtcgtcgacaagaagaagatggccatgaaagagcaaggctgatcaaggatgctcgtatagcaaaggaatatgcacaccgagtgctggagtgtagtagtggccaagacagctacaccaacactataaaacttattcttgaggtgcaatctgtcatatacctattatttttattagcataattctaaagcattagtttttaattttgtgtgctaaatatttgaattgtagagtgttatccagcatactggaatgcctctacctgttgcaattccacatccaccgccgccgccgccaccacctacatacggagtttatcattctgcagatcaatctacggtgaatgtatgtggtcatgtttctattaatattgcagatgtgtcctagagatagattttttttaccttgcaatatccagtaatttcaatgtcattttagtggcgtttactatacatatgcaaccattcaagtgtagcagtgtcatatttatcaattgatactaatagtgtaatgtctcagtggtctttatgctcatcgtctagtttattctatacttactactgcaaatcaatgttttgttcaataccatttgttacaattacatgaaaaccattaaatttcatccattgtgctttcaaatttctgtgttggataggctcgtagcagtggctcagttgttggagctggagaagagaatcatgctgggactgcaactgttggagccggagaagagaatcatggtgggattgcagctagagaggagaataatggtggtattgcagttggcgaagataatccagaagaaactttggctagaatttctctaggcatgtttggagggcatattaatgcatctggcagtgcaggtggaaaatactctcctcctttggaagagcttggcccattttgattttagaatgtttggaagaattgcactgaagtgtgaaccttgatgcactcatgcaagtg

SEQ ID NO: 50472 - DNA, 1091 bp, Oryza sativa
  unsure (1)..(1091): unsure at all n locations
ctcgctcgctaccggccggtgcttgatgttgtgtatgccgtgtgcgtgttcgggaggttttcatgtatggttgttaattttctggatacggtactgcgacttcgcgagaggtgatatgtgcgtggatggatatccgatgagatcttttgccgtggtcctgactaaccaacttggtgaagatgacaggaaatgaataggtgagaggtattgtaagtccgtggttgtacgtatgtgcctgacatgcatgtatctaggtcggtatatgtagctgtagcacaatctgaaacttgcaattcaggcaaattatcaacagtactctggatcctaattnccatttcccgggttttttggcaaagcatgattgtaaataatggaggttgtttatgaatataagggccagtatatataccactaanttgntncaaggaaaatatttacgtgcaatctgtatgactaagatatcaaaacacaaaaaaaaatctaaaactaacaatattatcaactctttaatttccaatagttgattatgagatttctattttctaatgtactgatacacgtaagtttttaattttttaaaaagagtaaaaattatatctcagatactatgatttgcatcactagatgttacaaacttgctacataattaaatgtcaaaaattaacccatggttgtgaacaattgttccaaaatataaaccatacatgcatacatggctacatcctagatcaccatcaccgtaaatagtacttacttcgtctcataaaaaccgaatctagaaccggatataacaacacattttagtacagtgaatctagacatagacacgtccaaattcgttgtactaggatgtatcatatctaatattagattggattttatgggacaaagggagtggttgctcaatcttaaaaaaccatatctaacccttgtttttttcacctcatatggtgtggaccaagcgattaatttctcacccaagcagccgtacgtcaccggtgacgcgtgcaccccacatgcaagcacacctccatcatcagtcaatgtctcaatctctcatgtctgctgccacagttactggaagaagagca

SEQ ID NO: 50473 - DNA, 1020 bp, Oryza sativa
tagtatatgccacttattagttgtgatgtattgctattcatagttcaaacagtagtgtcttttgtttaaaaggtaactgcagttgagcatggtgatcaccagcgtgtttcttggcatgtgcttcaagcctctcatactcacaaattcaggtaggcacaaagaatttatgacaactgcgtgtggtctttaatcttgaaaacgtggttttgacatggccgtagcccgcaagtttatggagcttgattcaactgaaatgaaaattgtgatttcaatttttttttgtgatggctcggtgcagggttgcttgaaaacctgaggttcagtgaaggaaacctcaaggcctaggtttttgccaaactaatatccccaaatacagggtttgccaaatttgccaaactgatatccttgataataaggctctgttttacacagtttcaaatctaagatttgttgaaggtgcgtattcataccttagaaatccatggatatagatttgtgattatattaatagtatttagataaatcatttatttatattttatagaaaatataaaatttcaaactactgtaatttaatgtaaaagctctaagcccagcaagaatatatctggagagctgtgccaaggaattcgaacagaaaattcttttatggatctgttagaaattctccatcacctgtgtatatgttcgagtaatggagtttaaagggttcgatcaaactttggtttgaaactaacgggtactctctccgtcccattttaagtatagttgtggatttttttttgttattagataataaaacatgaataatattttatacgtgacttatttttaatttattcctaaaattttcaaataagatggacggtcaaacattggatatgaaaattcacaaccgcacttaaaatgaaacggaataagtactccagaggtgaaagaggaggttgggcgtcaccagacggcggcgccatttcctccctgccggtcgccgtactccggccgctggagccatgctccatg

SEQ ID NO: 50474 - DNA, 1234 bp, Oryza sativa
tccaaagcggatgaaaacgtccgtgcgcagcgcgccgatgagcatggcgtgcgacgccgacgctcctctggcctattcaagcaaatgcttactaccaattgtcgtgtcagagaagataaggccactgcgaaggatgaggttcctgagtagcactcttggttgctccatggaccagggttcacaattccgacgaaaaccggtcgaattccgcgaaatttcgacgtctcgacacggctcggaattaagtttcgattggaatttcgaaggttgaacagtagatttggtcgaaattcagtcgaaatttatcgaaaaccgatcaaaatttatcaaaaaccgtgataccgatgagactcgaaatttagtggtcaaccggtaatgtaaaccctgccatggaaaagatccgtgaaattgtctgcaaaacaccacctattcttggatgttctgaagagaaccttcacagaaagataagagtttttggttaccaatcttgggatgtgtttagttcacgccaaaattggaagttttgttgaaattggaacaatgtgacggaaaagtaggaagtttatgtgtgtaagaaagttttgatctatgtctatggcattaactacattgccatgtaccccgaaaaaaaaaactacattgccatgtaggatttttagcttacgtaacactatattaattaagagaggaagaaactgagtctcatgcaagacacgacttcaacaagagaacctatgcactataaactaacaagttttgcattaggagagaatagtgtcttcataacagatgaagaataaatatgattggtagagaagagagatgatgtatttattaatgatccactttaagaaaccatgggttgcagagtgtagtttctattgtgatatcttattgacatggcatcatagacactacttatggacactatgggttgggactgccctaagccagctacaaacatattttaaagagataaaggaagagagagaagggtagcgggctactgatatgtagtcaggtacagcacggactccaagacataatgtatgtatgacaggtgggatcagatattaatagtatagtaagcaactattgtatgaattggttattacattagctatagatgatttgaagttagcagttggctatacttaagagcaatgtcaatagtacagccagggtttacactatcggttgaccactaaatttcgagtctcatcggtatcatggg

SEQ ID NO: 50475 - DNA, 1429 bp, Oryza sativa
tgtgggtttttggggccaattcgaattgtatgttttgattgaaataatcaaagagcatttttgggtccccagtccctgtatataggagtcgatgattgcttaagaataattggtgacttgctacgaatgtgggatagtacgaagtacattatttctaacccaattattgtttcgagatatggtagctttaggatggtgaattttgctgctgtcaagtgattgctccattcataacttttcatttgaactgaagcttgttcatgtctgattcaatagggtgccagatgcaagctatgtgcttccaggcagaacgctggctattgattctcggagacaaaatcttgcggttgaagaaggacgctttttcgcaaacaaccagggtttggagcatcccaggttgtctgaaacttcagtttctccaaggaaagaatcttaccttcacaatttggatctttcaaacgatcgaactgcgtattgccatggtcggaaatcaacggagattgtgttcagtacaagagtgccaatctctccccctggctcaaaaggccaaattccctgtccgacctcccctgtgcaatcaagagcattcgggcaatgcccaggatcccccactgctcggcaggatgattcacgaagctcaagctcacctcacccttttcctcgtcctccgggctccccatgctcatcatcacgtgtcgtcagttcacagtggaagaagggcaagttgttaggcagtggtacatttgggcaagtataccaaggatttaacaggtacttgcttttgaaagcatttactgtattttcatccttacggagatgaatatttcttttctacaatgcatactgaatcgctattcaaaaatgtatttaatgcagtgaaggtggccaaatgtgtgcaattaaagaggtcaaggttatttctgatgattctaactcgaaagagtgtctcaggcagctacatcaggtaatattcatcttgtcaacaaatagcatctgtcagcagatatttaaactttacatctttcgtactaatactacttcctatgggcaggaaattgtgcttctgagtcagttgtcacatccaaatattgtgcagtactatggcagtgatctggtaaatatagaactcatgatgattttatgatcttgtcttgagcatgtagttgcatcataagttaaacgaagacatacaatcattcaatcattacgaactctgaaattaggtgatgcaacagttagattaattgtaagtattattttccagtcataaaccactgttctgaatttgttaagagggaaactctgtggtatatattgtatgaaaatctgattttaatttgctattttatatatttttgccagagtatgcttcgttattcaatacagtctagtgagacgctttcagtcaatctcgagtatgtttctgggg

SEQ ID NO: 50476 - DNA, 1034 bp, Oryza sativa
atatgatcaattttggtctgaattcccactttggctggctggatacatatttgctgtagaggctggattgaattctattatagaaaaaagaattctcactaatatcagaagttatatatgattttacaaagatgtttgcaaaactgaaaattcatggaagctgtatctgatgaacatggaacacatcccctctgtaagtcacttccttctcttcaacacccaaaccccagatatgcccttgcagcttcagtaaaccctttgcatcatctccatggcctttcttggccatggcaccgcccttgccattgccattggcatgatcgccattgtcagcatgagccgcctccagacgaaccggaacacgccgatggcgcggctcagctgcttgacggcgttcctgatcgccggttcatcgccgtcgatcaggaacttggcggcgtggacggtgaccctcttcccccccttgccagagaggcgcttgccggcgtgcacctcgacgtcccggacattgccgtataggtagaagaggagcaaggtgtagaggcatttggacgaatggcctaggctcttggagagcttcttctgcaccaggcagtcttgccggcgagcctccttgaaggcgatgtccctctcgacgaagacgttgcgtatctggtagagcccctccttcatcgcggcgaccttgtcggcgtggccggcgagccgcgcgtcggcgtccaggctcttggctaggtcggtgaacatgtcgagcacctcttgccatgtcttcgccggcggcggcggcggagaatttgcaggtttgttgaaaggggtcgggcgcatccaggatggggacgacgaggtcgcctcgtcggcggtgtcggagaggaagtggacgcagcggcgccgatctggtcggccatctgggtcgccggggatgggtggcccagcgcggccatgtcggcgcgcaggtcgcggagcacctcctccagcgcgccgcgccagatgtggtgctgcgtcagctgcgggcagatgcgaggcgcacgctcttctca

SEQ ID NO: 50477 - DNA, 1643 bp, Oryza sativa
gcttattcatgaagatggtactgagcttcctgaattttgtgcaagcatatgaaagcaccagtctagtactaatcagacattgctccattgtttgacacagcaagctggacaaaggacaaatgggaaatgaaccaaatatcaaacctgataactttatttcaactaggctctgatctataaccttactgtgcttagtctcatcaaccaaaagtcttcgtggatggaaaatccttccccaatcaaattcgctaaatgtattcttgtttttggaacaggcattggacctatgtacagagctatgtctcttagcatgtcatccactttgtacagccctgggatgtgggatggttgtatgaatgccttcctcaccaaatcatcaaagtaatcagtcgcaacattctctatgctatttttcatacaattttcactgacgacgacacagttgttcatccaatagcttatcaattcctcccttgtgaaggtccagcgagggtatgtacccaacaccccaaagcagcgttgcaggtgtttgggaagaagcttacaacccagaataaatggagtaacaaacctgaactggatgcgacgaactgctgacagcgattcagaacaatgtaccagtcttctcattgaggttttctcgaagcagtccactcacaacttttgcagctaaagggctgcacaccctcaatgtcgcagcgatcttctttccaataacaagtaatttctggtattcttcagggtgtgcaccacccagggcattttccatgaacatgcagccgagatcttccattgccaggaaccctacaggtaagttttcatgctattgatcttagttgccagatgttggtacatagtggtaatgatggccttgcttcctgctctacttttcatgaacagtgtatcgagtatgtcattcattcccctggggtagctagaagcaccatcaagaacaagtagaaatctctccattcttagcctttctgatcacacttgaaagattaatggttacgttagaactcaaaccaagcttcttgcacaatgactttaccaaggccatggctggactagtatattctctgcaattcacccatataatcattgagaaatggctcctcaccttgcgatcgtcgcatacgagccgcgcaatcgtggttttacctactcctttgacaccccaaatgggaagcacacaaccatctggagaggatgatccattcttgtctatgtgaagcaagaattcgatggcctgtttcctctcatcgactctgccaactaccctgtcatggatcgaaacaaagatgataaccggtcgatgatgtaacactgcttggtcattctgcaagctgagaagctgagtgaacttggggatcccagaagctactgcttctagcttcttgacagtggcagaaactttcatggtggattccttggatggaatcagctgcgatgctgcgatcttgatgcgtttgaaggagttactagaatcgatgatggagctcaccttgctggacatatctctccagttgcgcagtgtctgatcgcctcgacatgcggcgtcctcaagctcgcgtagccagcgtagtagccatgaattggtgatggcacaccccttggctgcctccagagcggtgtgaatttcg

SEQ ID NO: 50478 - DNA, 1242 bp, Oryza sativa
ccaaggatggcatgctttcaaggaaaggaacgctaccagaacatccatctagctccaatgaaacaacacttggaaaagacatctgagtacgggtagctggataaaattcacaggaggcaaggctcaagattttaacggatggagatgacatcttctcggcattgatacggcagcacttcatcttcagagcaatcagcgccgggcagcaggagaaatcaagaatgttatcgttgccaagaacaccatcaagctctaacctggtgaggcgctgagagatgagaggcacatcaggcagcgtgatgtacgcgggcaaagagatccgtagcacccgggcatttggtgggctgccccaaaaaaacagggctagcatgatccagcggttgacatgccaatccttccccttgtcctccgggaaatcgaagtccaggtcgcacagctccagaggcgcgtcgcggcggcggcggctgacgaagaggccgtccacgaagcggatgaacctgccgaggccgtcgccccgcagccgcggattccacccctcgacgtcggtgacgcggagcgccggcgcgtgctcccagaggtggcgccagcgccgggcgagcacgcacgtccgcaccgcgtcgtgcgccgggagcagcgatagcacggcgtggagcgcctcgtccggcagagcgctgacgcggtcgggcactttctccggcgccgctcgcctcggcggcgccctcctaatccggggcggcattccgtcgaacagttgccgcgctgagcgattagccgggcaacggagaatgatagagagaagcgagagatatactagttttataatccatcgaaccgccgccgcttcgatcgccgggcgttggcgagcgcgttcattcgtcccggaagggaggccgcgcgtagggccgaaaaatgatccgcactcctatcctccacctccgctactgcagttttcgagctccgattcatacactttctaaatactactccctccgttttacgatgtaagtcatctagcatttcccacaatagcagactaagtagtttctaagagcaggtacaatagcagactataagtcagctataaatatattttaaacagataaatgaagagagagaagaacagcgagctacatatctatagccagctgcagcacggactccaagacgtaatgtgtgtatgacatgtggaacccggtaataataatatagtaagcaactattgtatgaactaggaaggtagcc

SEQ ID NO: 50479 - DNA, 9723 bp, Oryza sativa
  unsure (1)..(9723): unsure at all n locations
acataatgttatagcatagtatgtacagatatttataaaacccaaatgttcatagtcagaagatattttcggtgaatcggaataggtgaatcgggataaggagattggaaattaattgtttgactcactctatccattctaaaaaccaaacttagaaatatatatatgaaatttgtatcaagatttatactttacgggatgaagaggttactttcatctcttaagaccggtaagacggcacgtatcatatgtcaatcaccacgttccttcgacttcacgtcagaggatcctaattcggcactgatatatcagtgaccaggtgagagagaagcgagtcagacgagctcaatcccttcccgacggccggctcgacggcattcctcacacgcgagtcgccactcgccggcgcggccgctcccttccccgcacccagcaggcgaggcgaggctcgccgggccttgccttgctcccctcccccccttcggcttcaagttgctcttactctccaagttgctcttcctgtctcaactctgttcttctgttcctaaccccaatttcgaattctagttcgtaacattggttaaaatagtcgaatgattaaaattgtccttgtcagtggttagattaaaattttactaccctactactgcagcagttaagtgctcatctaaagactataagaacttgacaagttgacatcaagtgtttgatctgaattcactgtatttattatctaatctgcttgcttatcttgagtggttaactattttacatgacacctggtcagcctggtgttgttcttttttcttttcattgcttcactttatgtaattttgtctctgtttggtaatcgaaatcttcagagttcacaatcaaacaatgggcattctctagcttgtctgcacataaaagataggatatgttgttttgttccctttatagtaaccatattgattcagatccaccaaacttatattgtttacccttatgaccataatcaaatagtgtaagtgtggtgcaatagacgcatgaatttctgtatcaaaggcctatctgttgggaagcaggaagctttatcaaagaagtgctctgttgtgagtacagggaggaggtgataataagtcactgttaggataaaacttttgtgagtgataacaaggacaactgcatttgagtctattatcaaatcactgaaattttctacttatctcatgcaggtttgtgtttaggttggccgttttggatcaaagcaaaggttctgaaggtttgggctgttctctattgacgtgtgcatgcagtctcccttattattcagaaacgacgacagcagtggcgttgctgtcctctgactagtcgtgtctcattctccgtaccatattgatgcaatctagacatatcgtttgctgcaatgtcctttttatgtgtttctggccgagcggatgtgcgagcctggattcttcgtttctgtgttgatcttcagtggctcagttcaactagttggcactttggcctgctatgtcaccaattaatttgtgccttttattattaggccttatttagttcccaaaacaaaaacttttcacccatcacatcgaatgtttggacatatgcatgaagtattaaatgtggaaaaaaaactaattacacagtttacgtgtaaattacgagacgaatcttttgagcctaattgcgccatgatttgataatacggtgctacagtaaacatttgctaataatagattaattaggcttaataaattcgtcttgtagtttcctggcagaatttgtaatttgttttgttattaaactatgtttaatattttaaatgtgtgtccgtatatccgatgtgacaatcaaacccaaaaaatttccccaactaaacaaggccttactagtgagaagcgctatggttgttaacagatgaaaataaataacatgaaacaaaatcttggccaaatcttgtttgttaagagaaaaataaaggtttgtcaatgataaaatagtagtaaattgtattcaaattgagatcatctaatgtaaggcatggttacttacatgtgggacctatccacaggctcacatatcagtgaccacatcaagtgggaggctacgttagaggaactctcttcgctgcactactatttgatcatgtgctctctccgtctcaaaaaaaaaaaaaaactcaacctagacgggaggtgtgaactatcctagtacaattgatatggacaattatatatttagattatcgtagtaggagaggtcatatctactttttttttgacgaagggagtaggtatacgcttgataataaataatactccctccgtttcgttttgtttgtcgtttccgacagcttcggcgagattaaggttgacgtgaatttacccttttgcccttcctcttcactgattcattccccttcccttctacgcgtgacggcggcggtgccccatctcgatcccgagcgtcgtggcagggccgacggcggggacggcggtgctcttccccaccacccctgtcgcggcttccccttcccacgggcagcggcgccggcatcctgcttccccccgccggtgagcacacccttctctttcccctcttcccacaccttctctcacctccctcccgtctcttcgcgagcctgcgcccaccgccgccggtgaagtcgccggccaccgcatcccgccgccgctctccggctactaggggtatctggccgacgcatcctctcctccgaagctgtagagtagtgtagtggcgggtggcgttctttgcgatttgccaccaccgggcagcgccgccggctcgccatcgccggagcccagcaagaagctggcgtactgagattttggtcagggtagtactcacactgcggcactgccaagtccggcggctcgttggaggtttagcatattgggtttagatgatgctgatcacgttcaagatgatgatgatgatgatgataatgaattgatgttggtttaataaggttttagtgggtggtgattaaggtttgatcttgaattgttcatgtggcagtagcttttgatcttttgattattcgcaatattacttgtagatttgctctgaatttttgcaaggtgtgttgtagataattcttcattttgcaggaacgatttgcttctaataaaatgcttagtgtgacaatgaccatcatggcaccaatatttcacttgtaattagcagttttacctaggtaatctgtgactaatgcaatgctgacaccacagttgagctagatcagtggataaagtagatattatctgaacattatttgtgcctaatgtaatgctgacactatagttgagctacaccagcagaactaaattaaaatgataaattctatctgattcctggacaacagtgtatggtttacggagtagtttctttgaattgatcggttgttgtttaccatgtgtttcttgtcttctggtattttttaccatgtttatttggttgttcatttcttgtccgttcttgattttgtatggaagatactgggtgttcttcctggacgccgttggtcatgacgaaggaggagggcagggtaggtagacgtcgcaaatttgtcacaccatggaagaaagcggctcagaaggtcggcgacgncggtgcagaggatcgtgtcgagcgcctcgccgccgcggcttcgtcctcaactgctctctctccaaggttcgtattcgattttttttcgatgatgtattttgtgttcctaaaatgtgttattttcaggaaaactctatagatgctcactattgcgaggttaaatgaattttcacatctaacctcacatagttcagttcatggctactgcttgtgcaaaattcgattaattagagcaaggaaatagcattgtatttctatttacagggagctattgctggttgttctagtttatgcaaacatttagcataagtcttttccttatcttattgcttcataaattggagttcttgttattgtataatttcttgttagatcacatggttgtctgtccagttatgctatacaaccagtactagatgtcttacagaatggatgcttttaccttttctcagaaccttactatgcttttcactcttaacatttgatgcaacttataatccaaaatgtgcattcatgacaacttcgttgcaacaccttttgcagggttacactagatgggtccaatgttggagggaaaaaaggcaaaaaaaggaagtctccctgcgtggcaatgccattctttagaaccccgttgagcagaatgttactgtcccctagcatacggataaggtctccttctatacaacaacgaacatcaccttctgctacaacccatggaatttgtcaaggtcgagagcaaagaacaatggatattgatttaaatttggaaccgggagatacatatgctgccacagatcccggagaggctggatttgatcacagtgctgccacagatgctcaaggcaatggagaggctggattcgatcacagtgctgccacagatgctcaaggcaatggagaggctggatttgatcccttcgattcaaatgctgatgatgatgtcctagtcactctagaggagataggtgttgaccctggccaggagaatgtacagcctcagtttgatcctttcttcgattctgatgttgatgatgctatcctagttcctcaggagaatacacacaagaatgtcgtgcttgataatgacaaacggagagcaatctttgacgccatgcttgtaaaggcaagaaaaggatatttgaagggccatgagagcaaggaggtttcagctaaattctcggtgcctatcaggacagtacagcggatatggaaaaaaggcaaaagctgtttggatcaaggtatttcagttgatgttgcgagtggaagatctaggtgtggcagaaagaagaaggtggtggatgtgtcctgtctcgaagatatttcaatattgagccgcaccacaatacaggatgtagctactcaacttggtgttagcacgagtaaggtctacagaatgaaaaaagagggtgctataaagcgtgtatctagctcattggatccctacttgacagaccaaaacaaaattgatcggctgaagtggtgtattgaaatgcttgacccaaggagtgtgcctcacaatcttgtcttcaaaccactgtttgatttcattttcatagatgagaagtggttcaacattacgaggaagactgtgcgatattacgcagctccaactgcctcgcgtcgcatcaggacaattcaaaacaaaaacttcatcccaaaaataatgatcttaacagctctcgccagaccaaggtttgactcaaatggaaactgcatctttgatggaaaaattggatgttttccttttgtgacatacacagctgcaaagaggtcaagtgtgaaccgtcctgcagggacaatcgagatgaagcccattgagtcaatcacaaaggaggtaatccgaagcttcatgatagaaaaggtattgccagctgttcgggctaagtggcctcgtgaagacgctggcaaacctatatacatccagcaggataatgctcggcctcatattgcaccggacgacagaatgttttgtgaggccgcgaagcaagacggctttaacatcaaacttgtttgccagccggcaaattccccagatttgaatgtcttggatctgggtttcttcaactccattcagtccatccagtacaaatcagcctcaacaacaacagaagaacttgtagccgccatcgatcgagcatttgaagattatccagtgaggctatcaaacaggattttcttgtctcttcacgcatgcatgagggaagtcatagaagtactcggtgacaactcctatgatcttccacacataaaaaaaggagtgcttgaaaggcaaggtcgccttcctttgcaactaaggtgtgatgctaagtcagtaaataatgctaacaattatctcaggtaaactactttggttatattttattttcatgaaaatcgcttcatgtgcctaactagtttgatgtgtgctaattagtggcattctttttactccttttcaggaccatggcagatacctgatatgaatttgtttgttgctgcagcagggtgcggatatgaaattgctgctaagctaatctgaaattttttggtgttgctgctgttgctgttgctgctgttgttgatatctgaaattgttggtgttactgctgttgctgatatctgaaattgttggtgctgttgttgatctgaacagaatgaattggaggctttcttttttttctctctttttctagaaagtagcccatgtgtgcagtcattctgtgcagaacatgtcctttgatttttgagaaagcaggaggatatatggacctgaatatgtcctttgatttttttattagtatttttatttcacatgaacacattagctaagcttatctaagatcaatggtgtgaactgtcaatggtcctttgatataattacagactagctatctcaatttacaagaaacagcaactgggatggcagcagccactttacaagctctgtgtctgaatactctgtttacagactagctatctcaatttacaagaaacatcagctgggatggcagcagccactttacaagcttggtgtgcatctctgaatctgtatctcaagttccaatttttgtttccaatttctcattataacatccaaaattcccacgcatattacatcactgacagtactaagcactaatcatctgatcaaatacacaacaatcagtccccagtgaacacgaccagaatttcccagaaacagaaaaatttccccttcgatgaacatcaaatagccaagcaaatgcaatgtgcattctctaaaaaacgaacatcaacaatcaacatacggctaaccaaatcagacaatctgcaggccgttcagtagcttaatctgcaatcaagtgcacagctatcttaaccggatgaaataatcaggtaaattctggacatccagctgaagaaagaaaaaagaaaggaggagacttgtggcaatggagcttttcgaagcccggcgatctcctgcaccaacgagacgtgcaccagcaccgtcctccacgccatgtatcagcctgcgaacccgccgcggccgcgagcagcgaacgaaagaatcagggaaaagccctcgagccaaagccgaatcgagaggaggagagggcagccgtaatgagggcgatgatggagaggacgaaggcgaaggcgaggagcggccggaggacggaagacgacggcgatctcccacgctgccgccgccagcgtggctcctcctccggccatggtgccgcggcggcgctttgtcggcggaaggggactatgcgcgtgggaggcggcgccggacttgagcgccatgcgtgaagggcctccccgtggcaggggcaggaggaccgccggcggaggagctcctctgcttttccgcgccgccgactgaggggtaaagatggaaacggtatcggccggtgtactacgacgtcaaacattttgactctttttgaaatgagctacagcgacaaacaaaacgaaacggagggagtacttaattaatcacgcgttaatgtgcaacactgttttcccgaactcagcctaaatagtaaaggtgcagtgttcaacacacacaagggaacacagcttcactaaaggatgagatattcaaatattgtttgtataagcatttgagaaggatctatatggcagcaggttcaatcaaaatgggttagtcctaaaaaataaaatcaaaatcacaatgggctgaattggaggataatatgtgcatttgttgacatttccatcagtaaaaacagtagaacatgcacaaaagtatcagcagatagtacatgtaagacatagcaaacaaaattcagaaatactcaatgcatactgtgattaagtcagaacttatatataactatggacagtgcttggctctacaacacatattgacaactgcataataggaagcgtgggtgttcatagataactcacagccagaacatcggatactaattttctctagtggtacaccattggcattcaagaccttcaaaattttgagaataatcccatcaacctctctgcaatagatttcaactatttgaagatggctagctgcaaatggttgttccaattgattgaaacttccatccattcccactaaatttttgggtacctgatgccaacaaatactttactaaacagatcaaagcaggacatacatgtacaaaatatagtaatacctttgaaactctaagaaaaagcctttcaagaagaggtgcgtgttggagaaaccaagctagtgcactgaggtcaggagccacaaaccatgcattcagaaacaaagtctttaacttgctaaatgtagagcaccactttaaatccctgttgaaaaggtactgcacataatgcaaggtcacaagatcaaataacgaatttaccaaagaaaagttaaaatgcaaccagtgatcatatagtaatgaacgtctgatgaaaaaggttttataattcatctcttctgtatgttcatctaatgtgtacaaaagtatcctaaggctggcgcaattcaaataagttagcaatcactatctatctggttctgtaagaaattgcaaaactttcaattatgctgtagcatgacaatcatgaacaattaggtgaagtgtgatgatttgaaaggaacaaatgaaataagcttatgcatgaagtcatatgtcaatgtaattttagctatggttgcatcacaagaagtgataaaactcaagataatgctacgagttacgagagaagaagctgcaagcataccactttagaataagctaacaaagtcaagtccgtagcttccgtcaagccttcgagaaacacgcagtcgtattcatcaggcctataataatcatgacaacccttacaaccagcatccccgcaatcatcgtaccaaccatttgcgcatcggtcatgacagaaatgatcaagcctaaccgccgcggttgccaacgaaggcatcgtctcgagcaacggagtcctcccggtatttgtgttgaacttgaaggtgacaaggctagggaaatccatcctggtgcgatagtcgcagtagaagacgcagtatgttatgctcagatgcttcaacgatggagaccacatttccaggccaccaacgtagcaatccttcatcttgagatccaccagcgaaggacagctcgagaaatcaagaacctggtcgtttccctggacacccctcagctctagggttgtgaggctgtgggagacgaggggcgagtccgagagagggatgggcacccgggggtgggtggagacggcgaaccggagcgcccggacctggcggcgaaaggcgcggcggatccaggtgtcgccctgcagctcctcgccggggaaggcgccgtcgaatctgaggtcgaagtcgcaggcgtccagcgccgcgcccccgcggcggaggcggagcaggctgtcgacgaagcgggcgagcgcgtcaaagcttgcccaccccctgtccccgacgacgcggacggcgggcacggacctccagaggtcgcgccagcggcgggcaagcacgcaggtccgcaccgcgtcccgcgacggcaggagggagaggacgtggtggatcacgtcgtccgggaggtcgctgatgcggtccgctccgctcgccatgtggtggcggccgggctcttc

SEQ ID NO: 50480 - DNA, 3225 bp, Oryza sativa
ctattttaatatgtacggcttatagtgctatattgaaatatatttgttattcggtgccaaaacaaatatgtttgttattaggaaaattttgatatagaacattgtggcattttttcctctgtaaaattcaaataaaaatatagtttctttgtcacgggataatccgttttgttgataattagataaaaaacaatggtcctattactcatttaacgtaggggccttctctacagtactttggtaaaaattggagaggcaaaattttcgaagcactactgacctggccaagtggcaagccagtgttttatatcttcgattaaaattgttaaaattccatgtcatacctttcccttgaaaaaaaatcaatttttaatctatgaaaagttattaaattcttatctttttttattcaatttatcaaaaaatcagatatttccattatagtggtccccaaattgtttttggttttcacaatttggaacgagttttgaattttgcaaaaaaaaaagaattgcttacattcaacccatatttcttcacatttctattatttacattatttttttcaaaatttcagaagttcccattctactgttcccatgatttttttccctcaatttttgaaacaaaaataaccagtttgggcgtgcaagttggcacttggctaaaagtgtgatttttaaaaatcctataagcgtaatgcccatgcattatgtgagtgatgatctttgggagtgaagtctcctcgttcttgaaaatcatttgttacgttcctacaatacttcctatgatattaggatgaacccacatgtttctttgttgcggccagggctatcctgggcatgagcgagacagggcccaaaaaatttgggatccaaaattttatatattttaatccatactaatattttctgagttctgatatgtttcggattaatttctctctttctgtttcattgaatttactcctttggttcggtgataattatagctacactgaagaactatatacctcatgacagtgatgtgaacgtatcatctagaaaatacaatttcattttttccacttaattagtgagaagaactgaattggtgcagctatttttcttttacctagctagatcgtcatatgcgtgtgagctttttttcatagctttagctgtcatataaggcctcattttatatcttgtaccggacctccatatttttgggggacggccctggctgtggatgtgatgctatgagtccaccatacgcggtgacgaatccaaaagaaatagcagggttatgcacaaactagacaaggtgcaaactccttttcattacatatttagagattgaaaggatgagaagaagatttcttttcaagaatgactagaagtggaaaaaaaatcctaggctgttttcgtagtactgattttctttaacaaatacgaagtatttctctagtcctgctgcgtggtgcggtggaaaatggaaaggttgaacatgcaaattttggtattgttcggtgtttcaaaaccatgcatatagttcaccttctccacacagagagacgagcccttttaaatgatagcttctcattaaacaatatcagttgtttccactatttttacacagtaagttggattttacacgagctgaagctgttgaaacatacttatgcctctttcttttatacaaacatagccatgccttaacataatgtttaatttaatataacctttcttcagaatagaagggaaccaaatttaacatgacattttatccatggcggccacgatgtcatttgcaatatttttcgcatccatggcaataccggccaatcctctcctagcaaacccagcacaatacaacccattttcacctctccaatgatttggaaaataatttttagggaaaccatcgtctttaaacatgctttcaccattctgcaaccgataaaaaaggattatccttttgtaataatgaaacaaaatcatgcataatgcaacaaaatatattattgtgtaaacaaatagaattaaaaaagaagagagaagagtttaaagcaatatccatattctttgtacctttagccatgcattaactgtgcttttgtaacctgtcgcaaatacaatggcgtcaaatgaattttgcctcccaccatgaaattcaacactgtttgtatttatctttgatattccttggaacacctaatagagatatgaaaagaaatggtgtaaagtctgaacatcaattgaggctagaaacttcacaagcactaccaacttaattttgtatctaaagagtgtagatgcatgattactttgataactcctcctttgattaatcttgcagtgccaacatcaataacggcagaccggccagtttgtgacttgagtaagagaggacccattttaggcctcgtaataccatgttttgacaagtctcaaaataaaaatttgcagccatcacaagaagagaatccactgctgtcacatttagccctaaattttggaccattgtcatcccataccatattagttctttggtcattatgtgtatctgcatttagattgatatgtaaccattagataatcatcatattaggaaaaagtctctagcttgaaagttaggaacatggaacccaaaaaaccccaaaatttttttttggggggcttaatatttagagttaatcacatttttcatttatattatccacatgtgtatgtggtacaaaagacaaagataaagggctacatgaataaatacaacttatgaatcgacaactgaattaatgtattctattattacttttatagcaaacatgaaacataggtatgaatgcatcatgaaatgtaatgcaagataagtaaatatatatgatgtacataccgggctacgaacaactatagaggtgtgggctccatgcgtgacaagatcataagcgatctccatgccagaattcccggcaccgaccacaagcacattcttcccggtataggctctcccagacttgtaagccgacgagtgaatggcttctccctcaaacctagtgagaccaggaactggtggaatgcttgccgctctgttctcgccagtgccacgacaaggaactgtgcggtgagccttgtcacaacactagtgtccgtgtcccgtgctagcacagcccaacggttcttacatccatcatatattgctgactcgatagcagtgtggtaccttggtcgtatcccaaactgg

SEQ ID NO: 50481 - DNA, 1091 bp, Oryza sativa
tctaggtactccacaaacatatccctaggaacgtacgtcggcgtgcccgccggatacgccatgtgtggcagctcgcagaactccttggcgaggtgtagcttgaggcggtcgtaggcacggtggcgccacaacgatgcggtgctggactcacgctcgacaatgatgtatggcacatgccgctgtgcaaggcacgccgccgttgctaggcctgctggccccgcaccaacgatgagaacaaccacgtcctccatagcattcattgctaggtaatcacgtagtaggatgtaactagtgagcagaagtagcgagaagtgtagatagtagtgtttttgtggtacatgctattgagggttacaggaggtatatgtagcatggaaattggaacggattcacattgctaatagcagataattcttttttttatcccatttggatgaaattctggataaatccgttgcatgcattaaatgcggccaaatgccatataagttataattcttgtatagttgcgtttatatctcaaaattgtgttataatgtgaacttggaaaatatagtgacaaaggcgtgttcaaacacattaattaatttctaataatggttgtaagtcaaggagaatggacgtgcctgtataggcaacaaaagttatttgtttaggctagagaaaaaagtatgggacgctttcacaccattgttttagaaattaccgttggatatactctttgtttctaaatttacagacttaaagctgccgatcgtataggactattttacattgtaacacaaattgacatgtaccatatttttatttaatcatcaacccactgcaccttaatgagcatacatggactttaggctttggttgacaagaaaggtgactgaaataatgaacttagctcgtatcgaatacttgtctgttgtctcgtacaaatgtacaaccgacggtacgaatgttaaagttgctcacaaacgagaacatacatgcaagtagactgagcgtgccttgctaaacatgacggacacacaaaggctataagaatgtgatatatattcattatactccatgtgcatcaggactgaggaatatgaatg

SEQ ID NO: 50482 - DNA, 1618 bp, Oryza sativa
ggattatatatatttttttcaactggatataatataataaagatcaacgctttttaaaaaattttagaggaaacaatagctggctagaatattgtactgtgtcctactccggtgctttctactcggagtagaaagtaatctaggcccttgatcatatttaattataggattaagatctagttctactcctatcagaattagtggaagtagaaatgtggaggggtgtttttgtccaggaaaaataattcgcgaaggggtattattggtttccgatccatagatcgatcagcatgtcatcctcatcggagttggtcgtgcaagatcttaatcgatccatgtaatccatgaaacaacacagtgatcggaaacggcagaaacgaatgagccgagatgccgccggcaagcaaatgacattgcgtgcgtgcgtgacgcttccgccgaagcccaagcccggaattttttaccttaaccccccccgcagaacacctgctcaagatcgtggctcgctcggacgccaccacactcgtccgctcccagacggacgatgcgactgaggaagcggacaaggcggtgatggcgggaatacggatggcgacggagggggcggacaaggcggcgaggccgggggaggaatacgaggtgactgcgtgcaacggagttcggacctgatacgatgcgaacagaagaaaacatcccatgccaaaattacccctaaacgatattaggagattacttacctgtcctttaaaataaacagtcaagattaattctacttggagtagaatactgcaagtagattgcaccggagcattactcatgtttttttatgtttcagtttaggatgcaattttgcactcccagagatatatacatatatattttattatagttattactgaatttagtgcgttggaagagtttgtctgcctcccctctctcaacagaaaatgtctatttgtctgcgaggatgaactagtaatgtcgttgccacatatagtttggtcggctttaaatctgtttctgtagtggctgattaagacttaattaggagtcaataaacattatttcgaagttcatatatgttcatccctatctactcactagtcactacatataaagtttgcttcatggaccatcatgtttccacacaagtaataaatactttgccttcatcaacacacaactagccagtagtatttctttttccgaaataagatttttattttatagccaaaaataaggtcttaacactccttttttttggggggtccttgcaattctactagtccataactaattagatatttagcactttaatagcaaaagaaaaaatatccctttttttgctcattatatatatgtacattaatttgaaattcttaatattccatgagagttaccaggcaccgatacattatatatataattaattaaagcatgtcaacactccacttttgattggttattttttcaagatatatacaaacccaaggtttcagtatacaccaaatcccaactaccatcctaacagatgtcattttttttcaccaaatgtattcatggtcgctgttgacttggatgtatataaattacgcattctgttaattagggccatatg

SEQ ID NO: 50483 - DNA, 1066 bp, Oryza sativa
tatataggttgtaattaattatatgttcatattaacaataataatttagtttccttacaagaaaataataatttgactaatttgtcgatcgatgatcgaagcttaattactgttatgatgccaatatctacgatcatatcgaaagcttaattacggagtttcttaagacattattactgatcaacagaaggagatctcgcataattggagttgacaacactcaagagataaattaagagcaacctcagaaagagagaatatatataacagagagaaaagctcaacaatttgtatcatgagcagctaattaattaatcgattcacctcatataggaaattgaattttttaaaaaaacttatttggcaaagttgtaaggggggtttcattcatcctctccttaatcactagtggccatgcatgcatgtccctagctacccttttttcctgatctagtgcatgcatgcaattaagatgcgacgcctaattaattacgattgatcattaattaacaacaatattaatctcagcttcttctctaacaacatatccattggataacactatcgatccatctccggctcgccgccgccggcgacggcggctacacgccgacgccgaggaagtcgaagtacggcacgcccttccgcttgtcgccgccgccgtcgacgtcgccgtggttctcatggccgccggcatccatcagttccagcgtctctctcatgggagtggagaagaaggtgatggtggacacaggctgcgccgccgccgccatggacgtcgtcgccggcagcagcgtaccatagctcgtaccgttaaacgacttgatcaagaacggcgccgccgccggagaagaagaagacgacgacgacctgttgatcatgccgaagccgaagcatagcgagctattgcgcgcgcctgatgacgcaccgccgccgctgaagtcgagctggctggcgtagaagaagaacggcgcggggtgggccgcggcggcggcggcgcgggcgagaaggcggaagcgctcgcgggacgcgcgggcgcgaacgacgtgccagtggttcttgacgg

SEQ ID NO: 50484 - DNA, 1515 bp, Oryza sativa
aaagacgttttgggttaactaatttgattttgaagatggaaatgaaacaaacggacatcataattccaaacgtgacgaagtttgttctagtattccctgggaaccaaaatcatgcataaccagtttgataataacattacttataaatcgatgaaagaggatcccaaaacaaggaaagaggaatcacaacaaagataagtaataagcttgatcggaaaattgaaacagctagaatacatgcaaaacttccaacattaattagtaattcagattagacagacgatcaaattaaatggccagctggcctttagtaattactggaaaatattatccttttgataaaatatggttgcggtcttttttgggagtagtataaatggaagaaattaaccctcagctctaattaaccagacaactgtattcctctatctccaagataaatacgaaaaataattaattagaaaaactgaagcgctcgctcataaatatatacaagattaatacaaagaaccgtatggggagcatggctaatttctttcaaaaggttagattaaagtatatgcatcacagaaattttgcttacaaactaacacacaagcatgattggaggcaaatcaagaaaactatttttttgcacaactctctccgattaaatgaacaaattaacaacaattaatacacccacaaaaaataacatatgccaaccatagcatccaagatttcgatccgattcaaaccaaacaggcatgtacatatgcccccaaaattttgaacacaaaattaaatataatccccatctaccaatttctagacaaaagaaatataaatcctcatcttctctccatgagaaagaaccaaagaacaacgaaccaaataaatctaggtagatgaactagacctatagcattaatttctttgcaactatatatctagcaccagaaatgaaacaaactaatcaacaccatcaaagaaaaattaaccatcaccaaattaagagataaaaaaaatcaaaatcaatcaacacacaactatagtttaaccaacaacaccaacctgatctgccctccagcttctcggcgatgggggtccagttctgagggccgtacttctccaccagctgccggagcttctcgtcttccccgggccgccagtggcctctcgggcacgccgacgacgacgacgacgccggcttcccggcgccgtccgacgtgttcgtcgtcgacgacgacgccatgatccttcacctagctagagatcgaatcgatcgagtagaaatcaagcaaaacttgactatagcttgctagctagctatcttgcatatctatctttgtttttcagatcccaaaatgattttctcttataagtgagaggagaggaggagagaggggatttttcttgggctaattattagctagcttaagtaagtagaattagaggggaaatgggagattgagtgagggagaaggggtatgggtagtgttaggatacccatacccatatatatatacaagagag

SEQ ID NO: 50485 - DNA, 2394 bp, Oryza sativa
  unsure (1)..(2394): unsure at all n locations
tagctctccacgattaaattgtgcgggacggattgcgacaacctatgttcgattaattgttggtactctcacacaacttgtaaagctctaaatacatgcttattgtccatgtcaaaaaaaaacatgcttattgcattgtatatatactgcaaatgcaaatcgatgatcatctcttgaattcgtcgcaaaagtttgttatggtcaacatctatgagcccatacattcccacaggaggtaaaccgttcgagctctgccattacagccacccaacagaagcagaaaccctagtaatggccaatgaggcagcgtacacagaggggtggttggcttggctgcatatacatatcctgatcgatcgaaaagcccaaatttgcagtcttttcagcatgggatgcaccgcagaaacaagggatgcattcaatcttccatgctgctctgttcattgtgtttgggagatttggagcaacacatgcatgtacaagggatgtgatcagagagcagttagttggcagtgtgatatatgtgtatatttatgcactggctgcattgaattgatgagcttgatgtacacatgtaactacatgtgtgngnctatatatatatatatatatatatatatatatatatcggggatatataccctttctcggggtttcataaaatctctctatattttttttaaaaaataagtatataataaacatatgtactgcacaaaagatataccatttaatttcatttttatgagcttaatatagggtcattttgaggttatttaattgcttgagcatgccctctttgtataatttgcatttaatttgtctgcagctgttctcaacattgtcatccaaggtggtaactgattgatctatatcatgggattccatacttgattcccaaacagatgtcctcataataattcttgtcactttgtttagttttagagaggcatgcacatgtttatatgcaaccaaaaacaggaagctgtttaggctaagtaatgagccacaaccaaaagtctgttccaaaaggacaagtagggcccaggaacaatggacaaaatctacaagacaaaagcaaatggaggaaatttgatgcaaccaatattcaaaaaatacaagaaatctaaatttgcagtatgtatacataatccgtgtttcttcattttcattctgtaaaaagtaattttgctagctcttgctaaatagaccttcgaaggaaatgttgacaacagttgaattttcaaaactatttaagccaccaaggaatatcataatttctctggttatcaaattagcttatctataagattgacaatgatatctaccatcacattcctggaagcaaccaatcagccaaatcagttgcattggtttagcataaatgggcatccaaattaacatagcatctgaattttcaagtcaaagcagtttcacctgtgagatactgatgttgaaaagagaccaagacctattaacaacgaattgtatatgatttctggtccccgattccgttcaagaaaacatgaaaacgcactcgcaacagccggtaatatatgagcaataatttagtacataataatcaaagttagttttgtcattctgacttggcatatgttaatggtgtagctttaccttgttgccttggaattggttttggttcctggaaagtttgttagtgatgtatcaaaagggtgtagatgcaaagaaaaaagtcggaaagctatctctctggatcaatgtagtatagaagaagtttttgcttggtaaaagattgtgagctttgacaaaataaccaccacacaattgaagagattaatgtagaccctacaattagttaaataaaagtcatattcacatatatgtatatccattcgaacaaccattgttttttcaggaaggtgtttgtaataataaggattgttttgtcctcagcagatgcatgttatggcatggttatccttgagaattaaccaaaagtatcctaactttgcaagattgaacattattaatatggtatgtacatatatatctacagtggtttgtatatgcaagcaacattttgcactttatatattagctaaccattaattatctaaaaaattagctggccatgctactaatttcagccataattgaatattatttgtccatattatgagcctacatacatatatatatatatatatatatatatatatatatatatatatataaaataagaaaatctgatgcgtagaaatgtttctttcagacatattaccaatgatcattacttatacatgtccacggagagacgatttcgttttctccctagatgcacaaagacgtaaacaacacacgagcatggttagataacatctttaattaatttgttgttaattaacaatattt

SEQ ID NO: 50486 - DNA, 1088 bp, Oryza sativa
aaaacacaggaaaaacacagtaatagttgtttgattggagcacaggaaaaacacaggaatcggatgagagagatagactcaaagggaattttccaagaggttagagctcttgctatatttcctccaaaatccacatacaatgtgccattctataggaatttcataggatttggaaaacttcaatcctttgaatcaaagggctaagtaggaaaatttcgtgtaggatttgaatcctatgaaattcctagataaatcctttgattcaaaggggcccttacacttacattcttatcaaaatcctacgtttttcctattcctacgttttcttaatcctgcgattcaaaggggcccttagataggattcaatcatttgcttcaaagggtttcataggaaattttcctataggattgaaatcctctaaaattcctatgtttttcctccaaatcaaaggggccctacattctatcaaaatcttaagtttttcctattcctacgttttctcaatcccgcgattcaaaggggcccttagtacattacctcatatgcccgatacaacattagtggaaaatttcttgaattatatacccataactaaaggagaaatttaggattacaccatcatcaaaagtggcttcgtggccaaatgccactacttaaaaagaacaataaaatatcactctcaaccagacgcatcctggacaaaattacccttggggctctacttccttccttcatcaccgttgttcttgccgatggctattacgcgccatatctgtggcttcttggctgtcaccgacatgtacgtcatctgctgctgaaatatcttgagattgacgaagtcaacacggacgcctcactgtcaaggtttgtcgataggtaccaccgaaagaacaatttaattgtaaatacgagcacccgtgtaaatctacaacttgaacctgggtgagctgatttcataattataagaaaaggggtaactagctaactactactagtgagtgcgctcacttcgattcttttttctatttggtttcacttgttgaaggaaaaaacattttagaagcataattatgtgacaactctacgc

SEQ ID NO: 50487 - DNA, 8631 bp, Oryza sativa
  unsure (1)..(8631): unsure at all n locations
attaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacgaagtctatgtaataaggtgatccccatttgtgtgctagttgaactaagcatggctaagcatttcctaaacccacatctagtcattttgatacccaggttatcaatggcatatggtaaacaataaatggctgagtaataggacccattccacatgatattgtaaaagaatgcaacatttaatagaaatgcgggatatttgtaaattgggtacaatatgatcaaacgtattgcatgacttgccttgctctcgcactgatgagacctcagcaacgtcttcgagaaaccgcggatcgacgaaacggccgaaacctacgcgacaaacaaagcacacaagcaaaacatgctataagtctacagaaacaggaaacaaaaccatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcagcaaggggagggggcggctgtgctgacaggcgggccccactggcagcggcacaaggggagagggagggggcggctggcatgtgggccccactgggcagcggcacagggcgggagagggaggcgccagccgggctcggctcggcctcaaagccgaccggcggccaaggcgaggcggcggcgaggcacggccaccgacggcggtgaccggcggtgcgggaagcggcggcgacggccgaaaggcggcggcagcggctgaaggcgacggcacacgcgcgaaggccggcggcgcacacgggaaagggggaaaaaggaagggggagaggggattctcaccgatgagcacgacggccggcgcgaaggaagaaagcggcggcgacgaccggcgatgccgaggtgcggatgggcggcggcggcacgctaggagaaaacaaagaggggttaggggtagggagagcgaccacggcggctagagcagccggccggagttgggtggaaatggagagctcaccggcgtgcgagggaaacggcgcttcggcgacgattggcggcaaccgaatggtggccgaggtgcgggcgggctcggtgagcgcgacggcggcgactgcgcggcacggcggtggctatagaggcggcggcgcgtggccggagacggcggtaggcggcggcgcaaggggcgacggcgcggcgacgataggaagcacgggagggcgcggcgagtgcgaaaaacgagagaggaagacgcggggagcgatttataggtgcgggagggggcggacgtggccggggaggtggccgatttggccggcgatgtggggaggagagagagaaagaggggtgggattcgaaatcgaatcccgccctctcgagcgcgcgcgcgggccgggaggttcgggggaagaggctgcgacgtgggggggggacgcgggagcggcgcggcgtgggcgcggcaagaacggaggaggcggcggcgtggcggattcgcggcggttgccgtcggaggcgggtggctggaggaaggggacgacctgacaggtgggccccacctgtcagcgtcccggagagagggggaaggagaacgggccggcccaaaggaaaagaggccgagcgcgggagggagtgggccgacggcccaatagagaaaaagaaggaaaagaaaaggaaaaagaagaaaggatttttcctgggattaaaaattgcactttggtgatttttaattggtaaaaattatttccaaggctctgaaaattccactaaaaatcctgttaacatattgtgacatgtagaatccaaaaaaaaattccacatgccgattccgattattatttgcatttattaattagggaattagctctaggttaattaagataatttcttcggacggtttatttagccaatttttaaagcaagcaaaaagggggaaaacttcagggcgtgacattcctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttgaaagcgatgtactcccctgagcggagtgacacggagatacacataatcccctacttggaaaacgagctcccttcggcggttgtctgcatagcttttctcccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtactccatgtaaacacataattcttgccagatagagttctgctaatttcttccctgagtaggtagtgtgcaccgaatgaaagtgagccactttggtgagtcggtcacggactacccaaatagaatcatgccccgatgacgtcctgggcaaaccggtgacgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccagaacttctctttgaggtcttggtacatcttagtactaccgggatgaatggaatactgagtttgatgagcctcggttagtatcaggtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcagatgttccagatcgcgttgaacctcgcaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcagcttgagtgaagatgtactttagacttttgtgatctgtatatacctcacaacggttactgatgagatagtgccgccaaatctttaaagcatgaacaactgcggctaattccagatcatgcgtcgggtagttgccttcatgaggacgcatctgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaactgactgcacattggctggatccacagctactccttgagcattcacgatgtgaccgagaaactgaacttccttaagccagaagtcgcacttgctgaactcggcatatagctggggctcttttaacttttcaagtaccaaccgaagatgctgcttatgttcttcctcggacttggagtagataaagcatgttcatcgataaaaacgcacgacaagacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacaccgtagctcctttcaactgatcaaacagatcatcaatccttggcaaaggatacttgttcttgatggtgacctcattgagtgcgcggtagtcaacgcacatcctcttggttttgtctttcttttccacaaagataaccggagcaccccaagcgacgtgctcgggcggggggcccgatgtatcccttctgtaactgttcatcgacttgcttcttgacctccgccaactcgttggctcccattctgtaaggcctcttgtggatcggtgcagttccaggtaccaagtcaatccggaactcgatatccctttttggtggcattgttgtcagatcatccggaaaaacctctagatactcttgactatgggaatatcctccagcttcttagtggttttctacactgctacctcttgttcttcaccagcagcctggtttaaactaatccctggcttctgcggcactggggactggaagattaccacctctccttttgcattggtcaacttgatggtgcggctggcgcaatcaatcactcctctgtgccttggtcaaaaaccccccaaaaaaatttttcccccccccctccagatgacgtctaggtccttggattcgagaagaatgaggttggctggaaaaatcgacccttgaatttcaactgtcacagatgggcagtagtgagttgtggtcatgccacctccaggagtatgcactcgcataggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctaccaacctcttgggctgttctggcagagctggctgatctgactgagctggaatcattaatggacttggagtcgggttgaggctgctgtgactgccactgttgttgtgactatcactatggtgggtcttattgaagctacccgggtggtagggacggtgctgtcggataatcatggtggaaggtccaccgtgacgtcccatcgtgtaacgaggcttttgacacttcccctggggagtcctgaactgggctgccttcctcttacgggtcattttgttacactgctcctcttgacgaatagccttgtccacaagcttctcaaagtcctcatagtctctagagatcaactggttggtcaattcgtcatcaagaccagacataaacttctcctgcttctcggcatcggtacgcacgtcctcaggggcgtagcgcgcgaggcggttgaactcatgcaaatactctataactgttctggttccttgttgcagggaacggaactctctcttcttttgtcccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttgtctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcggccgccgactagcccacaagcaacaaacctaaacacgaaaactagcaagcaaccagactaagaagacgataaagctaagggcggcgactctgaagctcgaggcggcgcttgcaaacgagggataagactgacatctaaagtagacaagggataggaaccaatccatgctcaaacccaaattaaacaaagcaaaacaaaactcacataaataaccgagcatgatgatttttatgcatagaacatttttcatgaactcaaataaagacactaatgcaactaaacaataaattaatgcatagactagttgcatggaaaacgatgcgcataacattgcccccatcgaatatagacacgacctaatgcataacccccaataaattccgactgactgtcgaataaactccactaaaaattntttaaaggcctagactgagctaatatttttttttttaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttaggtttccagttggcttgtcctacggtcaaggtcggttctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcggctccactccacaggcaatccttgacggcagcgacgaaaccaacttgacaaaacagctccaactaggaagatcttcagctctggtgtgggggaaaagagagcaagactgagtactacccactgtactcagcaagtcataccggaagaggaggtatgatgcaggatgtaaccaaaggaggctagaggttcttttgcataaagctagcatttaaaaacggtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcg

SEQ ID NO: 50488 - DNA, 1383 bp, Oryza sativa
atatagacacatgcattttgggacggagggagtactaactactaaataatgtctcctacgtacccatcgatttcatgagagcttcaccagcagatgtcttgtcctgctgtccacttcaatcgtttgatcctcgttaagcagaaaacagcaagtatgtgtggtgctctgatgtggtacaaagaaatttggggtatgctatcgttaattaaatgtgcgtttcactcaaataccacttcacaaaatggatttgataaaatgtcattcttgatcagaacatctacgatggattaatgtcatcccgggcaaaattgccgttgggctcctcttcttcctccctcccgtgccaatgcgtttaccgacgaccaccacacgtcatgtctgagcatcaccaagcctaagtcatagaggttccatcttgtagaggccatccaagatttggcatccgcaagaccgggtttgaccagagagcgccggtgcaagcgggactataagtgggttcacgggcctggccgcttgcatccctactaagagaacgaagaagagattggcagagtgatgatggagatcagcttgacgcgacaggatccattgctgacctcgtgctctagccgctgcaagaagagtggcactagtaggaggcagaagactccaagggtaattttgtccgagatggcatcatcccaaatttatcatctgtcatttttgggtatataactggagaaattgtatggtctgttccttaagagtatcaaaatttgaactaattttgatacctatcggctatctgagataatgtagtacctctatctgatacccaccgtaaaatcactcatattactcaatccatgtaagtttgattcctgatgctcatagaattttatgaatatgtatcttattcttagcgttcgtgtgttcgtcatgttaaagaaggcatgcttagcacggctgcacgtaccgatgttctcgaatgtgcgtgtcttttacatccgaaaggaaaaaaagagtatcataaagtcgattgtacattcgtagaggactaacaggcaagtacttgacttgagaaaaagaaacaactttcggcggttggcgatctggtttttcaggttagcaaaaacaagtgattcttccaaacatgccatctgtgaccactacaaaccttctttgaaggcgatgccatgatgtcccttccagtggcggacccagaaaaattgtactgggtatgcccatttagcaatcactccgcctcatatccttttaaaagaaagctcccaattacaatgaaagaatttggcggattttagtcggaattttacacatttctattcagatgtggtccataattcatgaaaaatctataggatttagcctaatcaatcccatgtc

SEQ ID NO: 50489 - DNA, 2361 bp, Oryza sativa
ttttttgcattggggccccttgcagccccaccagaggccggcaggggttttcctgcaaaaaaaccctccctcggtcaccgcctgttcctcccccgtttgccacgtcagcttgccgccccagaggtgagcggcagggtctacttttgtaatttttttggccgatagattatttctgtaaatattttttttaaaaaaatctaaaacccaaaaaaagtccgcagcgacatctatggcgagtgaggcggcccaagaggccagagcaagactgcttgtgggccacgtaggctgagatctagctggtctttctgctgtaatcgctcaggtccgttcgatgaaaaacgaacggtgcaacggtgttggacatccctctgactttagattaggatcctattcccgagaccgagcgcttgctccgggaacgcggcgatgatgtcccctccgacggagctccttgccgctactaccaccactcgctacaccactataaaaaagcaaaaagcgagatttagaaagagagatgccccttcaaatatatatatattttaaaaattattagcagagcaagtttaataatatagcccactactagctacaaatcatatatagctaatgtaactaaaagttcattaaacttcctacaaacgctctcagattgccacgtggtaatccttaaaacgctctcaagctgccacgtggcgttaataaaatccatcccttaatttttaattaaatatgtgggtccaatatttcttagccgtccaacttaattgagattaaaagaaccgccgccggaaccgctggctcagggccgcgcagagagaagctctagctcccctagggcatcgccatggtcatgatcctgcttctgctcctgctcggacgtccttgcctccgttcaactccaccattcaggatatgtggaagcgctgatgattaacttttggctattggattttgctattcacacgcctatgcacacgtataagtggtcgattcatgaatacaccgatggatttgcttgccggttagtaataaatacattccatctctaacctctgcttccctcctattttctatcttctttttatgtacagcggtatcagataaaaagttgtgataataaattttaaatagccataacttcaaaattatactctctctcagtcgtagaatatagcatcttttagctaagtatctagatatgtatatgtcctaaattcatagctaagagttggtatattttgagacggaggtagtacgtctcattttttttattcatcattgcatttacagctaaattgatagtttatgacccatattggcctgtattttaacttaaaattttcatattattattagtaaccacgtagaatactcctaagaattgctacataattcaaaattagtagactaagccatcggataaacattagtaaccttgaaaaataatttacatggtttttagttacatagattcttatccgcggagcatttctaagccaccatgtgataatcaaataaaatatgagagattcctacaaattttattaaaataaaataaaacatctagccatcaatttttatttaatttgataaacccattatttgcaaccaagcttaaagaaaaaaaaacccacatcccaaacggggggcgctgatacgcgataagccgcgcgcccccgcgcatgcgcggtcagtcggctgccctctagtctcttatgtatctactatacttatgtatatactacatatacacacgtatatacatatgtatataggtgtgtgtatatatatttacaaatatatttttaatacacatatacaaagtttatataggacgtatataaactttgtatacgatgtatacgaactttgtatacgattatacaaactttatatacatacatattaaaaaaaattaaaaaacaagaaattacatcacatatacaaagtttgcatatgggtttataaactttatatacgcgtatacaaagtctacatatgcgtatataaactttgtatacgtacgaatacaaactagcttggtatacatacgaatacaaattttgtattcgtgcatctttaaaaaaaccgaaaaaacagaagagaaactaaaaaaaaaagaaaaaccaaactgaacagaaacgaaaaaaacagaagaaaaggctaaccgaacagaaacgaaaaacacggaaaaaaacaaaaaaaaaaggaaaactcgcactccgcgcggcgcatccgccaccccctctgcgcgcgcgacacgtgtccagtcacgccgggaggggcgcgcgtgactgatcgcgtaatagccttctcgcgtcccaaaccccaccctggcctacacatggacacggatgt

SEQ ID NO: 50490 - DNA, 943 bp, Oryza sativa
ctagtccataatttggcagaattaagtgacaaggcctattgcgagagcagcgatccaccagtggctgtaatcaacatactttaaggctctgttcgaaagtgagggatgaaaacctcacttcctagcatgcaaaacacaacaacatttaggtattatcaattaaatattttaaaataaatttaaaaaatcgattgattaatatgattttaaaaataatttttatatagaattcttttaaaaaaattatatcgtttagcagtttataaacgagagatgttggttggaaaagtgaagataaatactcagccgtgaagcctgttacaaatatgtaagccgaaaaatgctcttctggagttcatccgtttcaagccgagaaaaatgaacgaataaacattggttaattgaacccaccgagttagtgactcgatcaattttacggaccgccaaagctccggacaggtagcagcaacctgagctgtcgatgagacatgaacagggaacaagctaggcaccgcacaacacacaagaagcagagcacaacgattcggccggtaaatttaatttctattagaaattacttcacatacgcctagttagcatcatggattcatggtttccccaaaccaagccaagaacacaaacgaactgtacattcacaacgcggatcaacgcctataactaggaacttagggaggcccggagttgcgaacttgcgattcccaggaagaatcacttggatcaatcaatgaaatatgagcagagaacaaagctagtcacaactagaagcagagcacaacgacgattgaacacaaccggatcgaaaagcgcttcaactaaactatgtgttcacaaatccaacggaaattcaatttctagccatcatcacttcacatgcgtctgagccagttagcatatcatagtttccccccaaaattaagccaag

SEQ ID NO: 50491 - DNA, 722 bp, Oryza sativa
ttatcatcagcaagagcaattaatattcagccatttccatttccaaaccatataaatgaggtagcccttgctagtatcagttgctttgcaaagctgctctgatcagaaatcccaatggcaatggagaagagccctcctccggcgccgcacttcctcttcgtggtgagcgggatacagggccacatcaacccggcgcgccgcctcgccgcgcgcctgatggcgtcggcgccggccgcgcgcgtcaccttctccaccgccgtctccgcgcaccgcctcatgttcccgtccctgccgtccccggccggcgaggacgtcgacgacaccggcgtcgcgtacgtcccgcactccgacggctacgacgacgggtacaagcccggggtgcacgcgagggacgactacatggcgcgcacccgcgccgcgggcaccgagtcgctctccgccatcgtcgcggctctcgcggcgagggggcgcccggtgacgtgcatcgtgtacacgttcctcgtggtttgggcccccgccgtggcgcgcgcgctggggatcccctcggcgatctactggatccagccggcggcggcgttcgccgtgtactaccactacttccatggccatggcgaggccctcgcctcctgcgcgaacgaccctgcccgcggcgccgtcgtgcgcctccccgggatgcccgttcctcaggtccgacgagctccctccgccgtgtccatcgtctc

SEQ ID NO: 50492 - DNA, 819 bp, Oryza sativa
tgctttctagcatgtcgggccgtcgtgccttaggccggcctgataaagcacaacccaagtcccagctcccctcgcctgcacgccgccgtcgccgaggcccggagcggtggcgtcgaatgggaggagcgggtggcggcggagctcctcggcaaggaggtgtcggtggaggtagggatggcaatgggtcgggtcgggcacgggtagagcaaaaccatgcccgacctgatgcctaatattgcctgtccaaaccctacccactagagttagcgtgcaaaactccgtgcccgtacccatgcccggtgggcgcgggtatgtccggcgggtacccaatggatctcatataaataataacttaaaatatatataattaaagaaagaaaaataaaatcaataatttacgaaattattggttcaccaacaataattcgaattacatcacaacttagtatcagttagcattacaaatgaaccaatagaaagggtataagaattaagaaatgagtcataattagctaatacatatgtatcgagatcgggcataggttacccatgggtaaaaaatgaaacccgcctagttgcccatgacgtcttcgggtatagggtgggagtacccatgagtgaaaagtcacactcacacccatgcccatacgggtcgggtatctgtgaatacctggacccatgggtaaaattgtcatccctaggtggaggaggacggataacctctttgaatttgctcgatgcgggatgcggcgaggcccaagaagagcgtagcggaggagaagtcgaagggggagaggaccgggtaagaggcgaaggtgt

SEQ ID NO: 50493 - DNA, 1535 bp, Oryza sativa
gtagcctgtgaacatgacaagaaagcttgtggagccaaaaatgtaagcccatttctctgaatttctgagccatggaatgttgtgcatgttgaacaatgtctgaatattgtcttggtgttgatcagtcagtgcagcgcaagttaggcacagggcaagaatgccaaaccttgatcttccgtaacaattgttgttcgcaagcccggtgacgacggcccaggtggcccaggagcaggcagcgctgcagcagtagcagaactacccaattgactgagtgatttgatgtggcatcgatcttagttagagagatccatgcacttatgaataagaactttatataaggattgtcgaaacaagatttcggtaagatttcggtaatactagaagggatggcaattaagttagaaaagtgaatggatcaggagacagagaatttatacaggttcagatcatctcaatgagaagtaatacctactcctgtccggaaaaatattccaccgagtttgttattaatctgatgatctgggagaaacgttatgcccctaagagcatccggacccctccttatataggggaaggagacgagattacaacatacaacctataacccttaattacttgatacacaaattaacataatacccgagtcatttcctaaacataatctatctacatgatatatcccttataaaccaatcggatatccatattatgcgggtatatgatacccataatctccacaagaattggattagttgaattgttaagaagaattggatgtgattttagatttgatgcaaagctacgtactggcctattactagtagtatgaggtatcaatttaatcccttgatatgctcgacatttaatagatcatgtctgaactttctaagggcaacgacaataatatagccgattgcctactataaaaatctccaactcaactagagtaagcactacagacaacgtttttaataattgtctctaccacttactcaaaaatattattattttatctatctttgtgggcctaatttttatctttgttccactgtatttatggtgagcctagggatgaagcatactgctggctgcatgagccttggcgcccgtgcatcatcgtcgattatttagtcgacgacttccttctctctcctgctttctctctcctccacctcatatttctctttctctgacgtatgcaggctaatagacggcttccctagccttattgcacttgccctaagtgaactctctggatgcgttgtggtacttgataattaaggtgtgtgttgatgtgattaattaccaagaaactaatgtaatttactgttaggaatacacacacataaagaaccaagaggtatgtagtgacaattgacaactgacaatgatatgtaactgaataaaatgtaaaagtattatatttggttgagtgccaaattttatttttcatcacttgcggctaggttaacggaagtgagccccatggcactctttattctaactcacctgacccgcttgacttacggtcaaca

SEQ ID NO: 50494 - DNA, 3360 bp, Oryza sativa
taaataagtataattttaactagtcaaagacattaaccaaaagatttaaaaaaactatgcactttattaatatggagagaaagtaagagatggagaaaataataagagagatactatcgattcaatggctaaaaacaagataaaaagatgaatagtagtgttagaagagttctactccacattaaaactacatatttaaggataaatcttgagactaacattatatttattcaggaacatagggagtatattcttaacaatagatagtacacataaatgtattatcacataattaagtacttttcttaatgcaaagatatcatatatacgtacactcaatatatagatgaaacaaaattgacatacacaaccatacatataggcatgtgcatagtactccacgcatgtaagaacacaagtagagacatgcgtgtttacacaatgtccagttataatttactccaagtactatctccatcttaaaatataataactttatacccgatagatttgacacaatctaatattattgaatctagatagatttattcataacatcaatttatgtctaatttcgatactaggttactatgtcttgttgaggatgctgatgcctttccagcgagactccatgcggttggacgggttcgtctgcatgtacacgccgaacttgaagtagtgcgagtcgccacccttgccggcgacgcggagcctctcccggccatcaatgaagacggtgagctgggaggcggcgacgtcgtggatgacattgaggcggaaccagcggtcgtagatgttggtctccaccacctgctggtggtagtaccaaaggtcgccgccatagacgtggagcatgagggtggtggcggtcccgccaccgaacacctgcatgatggacacgccggtggtgccggaggggacgtaaccggtgccctcgaattgccacacccctgacgagtagtcataaccctgcatgcaattaattaatgtattgtccaaatcaaatcacttttagattcctcgttaatttatttggatgtgattatctatagtaccttcatcccagaataattactccctctatcccataatataagacgtgctcacattctaaggtttaactttgaccactaattattgtaatataaattaaattttatttgctaaattaataccattggattgacatttaaatttactttaagatagttataattttgttacaataaaccttatagtatatgagaattataagtcaaaaattagttttgaagattgtgccaaatttgaccatgtcttatattatgggatggagggaatatattttaccatttaaattttatctaaaaatattgtatttgtaataaggtgaaacttatccaattagtttgacggagatatcatgtcttctgccctcccttttttatatccccatgtgtcttacctttagttctatgtatgtagagttattatgatcatttgtgtgtactgataatatgtctgaattttcaaaaaaaaattattattttttgggacaaagggattatggtcttatgcttatatgacgtggttgaagtttgatgtttaaattaatcaaactaaaacaattatgatgaaattaatcagtagttctgctctttttttccctaataatttaccactacacctcataaaaattacttaactcaaatcatacaattttttttctattcaaactttattaagtttgaccaaatttatagaacaatttagcaacgtctaaaacatcaaattcattttattaaatctagcatggaatatatttaatttaataatatatttgttttgtgttgaaaatgctaatatatttttctataaacttgatcaaagttaaataagtttgacacgacttataatattaaaaggatggagtagtataaatggagtggaatagctagtgagtacttcctccgtcccaaagaaaagcaatataggaggggtcacacctcttagtacaatgattctggataaaccccctcctgctacaacgaaacccctcacatctcctcttagattgcctagtcaactagtggtattcatttttccaacgaaacccctcacatcccctcttagattgtctagtcaactagtggtattcatttttccaaaaatataggtagctatcacgtgaagtatacgtatgggcagacttttgaatttgaccaacattatcttttagacacaaattaatgaaaacaatataaattatataattagatttatctccataaatacgtgttttcatgtcccatctcgtcatctctatcgatgtgttcgatgactggactgatttagagcattattattacataaattactgtagcagaaagtagtagactgagtgattattaatcattttattaatttattgaagctaactaattaattaatgaattaatcaagcacgccattatgataatacgcaccgtcatcctgatctccgtccttgggttggttccgctctgcggcttgaagggcttgtcgtcggagaagacccacagccgcctcaccgtgccgtcgaagctgtacctcgagctgctctccacgtcgtacggccactgcagctggaagttgccatcgcccaggctcaccgccgtgaacccgtccctcgggtcggccgccgccgccgccgccaacaccacgcacgccgctacaacccaccaagaagaagcagccatgtttgtagcttgtgtgtgtgtgtgtcggttgctttgggaattggggtgatttggaagaggtttatgtggtttatatagagctcggagggaagcagctcctatgacctggggcattattaaagaagcctcatcgagttcggatgggtggggattagagatcccatcgtttcgccaaataagtcaaagcaaaaaatttaaatttggtattgattttaagatattttctacgtaatttttttattattgatttttaagtcgctacgaaaaaatatatataaaagttttacatataaattattttttaatctctaataagccgttttggtttatcagggaatatgggcaactaatcaggctcttaatatatgacacaccttttttttaattatatggtacaacgcagacactcacaacgcacgcacacttacccctatgaacatacgcacgtaaaccctacctctataagcatctttgaagactaagccggcaaatccttgagattgacgaagtcaccacaggcgctcaccgtcgacgggtatgtcgcctaccactgaaagcacaacgccgttaaatcctacaaaattcgctcccatgaagagtcgaactagagtaattgaaataaataacacagtggagtctactt

SEQ ID NO: 50495 - DNA, 1664 bp, Oryza sativa
tgaagagtcgaactagagtaattgaaataaataacacagtggagtctacttgttcacactttgatcaataataatttctaaactattttattttatatgttaaaaatcatatcgctatattcattttgtatcatgattttgtaattaatatgtagagtttagaggctatttctagaattctttgttggaaaatagtgataaaagcgtagatgtgcagtttagtcaacattttggattattaaaaccagtagtaatattgttaagtacggagaattccttcttaaaaaagattatggagaattaccacaagtggtaaatatgtttagtccccagtgtccttttcatgacataaaaaagttctataccatattttaagctttaagttgtctatagtaagagaaaaaacatagacgattggttgtttccatcagttttagtgcattcttatactatattggcaatcaaaaccagtcaagcacgaaagtaggtcataattggtgataggttgttaaaatcatcatcctgaatcgaaatgagaaattctaaccatgatcacaattatataatcgtatatataaaaatcataaaattatatattttacttatgtagaatcttacaatcaaagcatcttaattagaatcgtaaaatcgtattaaagaattgagattggctagctaggtttctaattaggacagcttcatttttgctttgttttaccctgtctccatggatttggtctatggtcatgttttttaacacttcgttgtacgcttcgctaagcgcttgcttctgaacatcggaattaccttccgatctgaacatgctcgtcagtgacaacgaaccgtcgatcatctgtaccgtgcggacaacttcttgtttctttttggggtaaaagagctactagtatttttttgaaatctatttggcatggacagcatgtgtgtaactttaaaattaaatattttatttcaaaagtatgtactccctccgtccctaaatatttgacgctgttgacttttttaaatatgtttgaccgttcgtcttatttaaaaaatttaagtaattaataattcttttcttattatctgattcattggtaatactactactactcaagtttttaaataatattcacaaaagttcttgaataagacgaacggtcaaacatactttaaaaagtcaacggcatcaatatttagggacggagggagtatgtgccaacaaagacttttcgggtcaaatatatcggaacaatttatttatttatttatttatgcattagttccatccaaagttcacgggtgtcgcatacagagttgaagatgcaatttcagtgttgtctgaagttcacaagctgatgaaatgacgataataatggaggagaaatctctctgcttgactgcttctgttcggtaaccgacttcatcctacgctgagtttgaaagagagaatagtattgaggtttttctggcaccgaaatcaaggtgagtcattagcatatgattaattaagtattagctattataaatttaaaaataaatttatctattttagaaaataaaatacaccttttaataatttaaaaatcgtgctatcgaaaaaagatagagtagcgcgctccaacttatctttagaagtcaagccaagtcccaagcctctggct

SEQ ID NO: 50496 - DNA, 15579 bp, Oryza sativa
attttgtttaggtttataagccaacttataagccgaaaagtctaagcctaaccaaacaagcagcttatttttgtttagtttttttaagccataagccactctaacactattaaaccaaaagctaggttggagaagcttttttggcttatgtgaggttgatgtatgactccactactaaacttaggacattaaatccaccggcttataaatcatataagccaataaacctaagcctaataaaagagtggcctcagtcagctgtcaattgagaaggatgatacaggtgtgttgaaaaattgtgcaggttggtcaatcatcatcaacccggctgctaacaatattcagcttacaaattagcagtcaatagtctcactagcaggcagagagatggcaaaggctccattttctagggtctatgtttgaactgctgtgtcactttgaagatgagatgagataattcatagatgaagatagtatcatggtattggttcagctaatattcagcttacggattttgcctgtgaagtgaaacggttgaaatttgatagctagtattcttcaagcgtatcatgatattgcttcctttctacgccctgtttgggaaacttggtttgtagcaaccagggtttacaattccgacaggcttttccgtttcgggcactggtggaattcggaatttcgcgaaatccggtggaaaaccggtaaattctgaacaaatttcataaaccaaaatttgaatacaaattccctaagtttaccgacaaattttcgaaaaccgatcagttttggcgaaattccgatcgaaatcatcgaaatttcgatcagtaatttgtttcctttttttaattctttattcttttcttttctgatgtaagtttcagtaaatacacataatacataatgtttttcgaaaatttatatctcaataagttatatgaatatcatagtatttataagattttatttgattttatttttttttatgaattcaaatttgaatttggatgaaacttctcgaaatcttaaacggtttatactttcgagcctcatcgaaacatcaaaatttcgcgaaatcctgtcggaaatgtaaaccctggtagcaacagaatctgaatgaaaatctaagcgtggaggaaaaagcctttcaggaagagcttcctcgttcagaattgctagggcttgcaaggtcagaaattcagaacgcttgggaagtgtgaactggggaaggaaggttttctttgctgaaattagaatcaggagaggagatgacacgatgacagaacccaagtgcacgcatgttctctataactgtttttttaaaaaattacatattacaacgcagacactcacaacacacacactcatccctataaatgcacgcaagcaaaccctacctctatgagcatcttcgaagactgggctgacaaatcctagagattgacgaagtcaccacagacgtctcactgtcgacaggtacatcgcttaccactgaaagcacaaagccgttaaatcctggaacctaggacctaaggtgtaactgtttttttagtgttaggctgtgtttagttccacaccaaaattgaaagttttgagaaattgaaataatgtgatggaaaagttgaaagtttgtgtggataagaaagttcgatgtgacggaaaagttaaaagtttaaagaaaaaagttgaaatctaaatagggccttacacgtatatgtacaactcatatacagctagagacacgccactatataaatcaatcaaaagagagcatatttatatgcactgcgaccgtttacaaccgttgatccgttgatcaaattcagtcgtacgtaagtaagacaattaagttatatgcatagcactttcctaattttttttatttcaggatgtttttgcgattgcagtcattccttgttttgtaattgtgatttcagaatcttaggacaaatctagcaacagacatggtcaggttctttcttttggaccttgcatttataaaatacaaaaaaaacacaccatcaccatgttgcatcgcacacgaccgttctttgatcgttttaaactcttacaataacgaaccagcacattttttagagcacccgcaatgataaagtaaggtgctatctataaaatatgtacatctcagcaatagactagattaatcgtataccacctcaatagtatatctacacatgggtttctatagctctctaatcaattgtctcgtttttctctatagattatttccaggttaatagatagttttgctctctctcttcatttaatctcttccaagtaggaaaatatgctgacatggatctcttgtagagagcctataaataaccattgtgggtgcccttaaggataaatgcccactgaaccccaaaaagcgcaagcaatataggaataaaatcctatatgtagtaaggatttcccacacttagcaaacaagtaagctgcaattttcttccataacaaaattaactgtgctacagtgaggatacagcaaaactatagtaatattctaagaaattgaaacatcaaaattgatggctgctggtgccagatgttttctggagaacttgtctgctcctttgagccccccttgtgagatgaacacgttttcgaggctttgtgttagcagggcttcctcagcatgcacagggagtttttctggtaagttttacgagccaccgaggtcaacttgtttctcgtgagtttcacaagctaccgaggtcaactttctggaagtgctaatttaaattgatgattcaagacctcttcttcttagactcagatttctctccatcatttcctttcctttttgatttcttcatttctttgcgcttctcttgcttgtcagcctttgtcttgttggatttcacactgataacaccgcttgcggaaatctttcctccgttcagcgccttctcaatctcatcgtcatcggcatcaattgcatacttttgcagaaactttgggtccacatcatcctcatctattgctcttctttgttcctatatttgcccaagataaggttagcaaagaaaccacaactttggcatgcaaatgcaacctttttttttattcgtgtttaaatgtgtcacgatattgtccacatctaataatggtgctcaaataatttaggtgttttctgtacgagacatatggccagttttaatattttaatcgtgcagaaactgcacttgaactcataaaatatttcaacatcctcattactcctcagtggacgactcaggattttaagtatgcaacgcattactgtatctaaactctaaagaaaacatacctttacttccctggctgcttcatcaaggtcctcatccaatgatttaagaggagctgtatcaatctggaagtagtagtcagacatagcagctattatgagattatggccatgcacaaaattttatctaactacaccatgagcattgcttccatgcccaccaatgaacaatgccaaatctggaagtgcaactattacgtgtcaatactaagttgacaaaaggaaacaaaatatggttgcttacttcctttagtcgtggtaatgttgcttcaatttcttttcctgcaatattatgaaggtaaccgtataacttcttcattgtcttgatgaagtttgatagaacctgttccctctctatccccagttcttcctgtcaacagaaaaaccaaaagaattagacatgccatctcgatgaattttaattccaagtattttgaatttgcttgggatcaacttgagcttacctttgtagcacctatgtctttgtctggtagtcccatacagaacaaaacagctgcttgggcaccatgtagtgtaacaggaagcttctctgaaaaatactggtgtgcaagaatagggcaaaggtccagaatctccaaaaataacagaaaaaggtgaaaattggaagtgtttcaatgtagctttataacacaacttgtattcatataaaggcaaatgacaacatctgaacttctaacctgattaagaaaatgctttcatgagatggaatttaataaacgaaaaggagagaagatacccttctctgatcatagcaacaaaagctacatttgcagaagtgaacggtaataaaatcataaggaggcagtgatttgcagagtagctgtgcaggtattaaatatttccagaaatctgaaagttgctgagtgatctataacaatgtagaaccccaatttgcatccctaccaaacctgggcctagaaattttgccttgaacaagtggaatcaaactaaagatccttcataaatttcttaccagatgataatcgaccaaattgttagaatatgcttccagccgcttcatatcatgtggtgatagcatatctcccaatatctttgaggtaatattggtataatagtctgagggttcgtgatctgaaaaatcaatcttggaagccaatacactgggaatacacagccaataattagaacatcaccaaatttctttcccatgaaaaaaaatttgaaacttcaatatacctcattgcaagcttaaaattgagatgccggaaagatgttcataagagacgcctgaatctttgtctgaaatctgggcacattgttccaaaatttagctaatgcaccaaaaaaatcaagcaaaaggcaaaatctgacccgtaaaccttccgtcagatttgctgtgtacagttaagaaatcaagcagcttcagtttgaaatgcattagatgaggaaacagaactcatgattttgtaccttgataaaatggatccaaaaatccacatttgcttgactcattaacttcaatgtcatcgctatttaagggcctcaagaccatacaagtatgctcaccagtcacagcactctgaagaatagatggaggaaacataagaagctactacaaaagaagaactgcagaggtgaagaacaacaaatagatcagattagatcattacaggaatttggcccacatagaatggatagaagttgtgcttccgccaaaaacggaaaagctcttgtgtaagtccaaaagatacaccaagataatggagcttttcaggacgacgttcgcgaagatggacaaggagtggtgggagatttgccctaggctttacggtctcttctagtagagaagcctgcaatagtaatatacaaaactgtaaggtagagacttgtggtcaagcaaaataatattgtttggtcacaatatattaattcaaataatatggtaggcaaacagaggcttgcatcacaatgtacataataaaagctgctgtgctatgtgcagaaataaaaaagaactactatctaaaaatattacaccatgcttattttgttcaaagtttgcaaatttaaaactgttcatacattaaaatatgtagtatgaaaaccatacaatatagttctaattgtagagctatttcaaactgttgcacaataagatatcaaatgggcataataaatagttgttcaaatgaaccttctctgcagcctcagtgatcctgacttcaggctcttcattttcctcctcatcctcagcaaatagagtcatttgcccttcatagtacctttcaaaccaaataaataaatgtcagtaattgagtatgggtaaacaaatccttgtgaaaaaattactaattaaattgccagtaagattagacaagtccgttccctatatctaccatcattaatcatcaaataccagtttcagccaaaaaaaaaacagaagagcatcaacagatactacaatccacagcacccataacccctagttggggtaaagaagagaaatgcataccttgtcaaaaggtccacagcagctgaaccatatccaagctgcattgacaaaggagaatatttagagtgtggagagtgatgttaacacgtgcataacagagttctataaaggcaataaacctcaccctcacagcacttggatggacagcaattcgtacaatccgagctcctgagagacttggaaacacgttgtcttgaaactgttcacaaaatttccatggtatttgatcaccagaaggtgaccgaccctcacttaggcttttcatagctgattttcgagatatttgaccttccaaacagacctgaagatcacaaacaagtatatttacaagaaaggtcaacatcttgaaatgttgtggcggttgtattcagtaggaactaccctttaaattttcagtctagattgttcatatcatctgaagatgggcatcagtggaagtgaagtggagaagttaaattttaacaagagttaagtactgaatttaacaaccacgtgaataaattagttcaatcaaggaaaggttcagcttccagcaaagctaaaaatgtattcagcaaacaatgcatagtaagaacaatgagttgaagctaaagatatgaagtaatagattttttttgtagggaatgggaattagttttaaattaaaagaacttttaaaaaacataaagcctgagccctacagatcagtcgttaaaaagttgaaccagatttgcataatgtggtgtgcacatataatgagttattacaccagggccaacacatgaagcttgagcacattctgatgaggtaaaaaataaacaatgcaaaactcactaaaaggttcacaattgaaagtaaacagtaagctatgaaacattgcagtgtctttacattgtcaactaaaaactgaagttggatgttttccaaaatagcatagcaccggagtgttgccgcagatgacaaatacatatatgatgagataaaaaaataaaaatgcaaaaaaatcccttaaattaaaataagtatacagacgaccacatgagatcatttcaagcgggagcaggtgcagaacatactcactccattcttttttacttgtcatttagggcattggcatggtccaatgcatatcatttattttgccttttctaatgatatatccataaaaacatattgaaaatataactacagaataatatttcattaaaaaaatgctaatatcttatttacatatgaaaccttaatgttttttgtgtatattagtgagttaagattactaggtttgactgcatggatcctaagatgacatctatttctgaatgatgggagtaccatcaaactgaacttcccttttttataacagtatgggcagatatggtgattcctatggcaaattgactcaacaacatcaaatagattgataaacgctgaatagtacaatagcaaattaagatgtatgtaatttttgttactggtgcatggcattaggatgcatttctacaattatgtaagaaactttaatgttgttcggctacaccgcaattagagaatcatatatttcacacttttggctactgtgcaagcaaagaatcagcatatggccatcattaagagaaaatttcaaaataaaatactaagaagatcaagcaggaagcagtttagaacctggactacacatagaatatccgggagctgatttttagactcatcgactgggcctagaaaataaagaacataagttagtacttagtacagcctgacagtgttgccatggtgaacagttgggaatgctgggcaattagtccctaccaagcaatacaaataggtgatgagccggcgcatcagccattagttgcaagtcattgggtgaatttttgtaatgggaagcaacataaagtgccatcatccgctgaaatattaaggaattatgataagcatccattcatgaataaggaaaaaagagcatttctaatccatacctgtaaaaatatctcactctccttatgatatgagaaaagtgtgtctcggttgacataataaagatcacattcttttggatgaggtagcctaaagaaaaccataaattgtttcagacatgcaagtaacttggaagaatacaaaatgcaatttagatgatgctcacctactgatattggggatggagttcgcaagatccaaacaaagtaaatcattaagccagctctcaataggatcaccagatgcatacctaatggactcatttaattcaattttcttaaaaagcctacctacaaaccaaaacaaaacacaaaataagtgtaaaacatccaaaaatccaaggttcttcaaaagaagtgcattaaacataagaacctctgttttagatgaaagtaagaagactcttacttgaattgggtccattatttggagcagatggctggctttgggattccaactgctgtaggagcttcaaagacaaggatcgcccagttccttcgtaccttcaatacaaaaacatccagaatgattacaaccatgattttcagtgttatctcatttcgaaaggaaagcaaacatacccattgacagtggatgataggaaaacaaggtatggaccaagcaaggacttaacaattggcaatggaatagcagcagcttcatcaatgacaaggagctcaacttgagaaagcttcccatgatcatgtggtttcagatactgcaacattaaaaacagttgaactgggttgattgatatcaagcaaaatattgctcaatgtgggaataagctagtaaaaattatgtctgggaaacaacaaactataaatacaattttcaaggtatgaaccttaattgaatttatcaatgatcatcaaacacactttattgaatgatctacaaacaaagaacattatcacgaaaacaataatggtatattatatatatgttttatgaactacagaggatacagctcatgtgaagaagaccacccaacaatctacccagaataacgtaaactttgccattgtgagatttttacataaaatctcaggaaggaccagtatgcattaaaaaagtaccagtcctaattaaattttgtatcatatatgctgcgtttgtgtaccttcacaggcaagtaatagtaataacaaggacataagtttttcaatcttctgcagcatttaatagactggattattgaatgtgatatttatagcagataacaacatcagcctttggtcaaaggtaagttgggactaggctaaggatgaaacctaagtagaaacaaatgagctaaaaggggggaatagctaaaaaggcaaaagattaagctagttaacaaaaagcattccagctcatggttctagcatatgaatagctactttccacaaactcctacccaaagccagttctttcgacaccatgtcttcttttaactggttcctcccatgacagttttacataacccatgcctccttgtatttttgaaatggtttcgagtgcactacagactagttcttcagggggggctccatggtatgccaaaccaccacaagcgatgttggacaagcttctccccaatcagtgccactcctaccctaccatgtttacaataatttctaattcaatccgtccctgtatgaccacaaatccaccatagcatacaaatctctgctacaatcaacttctggatgtgttttcatattataaccagacataaggtaagcaaagaactatggtaagcaaaaatagcataatctcaaagtaccaagtcaactaccataatattggcatggccataagataatgtgcattttaaatccaccaaaagtttagtcctcccaaacaggatactaaaggtttctagggaagctaaaggatccctttgctcatacagtttgaactttgaagcccctttccaccaacatctgataagtgataagtctaaacagaacagaaagaacctttgggtggaagtagtaactgtctacctggatcgtctgacgatgctgcttgtagacatttatttgaatagttgccttcttgagttctggatctgcactcttcaccacatcataatgcaaatgctcctgaaaggggtgaaatgatacatacattaactgcataatacagaattaaactttttaactccaagactagactagacagacaccttgtactccagtgcattcattcccttgcacacaaaatcaaacagtgtttttaggttctctggacttggggctgtgacaaatatgtttgaatacctagaaagacaaaagattagaattaatcacggagaacgcaacagataattaactttaattgagttgagcattacccagcagcaatggctccagcaatagcaagaccaagggcagctgatttcccgcgtccgcgagcagcaagcaaggcaactgtgctcctcagggacttgtccaaaatagagtcaaggaaattgatcacagctttaccctgtacataactcttaagtttcagcatgctgcaaaatgaaagatttcatgtgtaaggtaaactaaaacaggataggcactaaacagtacctgatccatcgtgaagcactttccaattaaaggaccaactggaaagtcttcacggaattgatcttttagatctttcaactctctctccctttctgacagtccctcagaatcctaaacatatgttaaaatatatatgacatagcagaataagatggcctggttgaaacaaccagaatatccaagagattcataaaaaaggggaacaactcagcaggagcattcataagatcaaaaggcaccatcagcatgagtagacaagacgagttatatggaaaaaaaaagagagagagagaaattaagcacacatacctcattgttcgtaactggttgtataaatttcatgtgagaggatataggcaaaatgttgagttcgtcatccatgacgacacatgatttgcaagacgctatggatagcaagaacctctcgttgaacctagcagcagcctgggtatgcgactctgtccggaatctttcatggacatcctgttggagcaggaacaactcaacttagtcaagttatctcagcaccgaagctaagatgtagcatgtaaaccaaaattgtcccaagtttattgatagaaatgggatcatgtatgtatgcatgagagaacaagagaagcagaaggtccaacagagaattgagctcaccatgaccattgtataaagactggtgagagaggaaagggagcggagcagcaggatgatcaaaccaccaccctcaaccgtctcgatggtcctcgcgagtaggttgggcgtgagcgcctcaaaatcctgcggcgccaacaaacaccatatcagtacaggggaattacactacaccacaccacagcagcaccaaaaaggagaaaaaccaagctaagcttgatgttagacagacagacctgcaggatgcacatgccgaatgtgttgccaagaaccctctcggagtccttgtagaggcagtaggtgatgtcagacgtctccaagaagagcgagaaggggtcggccttctcggggtccatgagccccctctgcatgagcttcttgatctgcttggcccgcttcttcttgtggctacacaaagcattccatacaggtaactggaacggcattgctcacacatctccaattcaattcaacaatcaatcaatcggtgcagcaaccaatcgagtactcgaatcgaatcttaagctaagcgaatatggtagagtagggatgggtaaggaacctgctgatctcgagcttgtcgcggtagcaccagaggacggaggggcgggacttgacgcgggacttggcgagcatgtagttgaggttgacgatctggtcgcgcgacttgtcgccgacgatgacgaacatggaccgctgccgctcccgcacgccgttctcgatcagcgtccggatgcgctcgtccaccttcttcctcatcctcgccctcctctcctcttccccgccgccgggccggtctcgtgtggtcacaggagatgagagcgcgcgacggatagcgcggggcggacggcggcggaggcgggctagaggaaggaaggcgccggcggagggtggtgcggcgaggcgcggaggcgcgtacgaggtacgagtgatggagaggaggaggtccggaagcgtggggatttagggtttaagacatagatgggcctttcatgggctcaaacttgaatctacggagataggagatgctgataactttttctataaatttagggtaaatttaattaaatctttattaggactttgactagtaaatttaattaaatctaaatttggctgtgctcttctccctcctttcccaactaacctccctctttttaccgtctgcacgctgctaaacgttgtattttttgcaaaagaatttctgtagaaaaattgttttacaaaatcatattaatccattttttaaaaaaaaattaatacttaattaattatgtttcatgagtcgtacgtgcgcgtgaatgagttcctaacttatggtgccgaactcatgatgaaacggagggagtaataatctaatgcataccgacactgaaaagaagccctaatcgaactcatacaattcttaaccagaacaaacaaactccaataccacaacacagtccatcttgccttgcatgaacgaatttagctgtgcagactaaagttctctgcactctggaactctactgtagtagcatctacacaaaataagcgcagagcttactctattgtagcctctccatagaattggttaggcattaagcagcatacacattttctagttaatgctgattctgtattatcacatttcttcaagacatcagtatgacagatggtcataaagaccgtataatattagcgatataatgtgcattcataccttttttttttcctacaaacatgaatccctaactactgtatacatctctcaactctggagacaaaaagaaattcaaaaaacgcaaaagaaacaaagtgtgttatgacaacaatatcaaactattttcttctgatatccgagcacttcatcttcattgacataccaactaggtacatgtcctgcatttgagttcaagtcatttgattatcgtcaaaagtatagccacaaaaatatcacctcgtagtacgaaagttttatcagactatgttaacaacaaagtgaacattagtatgcaagtcaggatactaaccagtctatcacaattcacaatgcatctgcatttctaccacctctcttactaactagttcacaaagtcggcaaggcagtgtgtcaaggctcatttcacgcgaccttccaaagttacccagggtaccacacctcctccatgcatggtattctgcataggctacgggatcatttgcaacagctttcacatatgatgccaactcacggagtgagctgaattttgaggcatctataatagaattgggaggaatgaagtcccagacattgggtgccccgaagtatattggcactgacccagcctccaaggcatagaacaatttctcggtcacatagctttctgtcttagtattctcaattgcaagaccaaacttgtaatgtgacattgcgcagtgaagatgatcccaccagtgtggttttccattatcattggttgaacaaactggatacatggataatgccatgtcaggaccatcaacattattcaagcatttcccgaaagagtggtgcggaaccaatgacaggaaatcttttgcaaccttgtctctatgaggaagacaccttgaagatgaccagtaaataagtgcatcctgacaccatacaggagatcagacattgagatgattaaataaactttttttaaaaaaaaaaaagtactactacagcagaactgattgtgtctcagagtgtgcaaaaataacaaagcaatagacatccacaatttcatatttacaaaaagcattcaggtataccggtaagtaacaggagcaccttagcccccgctgagttatgttgttaacttgttttgaacactacacacaatcggatcttgttggcagttgaaaattgtatgaagtttaaaataaaaatatgagaaaaaatgaaatccagaaaaaaaaaagtatcgaagggaacagctcgacctaaatgtgtgaggttgtgcagctgtggtgcactggtgcctgctaaagtcttaatattatacttctacagtcaactacgcacacttaatcctatcatgctatgatgagcagtgagctagcagagtcaggaacaatgatgtcatgcgccatgtttacataatatattattggcaatacgcaatgaatggaaagttaagcatcatgttgggcttacatttctcttttcagttgatacatggtaacttcggctagtgtggaatgattttccagcatatgttacttgcacatcatctttagcatggtaacctataaaaatgtcctcgaaaccagttggtttcctagcagcctccagatccagatatacacgaagaggcaggcctttcattctctgcaaaacatgttcaagaatatgttaaacttggaaatcagaaagatgttaacatttactttgtttaaaacagcatccttacataagtaatgaaatacagtatcctcaggaaaaagagaactaaactactaacggaaatggtatgtaatggttagtaaaaaaaccaattgtatttgattccatgattaagttttgtcagaattgtaagcctgtaactcatgccactcaatactggcactatatatgtgaatccacaaatattttcgtggagactcttcatgctgttttcgacaagatgaaactaacaatcattgggtttttttattgtatggtggctatatgtgcctaggcagttgttggcacttccatttgggccaggcaggtcaacggctagagtcttttaggaaatatatgtggtgcattagacatcatttgccatatggctacaaggttcattagcacgacatacaaccatttgctgggtaataaggaagcatcaaaactgagcatgtcttcggaataagatgatctgatctcctgctgaggacattgtgctttttcattcctggaattttggacaggccttcagggagcgaatgtcaaagaagtgatgaaggcaggggctgcaacacagccaacactacaggatgaaccacttcggtggcatgaggctcctaaacaccaagcccaaaacgaaaacagagaggaataccatgctgttgcttctgactttatgagagaagggaacatcaaccaaatgttgctgaattcacgtaacctggataccatacaagattactccgttcatcatgtgtttgagggataactctgggagaatgaacagcaatatgtccatatttcacatagttagcaaccgccatccaagagtacgcaatatttacaaactaagggtgcttttggatcagtgagacgcattgcctagccagcaaaaaataactgcctgcggctatagcccacgcaacaagcgacctgttttaagtctagctgaggatgtatgaccctcttgaaactaccaaggtattacttggcaatgccactcagatacaaaagcaagaaagggggcaagcattctatagaaaataaaaaaaactgcctcaattaattaaggttgtttctctaactgatagtacttccagatatgcattaacactcgaagaatttattaaggccttgttcggtttgaaggggattgaaaaggattggaggggattgagggggaataattccacaccacagtaggtgtggaataaatcctctccaatccctctctcatgg

SEQ ID NO: 50497 - DNA, 1428 bp, Oryza sativa
  unsure (1)..(1428): unsure at all n locations
cccaccgggccccgccggtgatcgacgcgcccgccgccgcggtcgagttggcgccgtacccgggcgcccccacggtgtccagcttggcgcggatgcgcgggcacccgacggtggcgtcccagtccgctaaagccgagagaagctacgtgaacggcgaccgctcgcgggtgccgacggcgtccagcgccgtggcgaagagcgncggcgccggcncgncggagtagnagnagatgnacgggagctcgaagtagccggagacgaggaggaggaggatgacggcggaggccagcatcggggccatgtagttgatccgcttcgggaagagcatcgaggtggcgcgcccctcttcttcctccggaagcttctggaagcttcgcctcctcgccggagcgcgagatctcggtctcggaggagggggaggcgataggtagaaggattcaggattaggtggagtggaattaaaagtttttcgaggggctcttttggaaaagatgtcagttcgcgtatcggaggtttatttcagctacggtgttttttgcgattaggtccttggaagtttaagattttacagtgaaaagggtggaaggttgtcgccggcggctgccggtcgtttaccaggtgagaattacgatggtgttgactttgaccatagatgggctgggccctgcattgaaaggccaggcggcccaggcccaacgccaaaatgtaggagtattattttttagatttttcataaacctccatccatttcaaggttgacctcacttgacaacttctaacttgtagccaatgtttggaaatgggtttgggatatgatttcccactcccaaagagtaagtttcaattttagccatccattcatctcaccccatttcatcctatccctctattcatttttatttctcaatcccacctctcataagtcataacccattttccaaacacacatgtagagagagttgtacgaatttatgcctctcccttcccaattcctctaccaaaatccttttatactatttttccccgtagtttgcagaaaatcatcaaatgcagaaatgtttgcaacatcatctgcataactatcttaataaagaagtgcatataagatggtacaagatgggaagaacaacttcttccactttagataacacaatgctattacaccatgaaatacatacgtcatatatatatatatatatatatatatatgatcatatgcaactcgctacgcatcatgtgcaccttcacttgtcaccattctcctcctgatgatcacccgcgaattgctcggatggcagcagcatcgcgagcgaagcatccaactgcccgaatccgaaatccatggcgccgaagcttcccgcggagaagaactcatccccaccaccggagccggacccgacgccggcgatccctttgacgtcaagaaac

SEQ ID NO: 50498 - DNA, 3058 bp, Oryza sativa
cctgttcgtctcgttattacgagccgagctggagctctcgccggcggcgaggctgaccgcttgtgcggctccggccgcggcggcgggcggcggggtggtgcggctgaggaacgaggagttcttgagcgacgggaggaggctgccggcggtggagatgagctggacgatgaggcatgtcaggtcggcgttgacaagctgctgctccggcgtcgccgccgacgacgacgaggcgcggcggccggccatggatcggatgacgtccttgacctgccggatcttctcctcgatgaaggtgaggttgtccagcatcgtgtccgggctccagtccatgtgctggatgctaaccgacggcagcagctgctgcggcggcggcggcgccatgccgaggagagcgtcatccgccatgaacgggtagaagagaggattcatggaggtcaggttcgcagcctgatcgcgcatcgtgttcgtcatctggtcgcgatccattgcaagcttctgaataatctcgcgtgatctttattaggaaaagagatggcgcctctgaaatctgcagaggaagaggaatcaagatcgttagccagttcaaagattgttcttgttttttttcccccaagaaactatttgatgttatttttgagttggttgaaaagtcaagaaactgggaactaattagtagtagtaatctactagattatcaagtgatgcaagatttgcaatctgctccatccttttcactgacacagtcagcaatgctaaaatgaagtttaaatcgattttttttcccataaattacttgatcaaggttcttctctgaacgaatatgctacgaattaaaagatactaccagctttgatcattttcagaatcactaatttattactaacacaagacaggagaaaccaacatcctttttttttcctaagaacaaagaaaaaattttgcaactactgcaggctgcaggaacaagatatcttaagaaccaaaagtctccttcttagttcagaataacctaacaattcacctaaacttaactagttaaccgtaaaccctgaagaaatttctacaagaacaataaggaaaagccttagatccaagaacaccctctctatcctcccaagatcgcagaaaacaggggaaacttatatccatccaaagttccaaaccataataacctagaacgaaactgtcaactgtacaagaagaagccaaaacaaaatcaccagcaagatggttccaatccagcatcaagccaaaacagaagaagcttacaagttgctgatcagagatcacatacccaatcaaatcaagcagggggaatcactcccagctcgtcgccatggacgcctagccgtgtctccacaccaagaacagcagaacaggagaggagaggcgagcgagaaagctagaggagatcgaaggaagcatccgggaagctgggggagctagctaaggcgtgagctgtaggtcaaattaatttgggggtgggatgggctcccgattccaagatcaggatcgagagaggagggggacggatcggtcgtcgattgcccatcatcctatcttagtttagtcggctgtcagtgactaatagcgagggaaattgtttgattagtcgcctcgagtctcggttcactctgctcgagcagttgagcttgagctagacctctctgattgtgggtgtcgcagcctgatttgcttgccgtctctttggttggcagtaacgcaggtgcttagcacatgggagcacttgtttatatcagcttgattatactatggtttagtggagggtagatcaggcctttgcgtgtgattgtatttgttttcagacggggtcctctccgtagggtttgcaatatcgcacggttacaccacggttattgtgcggtaaccttctttccggttttttaaactttatgattcgtaacctccggttttcgcggtaatcgtgatactattgggtagagataatcctcaccaatatggtagtaaaggaaagtctgcctctccactattatgtggccaccgagaactgatatagaactgaaagaaaaatatgagattatttttaagggcacatttgaaatgcaggattatagaaatatattaacattcatgtacgatagccaatctataggattttgcacagtccatttctttgttttaaatgaccttatacaaatatttcccaagaaatgaaatccttcagattttcttttagggcccctttgaaacgcaggataggaaaaacacaggaataggaaaaacgtaggaattgaagttgtatgtttttccaatcctacagaaattgaaaacacaagaaatggagagaggagccctttgattataccacaggataaactcaacaaaggaaagtttcacaagaggtctaatctcttgcttattttcctatggaattgatcataggaatgcaatcctatggaagttttcttatcctctccctatgaatcaaagggctctataggaataaatccttaggaaaatgaatcctccaaaattcctttgctaatcctccattttaaaggggcccttaaatcctttcaatctcaaggagccctaagatgttggtgtttttgttaccttatttttgttggaaatttagtgaggttcactgatgtatcaatggcctttactaggtttagcacttatatttactttacgccatgctatatattgtacaaagttccagttagcattgttccagttagcatcatgatatacatcatcaaacatatagaaatttcattaaacctcacaaaatcaaaatgaaacttcatgaaacatgatctatatttgttaagtctggtatgtctcgctcatgtttttgtgatatttccctctgattatatgaaataacctagtgcaaaagtaaaacttatttccaaatacactagtataaagtgaaagtatacactagaccccatgcaaagtgaaactagatacactatacccaatgtaaagtgcaatttgatcttaatgtatgttagaagagacacattcgtaggtgtgcgagtaaacagtacatgtgtgtattttgtgc

SEQ ID NO: 50499 - DNA, 3655 bp, Oryza sativa
attacaacaacagaacagttttgtttatatgtacttatgtttgacatattctttggctgtcaactccacactgagatttatgcaaccttcatggcacaggcaaagtttgcacatgggctggtaggcctatagatgtggggtaaggaaaaaagggtgaattgtaagagttagataaaaagaatttgctggtggtcagtacatgtagggcacatggaacttaagaaaattttggtacacactcctgattttatagtgtaatgtttaaaatttagcgtaaatatactttagaaaatttacaaactgttttggacttttgacatgagcccgatgtcttttgctgctttgacaacttgcagcagcaactatgactactaatgttcaagcgtacacatattagaaccaatatgtacatatattagaacatagtgaactattaacctatttgattttaaaatttaaaatgattagatattatcccgagagcagtacatcaagtctcagaaaaatacaaccaccaaagccaacctacctgcagcaatctacatgcagttgctacctcaaattgcatattgtgcaaatgtaggacaactaggtcttgctaaaagtgctttttttatggttgtggattgtaatcaaagacgtgcttaaaaaaagagtgagacttgttatacccatggtttttatcacttaaaaagatatgagaatgacggcaatactaaaataacagaagaaaagtacggtgttattgaatgaaccataaacataaactctcagtgtaaaatatcccaaacaaaaatgttatgcatctagaaagtatattttaggtcaagagattcgttacatggctacaaggtcacaaattagttacagccttacaggtctcatgtatcatcgttttgtgtttttttttacaatgaacggacttacctattggatagggtgggtcggtcggtccagctataacctgtgtcatcttacacaccagaacctcttctagcactgagccatccatattaaccaccgtctactaacccataaacaacccatcaaattaatattttactccagactagaaatgaggcaaattgctcgtctcttcgtcccgagccatcgactattcattcgtcttcatcacctgttgcttgatacttgttccttcgcagtatcgatgattgtgctagtatacatgtgttgacgatgtattgtgcacaggcccatccgcccatggcccgaagccctagccagcaacatgttagtgggttatgtatggctaagcgactctataattgcattctatttttcttttttgtctttgatgttcttttgtaccttaatttattgattgcactcttgttctcacacggttgcaaaatatgaaacagtatgtgttatattccattatttttttcaagcatatctgttatatctttattttagatttagagctatgtccgccgaccatttatcatggcgtgcaccgtatcttccgttattttgtgaagcaacccacgcaatcccgctttcaaaccgcgaaggcgtaaatcctcaatttcccgtcttcgaagcgatatttccactccactccacgcaatcaccgtgcacctggcttggcgcgcgccacgcgcgggaaccggacgaacacccaccttccacacgccaccgcccaccggcgcgccggccatggctcccctcctcctcctcctccccccactccgccttctccccgccacccttcttcgcgccacaagccgcccggcgtcgccaaggcgcggcctctcctactcctaccccaggcgcgtcgccgccgtcctgcgacaatgccgcgcccgggcgccgcctccgcctgctcctccggatgccgtgccccggtggcacgcggcgctcgcggctgcggcggggctgtacccggcgtacgtgacggccggcgccgcggtggccgtggcgcggcccgatgcgttccggtggttcgtcgcgctggcgccggggtcgtacacgttcgccctgggactcatcatgctcgccatgggcctcaccctcgagctccgggagttcttggctctcctccgcgagaggcccctctccgtaagcaccccaccccaccctgcaaattttggcactaaatatttctccatttctaggtgtacaattccatggcaatctttcaaatttcaattgtgtccttgaatccaagatcccaaaattgtgactgatccaaaggaaataaattgtgtgttttggccgctgtagatattgtttggttgtgctgcacagtacaccataatgcctgcctttggagcaattgttagccgggtgctggggctctctccaccaatatcagtgggactaattctgctaggatgctgtcctggaggaactgcttccaatgtggtaagattctcaaacttgctcagagaatatgccccatttgagatggatcctcgactggattattgccgcgaactgtctactttattgtggagataaattaaacattttgagaaataaacttaacaaaataatttagaacaagtggtctaagcaatgtagtagaatttgtttttaaagaaaatgtatttttagaggcgtgaagccaggggcggacccagcccagaggcaaggcccggaccggcctatagtatttgttttcataatattagcccatgggatattgggctttcaaccccaggccccgtgccatggcctagggtgcccggggtcggggtccgcccctgcatatagcaaataatacatggctcgactatgagtctatgacccgttttgtactgaaggggaattaaggatcaacacttcaacagacacatagtagtgtaaatcaagaattcaaatgtgcatattatttgaatgttcgagtgttctagcaatttcacagtgccacagtccaatgttgaattttaaatttccaactaggattaagatcaagtgtgctttatgaaggtatatcgactatttaaacgattgattccaacagttaacatatgttttctgagtgccaagaaacacacaattatctagagcaccaagttatttttggtggttcctttaggttatttctacataagacgttctgttattttactttatcttcttggctttatgaaccctgagctctccaagtatatgctgtgtgagtcaaatatgcatgattaaacaaagggtctctcattcaagataaaatcatgatggttggaggcagagtatcccacataggttgtccatgtatgtggatgatgtagttatgttcttcctagcaatattcggggaagcgtcgggtctaaataccaagttcgcaaaattctcggtgtttctgagctgcctagtgtggaattgcccctgtgctgttcatgattcccatgtaccttgggttgcctctgtatgaaaaggcacacaaatattttgcatgctgaaaaaatcatttgtacctggattttctttgttatgtattgacctagttcttccatatagtggttcaggtgactttagttgctaaaggtgatgttccactatcaatcgtcatgactgtgtgcagcactcttggtgcagtgttccttactccactgttaacaaaaattcttgctggtgcttatgttccagtggacgcggtgaagctttccttaagtactctgcaggtgaaatt

SEQ ID NO: 50500 - DNA, 6578 bp, Oryza sativa
ggttcctctatacaaagtgcattcccatcagtagttaaatttgttactccttttgcccctcttctagcggtcttaacttcatcacttctggcgtgcaggtttgagttcttgtaacatgttatgttattggattttgaatagctgaaacagcacgcatttttagttttttttaccatttttttattcttatggacagcgtgttctctgagaactttgtacggctgagatcaacaattgctgatgcatcatatgggaatggaggcctgttttctggggatattggggttgtgatgctgtctgtcttcttgctgcactgtgctggttttgttgtcgggtgagcactggactgtttgctatagttatttttttatatgaaggaattacattggttgtgtgaatagtagaaatttttgtttaagaaaaactgtaagggaacaaatcgtgatgtttcatccttccattaattcaaccaaaatgttatggatgcttgtagtagttagtatctatcatccagatttctgattgtttacataattttaccacgcataggtacacgacagcagctataggtggtttcaaggaaagacaaaggagagcgatatccattgaggtatgcagtctgatcgctaaagctactactagtaatttatcatcgtcagaaatgcagaacatagcattccaaagctaccaattttctatcatcattaaacgtggagtcttattaaaatatatgaaatcacacttccatttagaaaatcagatggtttaaattgcttcggagagatcaacactaaacgtaacaatatctagccattatcaacactgagttactaaccataaaaatatctaaccatttgttataatttaaacagttgcattccccacagtgtaagtttatttctcatactacctttaaatatgtagcattacaaaacaatactattactatggccttgatcatatttatttggtctttgttcagtttataactggcatgaatataatttgtttctggatagttttctccaggatgatgaatattatgcctttttggattgcaggtagggatgcagaattcatccttaggagtagtattagcaactgcacatttctcctcttccttggtcgccttgccagctgcactctccgctgtcatcatgaacataatgggtagcacattaggtcttgtatggcaatttatgacaccgcctgattcgaagaacgaaaaccgttgactcgcgtgatgtatgacctgctcctactttgtgtggttaatctcctgtcatagtctgctgtaagaaacattagaaacgttaaaaccatgccgtgtatatcctcaactttcagcccttcctgatgtcaacttgtcaagtagggattgtacatagttttggaatgttgattttctgaacttttgctgatatacagtctaaaatgcacatgtggccaaatccggaacactcaattgttgtctcgaggaataaacgaataatgcaaagaatttggtaatgtatgctgtgacaaaaaaaaaaaagagggaaaaaggaacaaagctctgagtcctctgccaaaaaaaaacagggaccactctgaatcatgtagcatgtgattctgtacaatattatgctttgagacagccatatgccatcagttttaaatccatgtatggttgtcaatgcactaggaagcagggtgcaatggcactggtcaaggacatgtaccagcattcatgctacttatgatagattatcaccaaacattgcatcaccccacatggagatgttgttggttggtgaggttcaaggaacccttggagcacatctctatcttgtttttatgtttccacacacaactttagatatgtttagtctgtatatgttgagctgagataactctactggaacagctgcagaaattttatttacattttaatatcagaatgattttcctttttttaatccatgttagtggctagcaactttgcatgataattgatatggtcagatttgaaaggaagctccagggcacatgttgtccagaagaagctaatcatgtgttgaatgagtcataaggtttttacaggtcagattctatcgaacatttctaggtgaaactcaaaatatgaaaaagtatgcaaaggaatatcaataccacctccgtcccaaaacgttactacctagtaatagatgctcatgtccagattcgtagtataggatgtgtcacatatagtagtactagataacaacatttcattttgagacaagtatagtagctgggatgggatgacctgatgacagtcttttacttgccttttcactctgtgtcactgatgggatcatgtgcagaaaggagtttagcattcattggtttggtccaacttgtgaaaaatgaacggatgcatgacaaatctttgtatagtgtatcccaataaatccatcactctactgttcccattaaaaatgaataatttaaaataaaatcgatgatctgacctgctgcattgcgtgcttgagcacccatatcttggttcattggttgctatcagcatccccggggcggctccagcatacagtcgaattttttcatttttaaatttttattttttaatatttacagaaatattgtaccggtgaaagtatttacaaaagtaggtgacgtgagggacggacaagatgaaaaagacactagaaaaatgcatttttggcaggataaaaattacatttgcccccttgcagtccttgtagagggcggcaaggcacctcagtgcaaaatgcacacaccttgccgccccaggggctatttctgtaaatattttagatggtataatatttttgtaaatattaaaaaatgaaaatttaaaaatgaaaaaaattcgcatacagtccgggtggtccaacctttgaccaccctggatcgcgaaggcccaaacgaaaaaaagcccacaagcatcagagccaggttagggttagccggcagaggagagggctcaaagccccgtgcacgcgccgcctctccctccgctgcgctcctcgcctcctctcggctctcgctctgcgccacaggcccacagcgccggccgtcgcccatcggcggcgtcgggtccctctccctcctgcagtcctgctcgagctcgacgacgacgacgagtctatgcctcaagccctaaacagctcctcataggtgagttactcattttagtctttactctttagtatttacttttaatagatcggtcatcgatgaattgaaaaatgtggatgaaaaaaatgtgattgaaaactgaaacttagattttttttttatcaacaacttagttagtagtcaatataacttagtgtatgaaggatgggaagaaactattgtttcattttgcaataaacatagtatccaagttccaactttcgatggaaaaatatgtgcctcatggaagatctccacggttttatccggaccaaacaaatgatgatcattttagaaaacaagtgtacattggtgtacaaagaagtagtgtattgtaatcttctacctatctattgtaatgtaagatatttgaattatttatgttgtaactttcgtaacttcgaacttaaatgttggttttaatcaatttgtgatgttctgagctatattgcaatatttgaattatatttccaccgtatttgtcaattttgatttgattttgtaacatcgtgacaatttgggatgccaagtaggaccacccaacgaatcgatcctagagccgccactgcatcgtctcctcgtccgccgccgccgccatgtgggcgctccgccgcgcgggcaaccccctcaggtacctacctacccccgcctcctctctctcccccgccctctgccactgttcttgtgggatttcgttaacagatgattgattggtaataaatctgtggcttatgttagttcgtgtcatccgtgcctttctcccactcgcgtttttctgtccctgttgcgtggtggcgacaagtagatccatccaaatgccttgtttagttcttgggggtttatttgtgtgattttccggtgccaagttgtgtggtgtccccgttaataggccgtagtttcttgttaagattgatcattgggtcttggatgagttgatcattgccagtgatttatttttacaggtggggagtagggagttgctggtattattcatctgatgttgggactctgttttgttgtaatctcttgaatttctatgcaaattgcagtcttaccatcttgggtttgactgaaatatatcagtcggatgtatgtgagagacatgatagtgtatctactgtgtgtatatgtgcttgaagaagtacccatcttagatgtttgtctatgtagacatgattattactttgcgtagcattatgtacggaacgatattagatgtgtttgaagatggaacaacacctcttcttgtttcaatcatctggtcatgttattgtgaaatgaagcagatattttgtatttcgttttgcatgtgaatccatgttcacgatcataatttgtacctatcatcccatgtttcatgcgttgttaatactgatatttggcttggctaactgtttgctgctgttttagggtccgtgcccaccaagctttgagtgcccgtggttgtgcaaaccttgaagtaattctaaatgcagatgcaaagaatgtggaagagcatcatgagggggactgtcagaaattggattgctgtcatcaaccaaagccattggtctgccaaccatcattctcatcaggccgtttcatgtggagtaggggtttctcttctcaggccggtgcaagttctggtgataagcaggatgagttggaggaagggttttctgatctggaggttccaccagaagctcataaaaaggatttagatttgacatccgatgagagttctgatgaggacaccattgatgcaattggcttgtctgaagtggaggctgatgcaaaacctgaggagccgataaagaagtcacaatccactcttcttaaggctttgctggaatctccaagggttgatgtcgctggagcattgaaaaaatggcttaatgatggcaatacattggatagaagtgagctcttttatgtccttcttattcttcggaggcggaagctctacatcaaagccttgcaggtgtttaacttggcctttacgtgttttattttttttcaatgatagcaagtcctttctgtacatttataattattgataatacatgtagcgactgttatgctcgttagcttggcatgtgttaagaatgttactttctgaaacatatttgcaatgtcaatggtgaatgagcttttggttttgcacataaatgaagagttatagccttgtaaaatgtagcatgcactagatgaggtaggggcactttagaatgatatgtctatatgcttcttcttcgagtcctagagtattaaaaaagaggaagtgatgaagtactcttagtcaactatgggaatgatgctagacagctagagggtgaagataagaagcacacacaatttccttgactattgaaaaatacaatgttgttgagatatcaccagttcaccccctgtacttctatgttacatcctaaacttaatttagtatgagaatgttattgtgactttgtagatcatgtgaatggtgtgcaaactgcatcttcttttctatagtatcagactctgaaatttgttagagtgcttgtgttggttttgtttgtcaaagggcgttgtctttttctgttcattccatgcacgttttgagtattactccatttctttgattccctctttatgctgcagcttttattgaccaccattttattttactgttaagcattccaagcatgtttaccccttaacatacatattgtgccatctgtgcttttaaacctttcgttgtaatactcatgtttggttatacatgatgtttgaaatagcgtagccatacttgtttctttttatgtgcaatctaatttgtgacatgatgaaatgaatgctacctttctttgtaaattactagctaaattgtgtgttcaactgtctatactcttatgtacaaaacaaattcttgtttgtaacttagtggaccattgtagctatctaatagatcttagtcatgcagctataactgtcttagataataacaaagccaccttgcttccgaatgcatttgtaccgctgcatggtaaattttcaaaatctcactattctttggttatttgtagctatacacggtgtttactttgatggaacttgttacgtaaacttttttcatgtgaacaacctcatatctaaacacttaagcttttttcactgtaattatttacctcggtctttgtgttttctaactcagaagatatttacttcattttctgcagcttctggagtatgttgaagaatccaaactaattgatcttggagaacgtgattatgcttcacgcgtggatttggtagctaaaacccacagtatttacaaagctgaaaagtacattgagaatgttcctgcatctcataggggtgagattgtatacaggactctttgggctaactgtgtggctatagccaatgtgaaaaaagca

SEQ ID NO: 50501 - DNA, 3457 bp, Oryza sativa
actttaaatcatctatagtcaatgtaatagccaattcatacaatagttgcttactatactattaatacctggtcccacatatcatacacacattacgtcttgaagtccgtgctgcagctggctatagatctgtagcccgctgctcttctctcattttctttatctctttaaaatatgcttatagctatcttataggctgctattgtacctactcttagcaagcaagagagggtacagattgaaggacagtcggccggagcaacggtatttaggctatactcctatgtaaaaaaaaactaatccttagaatgaatctggatatactgttttcctctattttattttaaatgaaatagcatattctcgtgctaattctcttaaaaaaagtttggatatgctataagtttggactcatctttagaattgaattttctttggatggagaaagtatgtgtaaacccttttggttttttagtttttgattgatcatacttagaatatactctacttttatacgcatagttttacgtttttatattatgaaaagtagaatacatttcaaggtaacaactaatcacttctccaatgttcttttccacctataattagctaatagattattgcggacacgcttcataaaccactaaaaaatacaacttttttataaaaagaaaacctttctacataaaagtcactaaaaaattcaaacaaatccatttttaatatttttaatagttaatatttaattaatcatgccttaatcagatttcttctcttgcaagccaatcgttcctattccatccgtctcaaaatataagcatttttagcatagtatcaagttaaacatttttaactctggctattaatagcaaaaaatttaaaaatatcgatcatgtaaaattgacattactagattcatcattaagcaaactatcataatatataacttttttttatttaaaacatcttatttttatagatattattggttaaaataacatcttgaaaaccgtgtccaagtaaaaaatgtttatattttaggactgagtgagtaatgagtacctctaagagcaggtacaatagtaggctataagccaactgcaaacatattttaagaagataaatgaggagagagaagagtagcaggctacatatttgtagccagctgtggcatggactccaagacgcagtgtgtttatgacatgtgggactaggtattaatagtgtagtatgtaactattgtatgaataagctattaaattgactatagataaattaaagctagtagttgactatactattaaacttgctctaataccataccctgtcctgacaaagtgaatgccattggaccaattggactacctctaatagaatctaatattctatgatctctatttggttgattgttgtaataataaaattactgttgtttctgaaagtattatactacaagtagaactaatctgaaccgtttattcttaagggtacaatagtaaagtactaagacagattaggggtaaatttgacatcacggcaacgtcggttacgtcgttgtgttcgatcgtcggtggcggcggcggtggagatcatcttgagggcggagccgccggtggtgaaagccttcttgcggacggccttgtaccccggccacgtgacggcgcggtaggcggcgctccgcccgggcgacacggcgtccgtcaacggcgccaccttgacgtccggcaggcgggccgaggaagtatccgagcgatatcctgtcacggtcgcggttgacgacggcgcggtggtatacgctgtggaagcggccgttggtgagtatgcatgtggaagagaggtcgccgacgttgaggacgaagttgcccggaacgatcgccggcaccgccacccaccggtctagtcctcgccggaatagctacagccctgacacaatgctctggagcataagccggagtcggtgtgtgcgatgagtcccagagctcgccgcaggtccgggcacctctggtaccagtgcatcgtcgccgtcatcgtcttggcgatcctcctctccgcctcaacgccagtgagacctagcgcccaccctgaggaacaactccagcagctcgtcggctagccgccgcatctccttgtggaactcctccatgacgtcaccgcgtatattatacgtgcatcagtacacttatacgtgtacacgtagtagtagacgagcagctcgagagagggtgtgtgcatggcggcgacgggtgtacgtgagaataccagaagaggagccgaggaggtagtcgtcgccggacttgggccagagacggcggagcttttgcttatccaattgcaaatgcgtgccggatcagaacgagagacgagtgagtgtagctaggtttagaaagtgaaaaggacaaatacctctccacaaataatttttctgggacaaaaatatccctccacaattctactaccattaaatgtggtgggagtagaaatagatctgagccgttcaatcatatacaattaacggttcaaattattttctactcctagtagaaagcaccggagtgggactcatgattgtttgggacccgatggctgttccccaaggtccaaaatcattaaaactgatgttaattcgcgggtgcagacatgctccctctcttggtctcaattggtcagccacacagtctcacctgtctcatacctgttcgatttttttttccttttaattcctcatccaacccgtgccaaaattcactactgaattattatacaatattgaagagaaatgatcggtagaaaatgagtaatgttctgagtaaatttcaagagctaagtttagctatgtgatgaagaggcaaactgaaagtctgaaagcaattacatttctgaatcctgaaggtacgaagaactgacggagtgatgcaattgccagaaatgcatgtcgcgatgagcacctctctctctgtctctctgtctctgtctctgcagcatgtgagctctgaatatgcaaatcagagctgcaatttttgggaccatggcgtgcctgattgcttgcctgcttgccgtgttggattcatctcccagccaagaatttcaccaggacaagataacatgactcatcagctagccttgaagaattcacacgtctgctgctctagaattcacagtgtaggtagctgctgcactgtcgactgttcttcggtcatcacacacagcgtcataaaagtataaaacagagattttatgagagtttaccttctttttctttgttttttggcttagcacatcttcattcttcctgcactgatgcagcttcctcttcatcaggttcagaggcagtgatttggtctgatcgtttgaacagggctatgtttttctatcaatatattcagctgcttcacagctcttttgttcccaacatgtactcaaattcagcaccattagttgatccattcagactgattca

SEQ ID NO: 50502 - DNA, 8202 bp, Oryza sativa
ttctaatatattgacgtgcaatccttttgcgcgttcgcgaaaaaagactgattcagtgatgaaaggtcattcagatatcacccatcagtcattcgacagtgagatggagcatggactacaaacttgttgatcatcgtgtttctcatgtaatctgaataaaggatgtttctccctttgtgcatatgtttgcattaatgtctgctcattgagctaatgcatcatacagttgttctttccttttcttttccctcaaatcctgaatctacttcatgtgttaccttgaaactttttggggggggttttggtcctgggcactagtaagcagtagtataatagttttggagcataatagggaatattgtccccaagatcacaggatatgaagttggaatatatgcttgaattagaaaggacaatctaaaatagatgaacaagaaaaaaaaattgcagtgataaaccatagtgttcagtgcagcatagaggatcaacatcatctatttgcctgcactgcaaccgcatagtgctagtcagaattcatgtttttctggagcatgtttgagtatcagagacttcagtcgtaagaaaaaatgtactcctagctcgaacttcagcccaaaaagaagtagcagaaaaatgcaaaaatactatgcatacgatgtttggttacgatatttgtagttcttgcagaaaatgtcctgaaaaaggtcctgtttgattgaaccagcaacgatgcaatctacaataagaaggtggtagatgttaaactcgaaacacaacatcaaaagtagaatccaaaataatcacgacatggtttcagatatatatatatatactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgatttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttatttttttaccgcgtcacatataattcctttttctttatcggaaagttttttttcgcctttttttaccgcgtcgatggagtcagattcttttcagctttttccttttcttttattggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttctccacgatacatataattcatttttctttggaataggacagttttctttttatttttttaaactctttttaccgcatcgatgtagtcggattcgtttcggtattttttccttttttttccttttttttgtcggacatatttgttttttttccgcccggtttttttcgccaggttttttttatcagacttttctttttttttcgctcggtttttttctcccgttttttgacagacgacagaagcacatagagaagtgtttttttttcttttctccaatccaatacagatcggatctcttccagggaaatcagattttttttctccaggatcggactctttttttttcgctttttttattcattaaacggtttgtctctcggacttttttttccctttttaagggatcgggtgtttttttgccagggacgggtgtttttttcgcccggttttttttttcactttttttttggatcggacttttttttcgtccggttttttttatcggacaaacttggttttttctgcccggttttttttcacccggtttttttgacggacgatggaagcacctcttattttttaaaagtagtagtagaagtagaagtagatatacacactccctccttcccgttttatttgacgccgcaagtcaaaaaaattagtgtcacaatgtttgacgccgtaagccaaatcaattgaagcattccgtctttgcccttgtcctccaacaccgtgatgccgctgccgcgccagtgggaggcggcagggcgaactgatgccactgccgcgccaggagatcgagcatggagctgggatgcgcttccctacggctgcatccacaactccctcatgccgtcccccccgctactgcttgctatcgaagaggtgatgatgtcgctgctcgccgacgatggcctcgtcctctgcctcggtgccgtaagccatcgccggcggcggcggcggcatggcggacgtcgaggccggtgcccgacgacgaacaccatatggtgcttgtgtagaattcgatatgcacgagagaggtaagcaactcagattgagtgttaattctattgatgaatttgtgtttgaggaatcaaaagaatcgatttctgagccgtaattggaattcaatccttggttgcagttgtggatttcgatttctgagccgtaattggaatacagtcattggttgtagttgtgggttttttatctctaccctgccaatggtttatggttcacattttcatgtgaggaccgacttttttcaagattaggagaagctgatttctgaatatttcagaccagcacccagcagcatcaagttcagatcagaacgcagcaacagcagcacgagcaccatttcagaccagcaacaacagcaatgctgtgggttcctgctcttgtgtggcggcgacggcgtggggagacgacatgcaagacaaaatcgagacgacgagctggaggcctcgtgcggcatcaaggcggcgaggcagacggccgcctcgtcgccgagccggcggagacagcagtatgtacgagacatgaacaaataagggcaaaatcgtaacttcattgcttccttaatcctgtcgaactggtcggaaacgtcaaataaaacaggaaggagggagtatatttttgcaactgaagtcctgaattcagaagaaaaactggcaagatggactctctaatacagaagtatatactgaatttattaagattctgatgccgcaacatattcttgaatgtctgcagagtaaagttgatgtgtccaacagtccaagctgtgttttgagtataaaactacgtttggatgccatgtctttggctctgaaataaacaaaagagcaagagagacaacattctttcaaaagttcagattggtcttagctgatactacggatgatggctgggttcagaatgggccatgttctgttttttcgatgggccggccaaggaatgctgagaaacgtcagggcaacaattaaggcccttttcagaagagctaattgagtttagctactcctcgttttctatttgtatgttttttaaaaccactaagactgtatatttcatatgaaaactttctatatagatgatttaaaaaataaaataaattcatttttaaatttttaataattaatattaatcatatgctaatcatgtttctcgttttgcgtgcaaatcatatgtcgaaaataacgtatcctaagtatttatttttttttcagaatatttatccgattattgaaacggattatttgctccacacttcacaaaagacatttctttcagaaaactttcttctattctgttacttggaccaattgttttaagctattcttttagtttatttatcaaaatatttaatttatccttatagtcaagtagattatccacaacaacaatccataaaaaaatttgtttcaaacttggccttaagtttgttgaagcaccatcctcaggctgtgtctgttcccttgtgttgggaactaatttccttcacacagaaaacgagataccttattagcgcatgattaactaagcattagcttgaaaaacttgaaaaatgaattgatatgatttttaaaacaactttaatatagaaacttttaaaaaaatcctaggcaacaacggaaaatcattgagagcgtcaaagggttgcttggtaatacaggatatctccagaatctgtggggtttcagtgatggggatatatggaatttgcatcactgaagaggaagagcacacgctatggttgtaatttattcaggtttgaaggcaatggtgagttttctctttgggcttgttcagattgatgtcatttcaaatcataccttttttttggtaaagttgccaaatatgtgcatccatttagtttcttaccaaactctagtaaaaaaaagaaatcctgccaaaacttggcaatattgctaaattgataaaaatttggcaataccaaaaattggtaaggtttattttggctacaatctgaacaaacccaaagtatcataggatcagtctatggcaccgtgtacgtgaaaaaatgaggaagtgaagttagaaatgttatccaaagaacacagcctaataaccagtctacactatgacgcacaaggaaaaacacccaagggatgatctgagcatttcgttcctttcaaagtagccgtatttggcaattgacacatttgcagctgaagaagaagagatgaatggcagattctttgtttgagatagattatcgattggattatcaacttcattatagggataagttaaatgatttaaaaaataaaattaagtttaaccaatgcaacaaaagaatgttcttttatgagaactatctgtagagacgtagagtaaataatctgtgacaaacaatacacattcagaaaagtatagttcaatggacatggccaaagaagaatatcttgtagctaggccgctgaagttgaacatagcccatccaccaaagatgaccagcagatttcaccaggacccctcaattgcagttgtaccccggacgattttattgccatgttcagaggattcttggtccgctcatctacatcaaagatatgatagaatatttttcaaccatttaataaattcttaaaaattaactcggccaactttccacgtatagcagtattgagtgtatatgtattgactattggtcactaccttcgtgtttactatttggagttctgcctataatatattcatgtttaggcgggagtcatgaatatagttgtaatgtaaataaatacatcgtttttatattaaccgataacccaaatgtaatatatcctacaataatagattacaatatataagcttctttaaaatctagggaacattaaaaaaaacacttaggaacattcatgcattataaaatcatgtacttccttcatttcatattataagatttcttatatatatatctagattcattaacatatatataaatgtgagcaatgctaggaagtcttataatatgaaatagaggaagtagatttcaaaacgctagagtactatagttgatatgtctatatggttcaaagcaaataaatataaacaattctctactctaattgcgattatggatttggtttattacttatattttctcggatgagtgtgacattgcctttgactatttttctagctatggtatgccatgttcaatatctataattgcatatattgcataaatggaaaacccacgggtactcaaacggcatgtgcatgtgttctatttacagttgataagtgtattgtgtataggccaaacaagtaattttaggtctcaaattaagcatattcttgctccgcagaggttgatccaattcatcgccaacatcagatatggttcaaatcatagctaccaacacccaacagataccccatttccatattaagtgcatcaatattacttatagccattggatagttatcataaggtagcaactgtttaagttagatttattatttatttaagttattttcactttggaacactttcaatcccgttttggacaactctttaattaatattttcattctagaccaaacaattttacatgatgacactttgaccaccctcaacacttttatctatctatatgttcttttaatacatcaaagaaatattctagatatagttatgggagtttagagacgaataactgacgtaatcaaaatcatttatatgcttgataagagcattggtgtggttaaaagaaaagcaagattagccggctaaaaacttaagttagaccaaaataaaattacgagttgtcagtgctgtgcctatatgtgcacgcgtgctattatcttaaaaagaaatgtgcacgcgtgtgggagccattttaatcattttaataaggaaaaaaaaaggagagaagaaagtaacaatcccgctattattacgtcatatttccgcccaaccatgagcccatttcattttcctcctcctcgcctcggtctcctctcctctcctctcccaaatcgaagccgcctcctcctccgcctccgccgccctcctcgccgccgcgtggatccatctcatcccctcgccgccgaaaccctagacccgcgcttccatggtggtatgaccggttggcctcgcgattggggggtgggaagcggtgcggtggtggtggtggttagggtagcagaggcattcggcgggcgatcgccgtgaagcgggtgtgtgtgggggccagcggtggcgccgggcatggcggcagcggcgaattcctcggcctccgcggcgggggccggcggcggctccgcggcggcggccgggctcaagacctacttcaagacccccgaggggaggtacaagctgcagtacgagaagacgcactccgccgccgtgcttcactacaaccacggcgggaagaccgtctcgcaggtgagctcgctcgtctccgggaggggatctagattggggtggcgtcggactcgcgtcgagggtttccgcggtttttgcagtgtgttagtgggatctcgattggcttcgaggcgggttctagaggaacatttttttaggtagtccaagtttttaggtcgctggtgcagattttagatggcgctaatttatttcatgaacaacttacgtcgctgctagccttatagagatcttattcgttagattttagcgattcgttgagttgataaggttgcaagttcaatcggtagatctctctcgatcatgtggtagtagtgtctcagcttgtgtaatgcttagttgtgctgtgtggcctatatgtgttattcctgaaaatagtttttgtggcgttgtaagtgctgttgttgatggttctagttattgcagttgacggtagcgggtatctcaaggagaagcctgccggacagggctccacgccttccacgccaagctccagcagcgggatgcgttctgcagcagcgaggcttcttggctctgggaatggtaaccggacgcttagctttgttgggggaaatggtgtaagccgggctgtgtctgggagcagccgcattgggggtggccttggtacatccggaggcattggtagttcacaagctgtggcaaattacgatggcaagggtacatacatcattttcaacaccg

SEQ ID NO: 50503 - DNA, 7878 bp, Oryza sativa
  unsure (1)..(7878): unsure at all n locations
catccggtcctaggttcttatattttgggatggagggagtagatttgtatcaccattgcctgttaaatattttggctgcatgtttccctcccttcctgcagtgaaaaccaagtggcatctttgaatatacatggtcaaactttaactttggtcatcaaaattgtcatgaacattaagataagatgtggaaataacattgggaggtcttcctggaagaccaaaatatttgtacatcctgtagtatatgcgctatgataaaaactggtagtgttgtgtttggggaactgtgttgatgtccaaaacgtaacttatctttaattgttgaggttttgacagtttagcacataagacttttttttgggggtcaagttggcataaatgcaagtacaacacataaatactcatgctcatgtgatatagacgtacattgctttgaagtatcagatggacagcaaaatttgaaaggtagcaaatttatttgcggtcagaaggactcccaaatcattctaaagaagtaccatagagttcttatttgggacattggaataaatcattgcgatgctttgaatctaatgctgagctgattctttcagttgatcaatctatggtagtaacgagcttttgttatttaaatctgctctctgttagttcgtgtgctatcaattctgagctctctctcctgtacgaagccaacatattatggagaaagaaggataaccttatttcattttgttattgccatctgctgttgcatggcacctgtttacatgctatcaattcatagaagcgataaataaaggaaagtaaatcttgcattgctgatgaacttttcttctcttagtctaagaacaatatcattatattttaagtcattaatcgataggatggaactgctacatattaatgattttgtaatacagctacatggatcattgtatgggcagttgtcatcaagatgcctaacttcttcttgttatttaattaacctctagacactattgttcaaaacagaatgctgtttacatagtcatccttgcagatgcttatctttctcttattagtgaattgaattctctaattagggaattgaattctctaattaacttgtgggtactacctttttttggcagccgatgcacttctgttgcatgggtaccggagcgtgaaggaatctttgttgttagccattctgatggaaatctgtatgtgtacgataaagtgagcagatgttggttatcggatttggtattttaaaatctggtttctgtttggtggatgattgaactgatgtatattgatgtactatttatattcagtgcaaagatggaaacactgagtgtacattcccagctataaaggatccggctcagttaatgatttcacatgcaaagtccagcaaggtatgttaagcacttcaagaattattttagttaagtatgctttagtatagaggtatattcccccctttgttaacatggatgtctacagggtagtctagtattctgaaccttgaacatatttcttaaatcaatgaacatacttatttatcgcgccatgtagagcatggaaatagcattgcaaacagtgataactaccaagttctgcacctatattcatgcttaagtgcacttatagaaatgtttaatagtcctttaaaaatgatggtttttgctcatgctcgcttttgatagtttgattatgcagtaattaaatttttaatagaaaaggctatcatggcagttggttccaacaattatgcacttgttctggcctccagttatgtacaatgctaagtttcgtgactggtattttacaacaagaactttactggcaaatgccaaccacccgatagtatattccaaatagcgtacatcatataaagtgaatgttggcaagtaactccattatcctatattttctactatcttagaaatatgtttttttgttgcaaaacatgtggttagaggagttcgtatgaaggtgccataattaactttggattcatctcaaaatcatttcagagcaacccaattgctagatggcatgtttgccaaggttcaatcaacgccatctccttttcaccagatggagcatatttagcaactgttgggcgagatggtacttcctttgtcccaatagtagatggttctttattccttatagaacccactgattctgtattgcttattaaaataacactataaaaccttatttaggttatttgagagtgtttgacttttcgaaggagcaactaatatttggtgggaaaagttattatggtgcactattgtgttgcacatggaggtaattggaatctccacttttacatttgccctatctttgctagttagttctatgatttatctattcccactgtttggtgtcctgtcccaaaatatagcattttttagaggatgacacatgtattaaggataggggtagaaagacttgtttgccttctcaggatgggtgaggtataggcctggtcgcctggactacaatagagacaaggatagtaggggtagtatgggtagtttagtggcaaaagttaccttttacatgtcctaggttgctacatttgggacaaaatgaactcaaaaacttgctacattttgagaccgaagagctttatgaggcaatcctgaaacgtgtttctgctagttttagttttttaactctacacccagctttggatgaacagcatgccaaacttaataattctgctgatttatgagccattccggaaaaaaatgtttctgtttgtaagtttaggttgaatagcatgccaaccttaactaattttgccggttgcctgcctttctgccaagctgcttgttacatgtgaggaacttttttggtttgcataacattacggtgtactatgcctattcccctgtatttggggtaacaaattaacaacacagtttttggcgccactagtttctagcacggcacacgttgaggcacatctctggcctggtctctaccatgtcatcaggtttctgctccggggcattttatctgctaattgtttatcactagtttatgcgactttgaattatcagcaactatttgtgtttaccactggattatcttccacaaattagttcctcttaccttattttatcatggtctgtttttacagctcggatggcaaatatctgttgactggtggtgaagatgatcttgtgcaggtatggagcatggatgacagaaagatagtcgcgtggggcgaagggcataattcctgggtacaacttaacttgcctaaaaaattgtcaatgccacgatgtttcctgtcaatagttgtaattgaggacaaggtcaattttatgttgacaggtcagtggagtttcttttgattcgtattggtctcctccgaattctgatggaacaggagaaaataccgtgtatcgttttggttctgttggtcaggtatcacaaatttatatagctggagatatagtatgcagtctgtgcttttatgacatgtccttaatgtttaactcatgtagtatcaaagtttctttttgagaagtgtagtaatcaatgttaataagcaatcataagatgcttatttctccgtccactcttatgctgttgtttggctttaaactgatcaaactatgtatgtagcaggatgtgctaacttcttatcatactcgtgctattttctcgctgtacaatctatgacaatgttttctgtttatgttaatcaacttggttagttattaatatcgattcttgctcatatggttagttatagtgatgagattcatttgggcaagttatttggcaattctttttacatgttctatcgctggcataacttttcactgtttcatgctcctaggacacacaactgcttctgtgggacctggcattggatgagattgctgtcccactacgacatccttccagtggctcaccaacttttagtagcggcagcccttctgcacattgggacaatgcatgtctcccaacaggtgttcttcaaccttctccaagaatgcgagatgtgccaaagctctcaccccttgttgcccaccgagtacatgtggatccactctcaggtctggtgttcactaacgaatcaattctcactatttgtcgtgagggactgatcaaaatctgggtaagacctgatcagaacgaaaacaatcatcagtcaaactcttcggagttagttttaggtaaccctgtttcaaaggatagggtgatcacaacttcaaataaagcaaccggttccagcttcaagcaatcttcagctgttgtcttcacatgacaaaagtgttctggtgggcacattgctctggtaatctggttaattgatcatcggtggtcatgtttcttactaacaccgtgattttgggaagggggtgggaggaactcttgctggtgatggagccgctcattttgcgtggccagatatgccagtgttgccatttgtgtggctcaatggaataatggggtattctcctgtacagagatacatatagtccaagataaaatgtacaatttcaccgtatgtgtttcgtacttttcagcgagccgactagtgatgggaggataatggatgccacttacctggtggtgttttcttgtgttttattagtatctaaaaagtctgtaaattatttattcatattattgttacagagcccttctaattatcgcctggtgtgaactgtgaactgctctctctctctctctctttgatctgtaaacaatgtagtatcttcaaataaagcaagcggttcaagcaatcatcatctgttccttggagcaaaatattttggcaataggtacctggctttcgctcgtcattttttatttttcttgcactgagacttatgtggcggaatatgaatgggaagttgctgttgttggaatcgctcatttgtatgctgatatgttcggaaggcgctctcctctgctgctactccggagaaaagcggccgggcaagcagacatctcagttctctcctttcgttagttctgggaagatgattatgcggtcttgctctgggctcatctcttatttctccttccttggttgttcttggttggtttgtgcgcttcgtttcttgattggaaagtgggagagagaagaaagatcgcacctttgtgtcactttttgattgtgcaaagaaaaattctctttttggctggtcatgtgacatgttgggcttgtggcaattggaaaggcagaagaatgtcgtgtgcttgcgagttgtatctctccgagtacaatcaaatgaatgtttctgacggaggattatatttgggaatgacgtccctttttcacacatttctgtcagtcagtcctgttcagatgaaactgggtggtactgtagtagatgtgcacattcgggaatgataggatctgaatttgggaaactatttataaatttgaacactgttcgacaatttaaaaatcgtagttgcccactttaagagtcaaatttagacgcatttccagactatgtatcgttttgggcctgggttttcaggttgggtaagtaaaataacatgatntcnnnngnccccccacccaccccccctcccccaaaaaaaaaaaaaaagaacagatgcatctgcatggaggatgtgttctaatagtgcatcagccacaggggaaattgtctttcctggatcagcatggaaacgacaggaagtgcaggttgcacatacctgctcctggtggaagcatgaacactactaatctgagttcttctaaattaagatggttttttagacaggttctgtaatgtttggtttacttgatttattgtcggtgttaattagcaaatagttgcaggttcatcagtggccactccagatacctattcagtccatatctcctcagaaacccacaggattgaggcccggttggcatctgatgaagctttagctaggcaattgcaagaggagaatgcgcatgatgtgatcgctacaagagaatttgctatggtgtaacaaacaagcttgcaaggtttcccaacctgtacaatataatctcaactgcatatggcagcagtcaaattatcctccgatatcaatagttggcgttctaataccatatcagtgttccccgcaaaataaaaataaaaataaaatatcagtgttattaatttttttgtacatttaaacccagacacattttgttaagaaagcagttgggcgaaccatgaattgataggactcacatgtaagaatttattgttcttctcgcttattgaatcttttccacaaatgacttgagcgattctcaacgtttacaagttctgtaaaatcatgtattttatacacaatactagtaactccgtacgtgccgcgcgtccacttctagtttacattagtcttatacaatcactgatacatgtataaatcctggtaaaaagatagataaaacaaattgtacaaaaggagacggcgacgcaccccatcgtctagtgattttaaggtccgggtgtttaagtctctgtttactgcgagctccatatataatgcaattaagatttgattaattatctgttgctggcattctgagcagcagcagcgcattggcatatactcctaaatttttagcagcagcaagccaattaattatccggccacgtaatgaaattctctcaagtggggacacgttacgcctatgcatgccactgaacgtgttgcaaatacatgaaaacggaacaaaattaaaaggggatttcacgtacaaacttggacaaaatgacactgttaaagattgtactaattaaataggtgaacacaccccaaactaccagcttatccgttcacacagcataaaagtagaccacaacatgaaatagctccttcaaccaatgtcgagaaacgacagaatcctctccaggaaccatagcatatttagaagaaagcaaaatggtagctgggcaggaagatgtactataagtaggatcgatgaagttgacagatgtgattcattccatattgttcctcgtcctgcaatacataaatcgtgaatttccttgcatacaatatctgaaatgtccaccaacacaaatgatttagatggatggtgttccaattaaacttgcgtccattagcaagataaggctagcatgcaaagatgctttgtaaactactccagttgtgctataattaattttagaaagaattggcaaaaacagccactacttaagaaataagcatacttcacttacaaatgctaaaagtttccaacaatatactccatccgtccctaaatatttgaccccgttgactttttagcacatatttaaccataaatcttattcaaaaaacttttgtgaaatatgtaaaactaatatgtacaaataaaagtatatttaacaataaatcaaatgataggaaaaaattaataattacttaaattttttgaataagacgaacactcaaacatgttttaaaaagtcaatggcgtcaaatatttaggtacggagggagtatatttaaatatttatgtttaaatgtttggaggaagaggctactgacaggaggctaacaattgcaggtacgcagcaatcaacatgcatataagtaggatatggatacataaaaactagcaatatatatacccttgagaaagtgatgaacttggagaagtcagatgggaggaaagactgcggaaagcgcgactttgcacgggtcaggccagcgtcctcagtttgaaggtcctccttcccattgatatacagagaagatgactccacgatcttggtgttcatgtcaatggcgacgacccacatcttcttgatgacataccgtaattcaggggcaaggaagtgcactatatgtggcctgtcaatgtccacttgagggaacatagtaaggtgcgtgggaggcagtcaa

SEQ ID NO: 50504 - DNA, 2502 bp, Oryza sativa
cacgagctacggcagctacctccctaccgcgagcagcggcagcgacggcggcgtcctcccccgtcgtgagcggccaggatggtgccctcctccattgctagcggcggcggcggcgaccggcgatctcgcggcggaggcggggcggcggctacttgccctaccgcgagcaacggcggcgacggcagcgatagcgatggctacctccctaccgcgatccccatcttcctcagcggcggccggtgatctcgcgactgacgcggggcagcggctaccttcctcatcacgagcagcggtggcgatggcgacgccctcccccatcgtgtgcggccacggcggtgccctctcccaccgctagcgacggcgacgacggccttctccaccgcgagcggccgcggcggcgtcctccgatgggtagatccggtggcagcggtgtcctgcgggtcggcggagcggcctcgacgacggcgcgtctcgaggcgctggcgctcgcctctcctccccatcttccttcgccaccaccgcccatcctctcgtcggatgacgagcttgtcgccatcgtcaaaacgataaatcgaggttgctttgtgattaatttgcttgattccattgatttcaaactttctatcccgttgatcatcccagctgattttattgagttcgattctgagtctgttggtttaatttgtagatgattttgtatcaaactcttgttttttttttctttggccattgtactgacctaactgcgctaggtcggattgacggacccaaaaatactgtgatgattggaaaaatacaaatatttatattagttatagatatactattgcgcgttgtaacagatgaagacaacttttataattgataaaaactcccaccaatttaaacgataaatgtcaaaactagattttggctaatctaaagtgggtagcgaacaagcagaaaagtggatgggttatgatacaaggaaatttttacaggttcaggcattctcgataagaaataataccctactcatgtctggggaaatattccgccgattgtgttatcgatctgatgatcttatgtgtgattatgccccaagaggcatctaacccttctttagatagtctgaagagctagcattacaatgcaagactatcccttacggttcagagtcctgttaatgccaaaatttggtaagccccgaagtcatcatcggcccagagtcagtatcggcttcagagttatggaatcggccgatgggatttgtcaagtcgccagcagtcggattcttgatatatccagttaagaaaatttatctagaagagaccaagttcaaggaggatgcggcatgacagtttatctattaattaggaagagtctgttagtttccttctatctttagaaaagtgtgtttagtatccgataaaaactttatgttttctttttaactttaggaaagtttttcttgtccaagaaggactagtgtctacccatgggtactttaggaaagtttttcttgtccaagaaggactagtgtttacccatgggtataaatatgtacacccggagttattgtaaactatctctatagatcaataaaattcggcgcatctccaccctttttacttttctactttttcgacaagttcctgcttcaagttagggcattggctttgatctccgacgatgagtaaaacttgctatggttgtttacatcggcagagctagggctttgacactttgatcttgtcaatgtatgcacctatttatcatatatcttagtttatctagtttagcatcttaatttgatcatatcggatgagattcgttttagggtttatgctggtatcggctaaattatcttgctagattagattaaataaggtatccaccaccctaaaaaccagttaaaggcttgattgtctacataatatgtttcttttcatactttgcactgcatcagccttagtcgtgcttagaaccataatctctagcatgctttttgattttcaataagggtttcatcggggtttcagccgatgagttatctggacgttgcatcggcttataaggattatatacaagatggatttagccgattgtgacaaagatttcattgtttatctaatcgtttggatttcatgacatcggtcctccagccgatgtatgctttaaccttcggatcattgtttattctatcatattattattagttgattgatttctactggattatattgttatttatcatcatcagtcgattgtctttatatcattatctatattggatatataaccgatagctcaaaacactattgatatcggttggcatcagcatggactgaactactccatcggctccttgctgctcctcgttgacctcctccccggcctcctgaacttgttctctaagttcctcttcctcctccttaacctcttcctcctcaatctcctcttcttcctcctccacaacctcttcctcctcaatatcctcctcttcctcaacttcttcctcct

SEQ ID NO: 50505 - DNA, 29050 bp, Oryza sativa
  unsure (1)..(29050): unsure at all n locations
ccccatcctccagtacgaccgctgccaccatgcccgaagcgctcttccgcacagtacgacgaacacggggtgctcagcgaaatgtcccgtccgtctcctcacctgcaatgcatcatgaaggtgtgtatctgccgactatcgttgtttcgtcgaactattatgaatgatctttaggtgataaaatattgattgaattgtctactgctatcgctcagaatccatactccagcaatcttacatatatacatatttgttgcgtcaatcctaagcatgcttttcatatatccctgaacaattcagcctcacaactgctcttcatgtatctcattcagaattttttttctcaaattagttggactgatagcaaaatattgcttttcaagattgtaaaataaccaactagcatggacgttcataaatttttcccttctgtttggtgttattttatcagacatatataatgaaggcgtatatagcaaagggaggagctgttgagggaaaggacaatagctcaattttttttttttttgcggggaagacaatagctcaattgactgggaagttgatgtcaaatgtcgggagcaatctgctaaaatgttaaagaggtgcatgagtgaactggaaatatctatcttgtttttgattagtagtttctttggtttcaaagtaactcttgacatgagaattttattagcagaggaatgggacacattcttggaaaaatatatttcaccattgaaagggtcaattaggcctagagggggggtgaataggctaatttaacaaactaaacaaatgcggaagcaggaattttcgaaactttcgaaaataggcagaacagttgaacaatgcagtaaaagtctagatctagagggctaccacaagtaaatcaaggaacatacaacaactagacctatagcggctcaagcaaataaatctagaggatgggaaggaggaatatcacccaaaatgaagctcacgaagtttttaccggagttcaaatccttgagggattctactctccgttgaggagctcaaaaagagccgggtcttagctaactctttcctcaagaggttgcacaaagcactcctctttccactaaggggtatctctttccttgcggaggcgagatccggccttcacaaacttcccacggccaaccacaagtagatcggtggctcgggagtgacacctagctgtctaggagtcctcaatctccaagagtaaaagatgatgcgaagaactcttggagatgatgcaagtgctcacaaatcttcacgaaaaccacaagaagcattcacacaaactcgaatccacactcacacacacgccaaatccgaatcaaacccgggtggagagaggaatcgagaaagcaaggctcaaatgagtagagagagaagcaagccaagggctcaaataattgcaatgtcaccagcaacacttacaagaggggggatgggggctatttatagccacagcctcatatctgcccgttggtgcataataattgcgattttcagaacttctgaaaatcattttcggaacttccaaaaatttccagatctgaaaactcgaagtcaacgcacctttttggaacttccgaaaaatattttcagatatttccgaaaaatatccagaacccaaaacaaccttttgcaaattttcggaactttcgaaaattattttcggaaacttccaaaaatatccagaagtgaaattttagttatgtgaatttttggaacttccgaaaatccttttcgaaatttccgaaaatttccagaacacacggccaaggagaaaatgcttccaaaaattgattgtgagcacacacatcactccttatatgtctatgtctatgcatcatcccccttaatagtacgacattcctaagacgtaaagaaagtaagatatacaatataccatttgctcatgccataaattcatcgtgatgtcacattcaaaggggtatgcatcgcattacaacacatcgaggacgtaacatccttcacatttgctttcatgaaaattgttagtcatctctaatcgtattgtaatcaatcatcaaaacaattaggggcctagatgcactttcaatctccccctttttagtaattggtgacaatacaattagatcacaagagagaatgaatataatagattgatttggtgcaaaggtttagtgaaagctccccctaaaagtgtgcattaaggcaagtggagagctccccctaaatctttgcatccacattgaagctcaaaaagatatgaatcaattcatagtacattcatcacatttcatatctcattcatgacaagcacaattataaagggaataagaacattgcaagatcataatataaagcatataagtcattacatcccaatcatccataataaagcattaaagtctcacaatagtaatagctattacacaaatgacttaaaatcacacatagtctcatacactgaaacaccaacaatgttcgaccacaagctaaaatgaaaaagagatagatattctccccctttggcatcgaagcaccaaaaagagaggatgaagcgaagatggctcacacgaacggggcctgaggtggatcctcgggaggtggaggaggagggtagccatggccaaacccaccaaagaagtcgtactccggaggaagatcaacaaagggatcctcgatgtcatcctcaggcccatcgggctcagcctcatagcctggtggggacggtggagcacccaactgaaaccgagagtagaggtgcgcctgtgtttgctttgctcgccgggatgccttcttgattttgtttcgcgccctgcgattctgtttggcctctgcagagcaaagaccgaacaaacttcgcaagatgcgaaacaaagccgaaggctagcgatgagccacaggagagggttgcgcacgctcaggaggaggctgagtggaggaagacgggatgtcccgagtaggcggccaaaaggatgaggtgggtatgtcaggagccgcagagcaagccttgggcactcgcagagtgagataggaatgggactcctcacaaataaactgggtttgagtgacatgctcgatcatccgcatcaggtgaggggcaaaaggaagcgccctcctgtactgaatcgaggccatgcggatctcctccaacacaaagttgtaagcatgaaagggattgccagtaggattaaacccgaggagcacattacgagagtgatggttgatgttgctagcattaccatctttgggagtgagggtccttctcaggatacggttgaggtagacatggaaaggcttgaaaccctcagttgtgcccaacttgccgccatcaagatacaggggatgccgctcatgatgcataggaatggaatagtcatggaggttagcaaagtacctcatccagttttcatcaaaaccccaaagagtggcaagagcctcataggtaatggagtaccactccccctgagtcatccaatgtatgccccgccggctgtcaaagaaaacggtggcataaaattgggcaataacctccttgcaccaaggttgatggagggtcataaaattgtggacacacatctcctcacacatggcaatcatagagttgagggtggggtcatcatgtgcctacaagtcctcccaattgatccattgcataggaacaatgggatcggttatgggaaagataacggtttcatagaaatcttgctgaaaagagtccagaacctgttatcggtagcagagcaacgaagaggtcgaggatcctcattcctctgaggtgccacaacctcagacttttggtgcgagtcacggggaactcggcgaggatcgcacgaggttgccgggtggagccctcaccggcttgagtagaccgccgaggagggagggtggaaccccgaggtacttgcgtcacttggggaccggtccccgcgtacccttccccagaccattcactgtccgagccctccgaggaggatggggaaggagtgggggaacgatcctgaaggcgcttgcccctgcgcgagatggacttgcgaggtggcatcctataaacaagaaagggaatggacacaagtaagaggaagccaaagatatgatgtacaagcaaatggatgcaagaattaggcgaaaccaaggttggagggctcaggcagggattttcagaacttttgaaaataattccgaaaattttcggaaacttccgaaaattcctggccgaaccctaaaactcagatcctgtacaaatccaccaaccaaaacttgtgaaactgaatctgcaagtcctagggcactagaggaacatctccaccgaagggaatcgcaagatttaactcgaggaatcactagatttgatttgaagaaatacctcaagaacgcgaagaacgagtgaagaacgcggtgaagatcaacgatgtaagtgcccacaaggtccccaaacgtgctcccacgaggatgaagtggaggagagcgtcggagagtcggcggagagaaggtggtcgccggggaggagtggatgggggagaggaacccgtggggaaaaggatagcaaagagagagaagaagagtccatgggttggaggagagttttatacccccgagaattttcggaagtttccgaaaattttcggatttacagaaccactgagcacgcttctggatattttcggaagttccgaattttttttcggaagtttccgaaaatatacagaaacacagggattgtttgtactaaggcagtaaattttcccctgcgagattatttacagcacagtgattgcgtgtgttcttttattttctggtttcctgctttacttgaaaaccctataaaccccattgaaattgataggttgtaattttctgtgtgttgcaggttttattttttgacatagttcagctaaaattttggattcttgcatgaggtaggtctaaggttactgccatcatggaattttgagtaaaacgctatttttttttcctaggaaatcatttggaagacatgcataacaattgtcctcttttttttttttgtgacttcatgctttacttgaaagccctatgaatgccattgcctctttctactatcatatctttcgattatatatcaacctaatgaagtgccggttagttatttgatgttaacatgatgtgtgggtccagctttcgtttcctttttaggagatggattatcaacctgtcgcatattacaccgttttgcttcaacatgtcaatttttaacttaagaagttaatttcccttttatattgtgtagacagtgcatggctggccaaaaaaaaatcaactaatcatatgcaaaactatgagtatccatgcaactctgatgatctaaattttgttctgcacataccatgcaaaaataatcggaattgctagaaatatggcgccatatttctttccagtttacagtcgatttttcactgtgcaattagttcagagattcgtgcatgttcgagactctaatgccatcgtaactactattgctgatactaatctcaaatctctaattgttacggagtaaaaaccaagattccatgcacagatggcaggcaaaaggacaagaagggcctcatcattcggcatattggtggaataagccaaacggcatatttgcaaacgaaaattaatttgtaaataaaacttttacatatgtgttcttagcgatctaaaagcaaaggctgaaaataaactttaatgaaaaaaccccaaaatcagcttcaaatttaacgttgaaaattcaaacttaggctgattagcatatgaatatgccaaacgatgggaaccaaaaaggagaagccagggaagatagggagctcaccgtcaatgtttgtttttaattacactgcagttatatatataattagagtgtaattgtactatagttacacgtgtaattcctatgtaactatagtagttacacctcacttatataccacttacatatgtaattagtatgtaattttaggatttacatatgtaattttaggaattacattataaatacactaaaattacatatgtaatttagggacttacaatgtaaatacacgccgactatttttcggtgaaaaatatggcgccataaatatagctactcccaaaataataacccatagctcatgaacgaacagtacatgaccgttacaataaggtgctttaacacgtcataagcagaagttgctgggatgctagataatattgtcctcttttaaacatagcatgggaattatagtagaatcaagatgctttcctttgcttggtaaaaatattttggactgcatttcagaactcagaccatcatctatttcagtgtaattacattattctgcagaaagacacaaaactatcatggaatagatagttctatatttataaggcatgtagttcttaattcttttaatcaagccaagtgctattttgtgtggtccatggatctttgcgttacctgtaaaactgtggtttatatatttctttgggagctggattctcttggtaatataattgactggtagtaatacacatcctgtaaacaaattaatttttcctctttgtttcttttttttaccgtgccatcttcttccttagggtaacagaaagctcctaataacattgctagcaatccctactctataaagtaagcttttttttttttgcggggaacatagatgcattactcagctatagtcattacaaaccaagtgcgaaataaaattacaagaatcatctggccaaaaggccgttaagggattctcgacgacctctgctagctagagcacgactgacgctngtctgattacgaatgattttcggcagtacaacctctctgttcctgaacaagagacacttaatctctcttattataaactcaaattcagatctccctttttcccataagtatccttatgggtcactgcattggacaacatatcactgacaacataaacaaattcaatagtatagtgatgtgtaattcgcgtgccttctctgtgtctataatatgccaatttttctattgcttacacccgtttcttattatgttacgggaagttggtgatttttgagaactggaggaagatcgtggattttgattgtaaaagcataaaaaacagccaccactaagatttaccagtcctaagtgcctgactttgcctgtaacaataatgttaggaagatattattttgaaacaatattgttgtttctggtatgttgctgctgccgccttgctcttgacgatttgctgtggatttacttctgctctgcgctgacatcctgctgatgtatgtgctgccatgtactactgctatggccagagaatagaagaatacagagggaacaaggaagaggaggaaagcattagagttctttggtgctcatgaactgctcgatgaaatgtcttgaggtactactaaaatccgagtacgtttctgtgaattatcgttttagtgggtctatatgcagaaacctccttccttggatttgttattatgtttccagtggaaagtaatttagatttaacaaatatttcagtgaatcattcaagtcaatcaactaaatcaataagaacatgcttagtttattcccattaagaggttgtatagaaagtaaaaaaaagcagaacagaagtttggtgcttgtatttacacgatttggtttttattgtgctttatgcaagtctctgaacttattttgcctgtggacatattacaggggctcatcacaagtatctatacgatctcttctattgattcacatgtgatgatttagtacctttctcaggattgcacacacatgagctctatgccaggttagtcaaggttgttaggtttgttaagactatccggaatgcatagtcatacttattataacttctctcactctgcatgaggaatgagcttctatataatcactgattggtgctgctcgcattgttataaacaacattttagtttgttgggatgggaattgagagaccctgtttccaaatgtttttttatggggtcaacaacaagcctgctataataacagcctggtgatacgccaatgttttgtttaggattattttagcaggatgcttactaggcaggcatgattcaggtagtgcacttttatgtagtgcagtatggatgtttgctaggcagacatgattcaggtagtctggggtcatttatagaagcaggttatctgaaacattacaagcaattgacatacatagtatctggtgggttagggcactatgcgacgctgtgatgagtgagctgtggccactgtgctgatcatagagcaacagagcagaaactacaggttaaggtgatgtcctctcttcctaaatcctcacataataaagatttgaattgcagtgtgtgattatggttttgtgattggttagtgcgacatttgatactgatttgctccatgcataaagaggttcgaaattcagattaacctgcaaaacaatttgattaggaattcccaaatttagttaaaacttatttgagtggaaagtttcagtttgttagattagctctttttcatgcctgtgagaaggaattatgtgcattccctaatatcggtggccgcttgcgtccacggtcatcagactatttcctcttccttaacgccatcaactgaatatgcagttgctcgacgtctacgccatgcttatcttctcataagcgcctcccatttcatccctatcggcctctgagattactgaaggctcctgctacatgaagcatgaagtgggtgctggtctccatctgcttctctccctggtaccattttattttattttttgcaagctggccttcattgttaccctggtggttgatccatatgatgaattgactgtgtgatatggcttcggtgttgcttccatgcattctgacctatctcatgttctgtttcatttagtgcctcggttcgattcaacacaaaaaattaagtgctcaattgttaatagtcttttaaagtaattacgcaatcccttttcttttccagacgtgcaggaatttatggttggcttaaaaattatagctgaatgggcacaccattaatgttcactgtgtacaaaaaactgtggtggttttttgaattttgtacatgatccaccaaacaaacaaggtaatctgcattggttatttggtatacttgtggagcttattatagatcaagatatatgtgaactaatagcattttaattaaaattagaatttgtccagagcaccatatttttatgaatatttttttttcttgacctaaggcataactttagtgatctgatcttatgaattgctatactgtctaggttagctacctttattaactagaaaacaatagtccattctagccatattaattaagccacatttgagtcaggtgtataacctgaatcaaggtgaatgaaaacatttaactggagtgctgcgcaataatatatgcagaattgacacaatttagatggttggagtttaggcattctgtgaagtccccaatttcattgaccaggcctatttgaaacataaggggggggggggacatcttatggtacatcaagttggtccattttgttcacacaggataacactgcacttaaaatattttttttcatattatggttcaagtgcagatattgtggattgccataacactcaccttctaagtgcatattataacggagatttttgagttgatgaatcgttgtgagtatggaattttgattctacgttcttctatgattaccaggctctggaaggatctaatatgtggtttaggaaaggatgggagtgcttgaacctggaagcatctcctgctcattatgctcttaggtgttttatttccgatgctgttactattgatacaacagggaaagtcacatattgtttaaaatatttattgtgcttaaaatactatactgtgtaatgtccgaaatttatattcatgcgttagatgtttcactttcacatgcacatgcacttctgttgaatgtgttgttaagttctcctatgaacttgttcgctgagtgggttacattacatttctttcacaggtggtgatcatagcatgatggcaatcgaattccacccgngtggtagcatgcactatataattnttcggntatacatcacagaagacagaaaagccacgtatgtttctatgagcctgtatatatcactttactaaaagttttctggcctcaaattattgaggaacttagagctaccattgaacaaatgtgccctggttcttgcagtgctttaatctgggtgcaacaacacatattctaactgggtttgggctcaactttctgttattataatttactagaaaaaatccccgtgcgttgcaacgggtaaaaacggtttttatactatacattatactcccttgtttttagaccgaatgctttcttgtttttggaccgaacgttcattctttccctcattttcagatttagtcctagagcagtccgctgcttctatctgcttggcctctctcttcggctcagcccacaagtggagctgtaggcccagctcgaacagtcctttgcttggcctatctcccttcggctcagcccacaagtgaagctgtaggcccagctcgaacagtcctgtgcctggcctacctctctttggctcagcccgcaagtggagctgtaggcccagctcgaacagtcctgtgcctggccttctcttcggctcagcctgtaacatctcgaacagtctcgtgcccgcatgacggagccgatcctcccaccaaatccggtaattgaccagctcgaacagtcctgtgcctgccctacctctctttggctcagcccgcaagtggagctgtaggcccagctcgaacagtcctgtgcttggcctacctctcttcggctcagcccgtaagtgtagctgtaggcccatctcgaacagtctcgtgcccgtaccgtaggggtgaaaacggtacggaaactttccggattccaggcctgtttttggaaacggaatcagccgatcgaaatttttttcggaatttctcgaaaacggaatcgaaaacggaaatattttctcggaaacggaatcgaatatgataatagcagtttccgtcggaactcggaatcggtcggaaaaattccggaaaatttgtcggaatttccgaagttaaaaaggcccatgaaatcaatagtctataattcgtccccaagtttccagcccaacccaaatcgcggcatctacccaaatagtggctaaccctatagaggagagagacagacacacggcatcgcgagaccgcgagcggtggcagagcatnacgcttcacccaccgncagcgccccgggccacccctggtccgccgtcctgggtccttcgggacctcgcccccaccatcttcgctgtctcgtaccgccgccatctcgcggcgctgtccacccgtttcgcggcgccgtctcgcggcggcagcgccgtcccgccgtttcgccgccgctaccaccactgacgacgacgccacagccacaccgacgagccgacgacgcctcgcctctgcgactcgacagcagccagcagcccagcggcagcagccaacagcccagcggcagcagccagcagcccagcgacgagccgacgagcctaaaccattgatttgatttcttttgtgctgcagatttatgatggaatcatcaaatgcaagtagctattttgtgattgaactaagtactgtactaatggactgatgtgtgttgctgttttgtgatgactaatgattgatgaactatgtactgatgatggagtgatagctcatagcagattagcagtatagcactgaataatagtgtatactgtataccttataccatggtcttttgctgtattttttttagaatatttgttatgcaaattatatgaagttatagaagaatatattttgctgttgagacgatttcatataattgtgttttatgatgaattgttgactgttgagacttgagaattggacttggcaaaagttttaagctcagtttgaggggtttttgtattccgataaattttcgttaccgtatccgcgccggttcattttcgctccgttttcggtttcaataatattcgtttccgttttcgttttcggggtttccgattccgattccaaaaaaaaaaatgaaaacgaaaacgataaagattgtttccatccgtttccgtaccgttttcacccctacgtgcacgtacgatgacggagtcgatcctctgtcaaaagcggccgaatctttctcgatctccaaaattgttagagattttgattcactcgatctcctttttcgatttttttaatcaaagtcgaagcaatccgcaaaactcggaataaaaaatgacaaactaaagggatgaggaaacgcatggagaggcaaatcgatatagtggcggcgctagggttcggcccgacaaaaaaaaaccaccgaaaaaatagcgtgttggattttgttaaaactggaaaaacggtgaaagaaaaaaaagaaaaaaacaacgtaaagaaaataaaacggaaaaataaaataaaacggacaaaaaaaccaagaaaaacggtgaaaaaatagcgacaagaaaataaaacgaaaaaaaggaaacggataaaaattaatttgtccttttctatattttttcttgccgggccgggctttttttttacaatcgttttacggacgaaaaaaccgggaaaaacggtgaaaaaaatagcgaccagaaataaaacgaaaaaaggaaacggataaaaattaatttttggcccttttctatattttttcttgccgtgccgggcatttttttacaatcggtttttttttgccttttttttgtccgcttttttagcacggataggaatcggtcagttttttttttctgcgccttcttttttggggccggactttcttaaatacaatcgaactttttttatcgcttttttttattaacggacgaaggaaacatcttatactttttaaggatttttaagtagtagtagtagatatgtagatttggacttgatagattctttgcataggctaagaatctaatctaaccattaatagaagtcatatagatagaacatcttatttcagtttcacacaaggatgccacttttgaacagaaaaataaagatatatagttatcaatatgactatttccttttcctcagctagattccatcaaaatgtagctatttgcataagatatctgggatgcttcaggataatgaaggataggttgcagatattcccttatttgcttcagctatacttaaaattttcgcatctgggtagaggtttgtcatttgatggtatcgcatttttctaagagggggtatcataccttttccctatatttcactaacaataacatatccatgtacatgccctgtctgttgggcctagaatgtgctaaaaaaattgggatatggcatttcttattgtacagttgcataaagtgaaaatagaaaaaaattgtgaaaaaattagcacaacacctcttcacaaggtaaatgttcccctactctgtttcaagcttaagatgtattttcgttacctatttaggtattcaccctcttgagatgagttctaaaatttgtttgtatattttttccttcgatgttacacatgatgccaatatagtatatatatgtaatcaataaaattatacatgatccaattttttatcttcctaggcatataaaatgattaaggctacatcttgaagatatggcagctttaatgtatatacttctccaaaacaagttttcagccttttgtacttagaatgaagtagcaccattaattttgatgttttgcaaagtaaattatgccttttggtaagcattttttatatggtcaagcaatctttgaaatgtaaagtgcaggtaatgctgcatacctaggacttgaaataaattcagattcaaagtattcacttttaggtccaagattagatttatccagattcaaattatccagtttcttttaatagtcacaggaaacggggtcggtggcagcgatcctcgacccgggaacgccgtccccgtcccgaaaacatggggtcattttcgtccccaccttgtaaaaaactctctcaagtagcgtatcacgttcctcgaccccgtttctcgatcccatcgacccaggaactttgttactatactgctgccataacaattaaaagaaaagagaaaattcaaatgtgttttcatcagttgacctagtgcttgaagaaaacttgttaaaaaagtaaggaaatcttcgggacagtcatctcatttagaaaattgtagtacatgagaaaactaatgttcaagaaacttgaaaaaagttctggagaaaaaagaacttacatacttttagaaaaatgttgtttgtgctgccataacaactaaaagaacagagaaaattcaaatgtattttcatcagttgaccagaagctggtaactttaattagcctaagatttgcaagccacatttcagtagattgggaacgtgaagggcgctctttatttttttttttcaaaaggggatgcctttacttaaaagctttaatacatgattgattaaatattgatgaattgttcgatatgatttattatagtgattcatgttattatgagtaatagttagttttgttctcatttttataggtttattgatttttctttttctttttacttaaatttcttcagttttcttttgaaaaaccgtgatagttgaagtaatttacttatggttgctataaacactaccgtagtacctagcccatagtggtcgacaccgtcaagtggacaagcgctggaaggaaggcctgatgagaagattgtaacgtcccgcctcccccagaccaggcccacttacatctgataatttttataggtcatagactgccctcacagggccaacatatgtcttttctgcacacttttgtcctcactcgtgaacatgtcttttctgcacacttttgtcctcactcgtgtgcacccgggaagaattttccggtcgatcacccatcccaaattgctccaggccaagcacgcttaaccctggagttctttggagattggcttccggaaaagaagttgcaacttgtttatatgagtattctattaatcctattaagccctaggccgggatgttacaaggatataattgctttgttgcagatatgaaagctacatagatgtgtaccattgggccaaaaaaatcccattaacaaaaaggtaagtgttgttctcttccaccttgctactaccaattgctgttgttgaatacaaacatttgctaccacaaaatattttttattcatgtgatctgatgttatggagcccacttgggttgatgctgaattgttgtacatgattttctagccttttctaataactagatatgcttgactataatttgttcttgttaattccatggtatcattcaacttgagttaatgtgtctgtgtctacatattattcaccgcaaaatgatttttagtcatcaaatcatgatttggtagtacatgtgatttgttatattgtacaaatctgcgtggttttgcagtcaattaacgtgttcaatacacgtggcttggaagctgaaactagattccatggcttacaacccagctttcttgccacaccatgtgaagcttgcctttacctctaaccatattgaattatcccagcatttatatcttagggtcaaaaatgcatttcaacatgaagggattatgatttttcacattatttttaatttccattcaatataccatggcataataatataacagttgaagtttttagatagttgtactgctcgaggacccgtgggagttgtttggttgggttcaaataagtacagtgtctaaattgatatgcaaaatcaatagaggggaaattcgtctaaacctttttgaaagtttttggtgtggaaactggattattttttcagggaagatataacatttttttagggaagatgttaggtgacaggttataaatatacgtcactcgaaggaatttcttgtgaatttatgctgttgtttcagattatcatagacgtgttgtgcgtattgtgttgattagttagctccttggctgcatttcagtgttcattccgagtgtttagttccagagcacattgcctgattcaaattaaacagaatgttgcacacctgttcatgaggtttccaaggaacaagtaaagatcttctaatcacgctaagagacttagagataatcatgcagaaatattaagttataattgtgtgatctcagagttaccatattcatgcatgcctttcagggggagtgtaggtattagcataggatatctgggatgcttcaagatggactttacaattgctccttatgaaaagaaaaatgaagtcaatcagtctagcaattaatttggagaaactgactcttttgcaagctatttgagaaggcatctatggaaaatataatgttttgctgaccggttgtcattttacttgtgtttggtcaaatggtcagggacactggctggcatgtagatggagggttcaaaaccgacaccatatgctttatcatcgatactcagggttttgtatctatatgattttggtttagcacacatttctgattattgcacgttattaaaccatgtaaacaatggattacaaaatttgtgtgcaggcccatcatctagaatatagtcattggtgagcagacacttacacttaggaaggaattaggataggtggatcacacacagacacagggacacgatgcatggatcttgcagcacaacacagacaggttgctacttgtgctcctcgtcgaacgcatagccatgtttgaggtactggtcgatgaggttctgctcgtaggcgttcatcttttcatcgatgaactttctgagtttgaggcagaacgttgggccagctcctcctcggtgtaggcgtactccgggtaggtgtaggggtagctcatcatttgtttgataacaacattaggcatcttgtacttgaccaccttcttcccagactcctccaaccagcactccatggaccccgggacattcctcgacacccagagaggcctccttcttgaggacctcactaccctcacacgggatcgaagaagacttcctccttgttcctggccgccatcgcccgcgcgcgatggaggcagttctcttcaagaagaagaaaacaggcaggcaacaatggcggcaagcggatcggaaggaacggccaacgacccaactcgtgtcagcccacaaccgttttcaagccttttcagcccatcccaccaatcttaaagcaaccggaaaagaattacaaatatactcccatgcaggcccttaatggcttaatccttgggggttttttttatcaataagccatataaacaatcaaatatatcgccttgatttcacacgactaaatgctgctattgcttcttcttgttggctgcgctgcttcaattccttcacagccgcatcatagaaagacaatcatagcaaattcatatgcagacttgtagcaagctcatgttagcaaatcatcagactcagttcaatttgtgctcgatcgtatcagagaatcagcatggcacacttgcttattctgtataatcatttatggtaatattaattatattcatgacttgacatgtgtgcatgtacaaaccatcccagcagttaagcttggtggtccaatagaaggatgcttaacagtaagcctaaattcatctcatttccccttggaagagatttcaaggtataataacgattactgagtggcacaattgccaactagtatattatgatgcttctcaactgaagattgcaagcatcatcggacacgacgtaagtactgttaccacaatacacgatataagtaagcactgttaccacaatacaatgtatagacaggaaaatagtaagcgcctcatctttagctgctatcgttcatgttgttaatagtttcaagggcttttggaggcaccatagaaaagggatatgaaattgaagcaatgaaactatgaaaagagttaagagtaaaactcagcaattgtacaaatgcactaggaatacaaagatgaatcaccatgcttgtttcagacaagtattttcactctaaaaaaaatcaacagcctattagtcaagttcttatgctccacaactaagaaatacagtatcttacagcacaaaaagcttaatcctctatagcttcaaattcacagctcatagtttttatacgcatatagtcagctaaagaacacaggaaaataatattcattcaacagttgacagctaaagagcacccagagaaaacatgtattgtgatacaggcatatagcttcataggcattcagaacagttaacaaaagatacaggcatatatagcttaaatgtgttataactaccatgtaaagagaaaaaaaaaataacagcaataatggagttgcgtcccataaacatgaaataaaactgtcaactgcagtcagatgtagcttttttctgctgacagaaattcaagcatgtgtagttttacagcgacaaaaaacacaggggatacatacaccctgggacatcatcaacctctaggggttcaggaaggaaactagaacagaagcaaaattaaccaaaagttaggccctagccagccaatcttcttgcattgaagttgcatcatgtccagcaatggcttgataaggacttccgctgcaaaatagagacgattttctgtatatcattccatgaaattaaatatactagacttttaggttccatagatgcggcaatgaacttacaaccagcaaaaatgcatctaaaaagtaggtgatagataaaaacagtaataacatagagacgattttgtgtatatcatttcatgaaactagactttagcgttccatagatgcggcaacgaacatataatcagcaaaaatgcaattaaaaagtaggtgattgataaaaacagtaatatacctcataaattgaggaacttggatagcttagaagttagaataaatgtcccaactgaagtgcctgcagttgacccctgttatacagctccaactgcagatacgggacaaccaatgggaaccggacatgacatgcatactctgagtccacagcattatagcccaaaatcaggctcctccatggatccatcctgtgagatgtcctatttctcagaaaatcaaagaagaacagagtttcaattaaggcgatctgatcaggggtaagcgatttctgtcctcgaataggagttagacccagtgcatgtaagaattccctctgacgtttgttgaggcatgtctgagatggtttgtcagctggtacaatacggccgtcagggttgaaatcataaggctttttgaggatacggttggtcttgactttactctcccaaacatcggcatatggaaggtttgttaggatagccctaagatcatctggtggcatcacaaatctgatatggtcatacattgacttgaaaaacagtgacacattagctagggataccaatgacccatgaaaatgaaatatctctctcttgtcaaactcatgaaggatcaagtttagcaggtgctgtatatcttcaggcacacttccgtcttcagatagaaagagattcctgataatctgatgagcacacaaatagttgtttcttagaaggtccatctctaactatacacgtgaaatgttcttgaacttaacttttcccgtgggactcacaaagatgtttgaaatgtttaaatccaaaaaacacaaatttctcaactcatttgtccttagtcctttcagcatagttctgaatactttcttacatgactctgttgcaaccagataagtcacacttggattagtttccccaaatgaacgaaactgatacgaatcagaagtcaccattggtctaatattcagataagactccaatgggatgcaatcatcaaaatacacttcagaggtatctaacacatatctatcatatgacacgtaggataaggcagctgtgaaaaagaaaagaaagcaaacattacttcaatgttttgacaacctaaaaggacagggaaaatgcaaaggcaattaccattatgaatggggttgtccatgtcttcaggtgaaaaacctggaaccaagtcaaggggacctggattgtttgcagtggccatggaaaagctcaataatggcagaaaacctacaagcctgaaaagaaagcatggacatgaaaacaacagcactaaaatgcaacctagttgctacctatgaccgtccccatattttatgaaccaatagaagtgaaatgggaaaatcacagatagagaatatacactacagatattagctatctgtcactaaacaatccaacatgacttgcataggttatcttcttcctatcaacattagtcatgaatctattattaaaaaagcctaccgaaaggataaatcatgtattacctacaaaacaactgctacttttaatagaagggataatttgtactatgtggtcatcagctacaaaaggctcacatatataagaaatcagctatcatgtagtatccagataaaccaacctgttgtaggccagtaagcagatgtcaaagcatagatacacaaattcaagatcaacacaaggaaaaaaaaactgaggcaacatcccaaggctcagccacttgatgactacatgatggggaagaaagcaaaacacataggaggctgggttaacttaaccaaacaactcagaacatagtgggagataagtccataaatgataaatctctgaaacgaaatgaagctttagatgtagaagaatgcaagttagaaacaaactaggggatcaatccaaatgcgttttgaaaacaatatgcttcagatgcagaagagctcagagacatgcagggagttatgttagttaaccaaataacagatacgaagtgatcagtactaacggatcagtccatgcatctctcaaacaaaatgcagcattgagatagagttgcaacagcgatttcctttctctattcaattcacaccagaatcccagcataaaaattatctgcagcttgccttccaaaatcagtctcagattgtaagaatcgtgcgtgtcaaatgaatttgtgcaattctctgttcccaaaattcagaaataatgccagttcaaacagatttacaattgtgcagaaattaataaggaacgcacaaagacagaacaggataaagcaacaggtgcaaccaacagcccataatttctcaaagcaacagccaacaggagccaagttcaggtattggtttgttgctaactcattaggatcaacactgaagaattcataacacgcacagagattttataaaccaaacaagacggcaggataccatcagcatgatccagaagaaaacataacgtgcagggaatcgggtttaattgaaccaaacatctcagaacgcactgggagaacagttcatacatctgtgaagcgaaatacttcagatgtgaaaagaaggtatatcagaaatacaaggaggatcagtcaacatgcatatatgagatgaaatgcttcaaatccaaaatatttcagccacatgcaggaagttcggcaattaatcaaccaaactacagacagcataccatgggatcagattcaaactaacatatcagcccattcatctctgaaatgaaatggagcattcaaataaagttacagacaccagaatcaaagcaaaatgcccaccggaatgttgtcatgttcagggaggaagcaccatcgctacaacgggtgcttcgactctgttgaggacgctacgctctgggcagagagaatgaaacacaggaacgacaggtggttacggtctggaaaagctgtttctctaatcccctttctatgatgtaatgatattatgttcgtggcatctgctccatccaatacaaattcatgaacaggaaaacatcccctatcgatcaagcactgaaagtgttccaaatctgcaaccgaatcccaccaatgaaccacatgccgagtaaagaacgccgcaatacacacatctgaacccgcggattctaaattcgtacgagaactcaaatcaccacaaaaaggctcatgcccatgctactgtacagattcatctttgctactctattgatccacgacactaggcgctccgtcgccaaaaatcaacatataaaatgacaaaaaccaacatataaaatgagacagcacagtacacaccgagggattcaaaatagtgacataaaaaagcatgggaaaaaacctcgctcaaatggaccaagtggctccaaaaaaagtgcggtggcgagtgagtggaatcagggcgacggagacggcgagtggaatccagcgatgacgacagaaatcgcccttctctccgcctggcacagacaaaacgagaaaatgaaaaaaaaaaaaaaaggaagatgtgggagggaggggaggggatgttacctacacaggtaggttttggggatctcgatctacgaggaaagcttgtccgcggacccaggaaatggctgcgtangcatcgggtcgacgaggtgaagaataataatcttggacgagaggttnntggaagtgacngcggaagcaggaccctaaactacggtttcccatcgtcgaatttatagacagggcgctagacgggcaaggccgtgatgagtggtcacaggttgggcaagcccggaaaacctgctagggcaaatataaatgtcgagtagttcaacttaaggtccctcatcttgatgctgaggccctgtttagatgctgcaaaaattttcaggcatgtcacattgaacgtttgaacacatgtatgaaatattaaatatagataaaaaatttttaatacacagtttacgtgtaaattgcgagacgaattttttaagcctaattatttcatgatttgacaatgtggtgctacagtaaatatttgctaatgacggattaattagacttgataaattcgtctcatagtttaccggcggattttgtaatttgctttattattattagtatatgttttatactttaaatatgtgtccgtatatctgatacggcacgctaaaactttacacccttgatctaaacaccccatgagtttaaattacatcctaaatcgtaaaaccgagtatttcaaaacggatgctaatatagttctaaggcaggattgaatacggctttgactgatatggagctgacgtgacacaataatgaaaaaaaaacattggaagccacacgtaagtgaaattaaatagcatagcgagagaaaaatactgcataacgtgatactgtattgagccttaggtagggatgaaagcggagcggataaatactgcataacgtgatactgtattgagccttaggtagggatgaaagcggagcggataaatactgcataacgtgatactgtattgagccttaggtagggatgaaggccctttttgtttcaacttatgattattataatctagattaataagccagattactataagctggcatggaataagctgtgagttgtttatttgtctggattattgaagacatggattattgggtttgaatggctaaagtctataatgtcctcacctatctgtccggttgatggcataggtgggtaatttttctcaagtatttaggggtagtgggtctttacccacttaataatctgaaaaaagctcctctagagcagcttatcagattataataatctggcttatagattataataatctactataataatatacttgtttgtttcagcttactcctaataagctatattataataatcctaagctgaatcaaacagggccgaaagcggagcggatacgaacagataatgctcgtaccatattcatttcatgtttttttaccggataaaaaacaaatacggattatctcaaatacgaataagtatcgaatataatcggacatgaatacggaaacaagttttttttaatacgaaaactaactcaacttctaatagaaacaaatatgaacatatataattagcttattttatataaatgccgtataatttataaatattttttttaaaatttaaataatattaatcgtgtggactagtgttaagagataaactactattaaaatcaaaaaaaatatatattgaaggttatagagttataaagaaatagggtatgtctcatggcttctgcggatatccgaatagcactgctcatcgcatatccaaattattatccgtatcaatcgacatttgatatcgcgactacggtatttgcatagtatagggatcgttagtaccagatatatgcgagattgaggtaaaaagatagagacaaggatttttgtacaggttcggacctcttatcttatagttaatagccctactcctgttggccgaagtcagtgttactcttattcatcgtaatcacataagtacaatgtatggggataaactatgtagctgtcgtcgaactggcggcctgtaaaccaccactagtcagcggcggacaaacccctgaatgttaatgttaactttaatcgaatatcacgttaacatccaaatgaatatcttttactgtgattccaaacaaacaattaacttatatttctaagacatatattccaacgcaacatgtttaagtcgtaaattttgataccgagcaacttttataagataatggggtaggaacaatttgcacatgcctgcagcgaagttagggtctggcattcgttcctgccgcggcggaagaggacgttgcgcttgtggtccatggagtctcgcacggcgaccacgccgtagacgccgagcggccaccggaggccgccggtgatctgggtcaccttcaccgtgaagacctgcattgtttccataggctgcgcagaagggggcagcactggaatgtctgtgtttggcataggagggagatccgctgcccaatttttccccccacaaaacaaacaaaaaatcaatcaatttgctccacggttgaactaatcgcatcaagttttttttggaactaatcgcatcaagtcgccaagaaattcaattcaagcagagaattcaagaagaggcatactctcgtcctcgaaggtggcgccattggtgccgtaggaacgggcccagctctggcggtaggcgtccaagggattcggaaggggttcgtcgtagtactcgtcgtcgtcgtcgtcattctccatcgccatggcgcggcggcgggcactgtcgtggtgatcctccgacggcgtcttggcggcgtcgccgccgccgttagaagctctctcctcctccgtgggcttctccagatccgccctcttgtggccgagctcgccgctcgcaccctccgcttccatatccacctccattaccgccgccgccgcacgccgccggcgggtttagggtttgtctcgtcctcactcctcactctgcttccttgttttctctttctttttcttttttgggcctcctaaagttgacgggctttggcttaagcccacccagccgaagccgaatcaaagatttttggaacaagtttattttgcctccctctcttttgctccttgtcgaatcgcatccctcgaccacagaaccgggtataacgtctccctctcgtatatcaaaaccggtgaaaattgtctcatttattggattgggaagcggtttcgtccgacgtggcaaattgatacgctgaacccacttatgagcggcctctacctcatcccatcttctctcacacctctcccccctctctcatctctttcgtcctctctctcaccttccatcagcaatagaccgggcggcggcgacggtaccaagctttgcggcgcgagggagaggagcttgccagacagccgcacatggaaggaggagctcgtcggccggtcgtgcccgtggagaggacctggccggcaggggtgcacatgaggaggagatcgcaaccgtacgttcgcacacatgaaggagctcccagcgagtcgtgcgtggggagaagagtcgtcggctggccatgcgcagggaaggagcttgccatccagcaccgcgcggggagagaagctccggccggccgtgcatatggagaggagtcgttgaccggttgcgcgcggcggagttgctcgcccgccggccacacgggggtggggaggggggggagctcgccgaccggccgtgtgctgaggaggaggtcccggccggccacgcgcgggagaggagctcgctggccagccgtgcacggggagatagttgttggccaaccatgcgtggggggagcagctcgattgccggtcacgcccggggagaggtgtcgtcggccggccacgcggcggggaaggagctcgccaactggcgccgcgcagggagatgatttcccagctagccgcgcacgcgaagaggagtcgtcggccggccaccgtgatccccctcggccgtggtaccgtttgcagcgcccaagcacgtggctgtccaccccagacctaccagagaaagagataaggaagaagagaaggttaagatggttgacaggtagggcctactgttttttatttctaccattatcacttacatgtgggaccgttttctattttcaactcctttaatgactaggtgccacgtcagcacacttagatcaaatcaacttgccacatcagcaaaagccggttcaaaaaccactaaaggagttaatttgtaccagtttttaaagttgggggacatgttatacccggttttgaggttgagggatgtgattcaaccaagagcaagagttgagggaggaaaaatagacttatttcaagatttttacaaaatttattaaggaataagttcattggaggtccctcaacaaaatttaattttttttacaaattttacaaattaggattttttgagtttacttaaccataaaacgagaaatgtatacctctaaactcatacaaaccgtacaatcaaggtcctatagcagtatatataggtggcttgactgacgtggcattctagtcgagaaaaaaaagtccacatgtaagtgtgatgaaaaaaaaaaagagatccacatatcttatttcttctcgttttttcccttttcttttctatcttctcttctcttttcctctccaatcttctcgacgctgaaccgcagccggcggctggcggcagatggcccggccactgcccactccactccgccggccacacgctcacccgccgccgtccgccacgtgctcgcccgcttgctccagccgcacgccgccgctccgctccgccgaccgcgcgctcgcccgccgcttgctcttgtttcagagtacagtctacatgtacttactgaatatccatgccagagtgttggctcatcatcgtttttcgtttcttgaaaacctgtgcagatggagaatcgatggcgatgacattccgatggaaacacatagtagcttaaagccttgtcttcagatggtgatccttgacccttcactttgaggtcaatctcaaataaggggttatccaatagaagaattgcacggctaggacctgtgagttccaatgctgtagttcatatgagtttgatcagtaaaatccaaaatgcaatgttaattaacacgtggataggaggaaatgggtaaatttgcttgcaatcgaatcactacacaattaggattagaacaccttgcaaatgtgcgagtgcgagcaagatagagagtacttgagcattgaaatgttcattgcctgatgtttctgctttcaaatccgagtactcgagctcgtcggtcagcaggttcgcgtaagcgacccgccgatcgagtagacggccaagtggcaacccctctggttccaagcaacccaggaaaaaagctgcaccgaggagcccgcaaactaggcaacccaagctgcaacaggcggccataacttactcggatactccttctgtcaaaaaaaaaaaaacttaacctctgtctagatttgttgtagattatgtctcatccacgtattaggttaagtttttttggacggggggattagtaggcaaccccaagctacgcaacccaacccaaccttggatgggaaacggcctctgtcccttgggattagggggtgtttggatccagggactgaactttagtccttgtcatatcggatgtttggacactaaccacaagcaatgggagtcctcaccgcacattgtacgcctacatgtatgcaaacaaaattagtggaggaaaacgatcatacgccccacccacctaacaaaaccattcctttagaaaaccggtgaaaattaggaaaaaataaaaaccaaaactttgtctaccaaaaaaaacatggctttaactttcatttttaatcccatatctccctccatttcaagatgtatggcgccgctgacttcttgcgtaacattcgaccattcgtcttattaaaaatatataaatattatttattttgttgttatcaaataaactataatcttaacttatacttttatatatttgtattcaatttttaaattaaacaaatgattaaacattatgaaaaaagtcaacgacatcatacatttaaaaaatgaggtagtatcatgactttgcggtttttctatagaacactgcacaagggaaatgcactttgtaaatcagctcatgaacactacacctatcctaatattcatttatgattgaatagtagagagaaaccgtgtgaaagttcggaaatacccctagactcacatgtcaagtctctcatctctctatttctctcgagttctatttctttgctcttctcgctatcgcaggaggccggcggggcgagtcggggtgtgatgagcttaaaggcggtgggctgtggttggcggtgattggggaaggaaatggggaggcttcgcctcgcctcgcttcccaaatctcacaaactaaaagctaacggcactaactcatggaccgaaaaggaagaaattaacgcgggtttgtgccgtgtagatgtttagtaccaaaaagactgagtggaggtcttctgcagtactgcactactcactgacatgtgggtcccatagaccgagcaatgctgcacttagt

SEQ ID NO: 50506 - DNA, 9886 bp, Oryza sativa
tctctatttttgaaacggaggaaataattgatataggagaaggtgaagaagcagatcctcggacacctcactcccctttccaaccggcaaaccctacttttccggcggcggcggcggtgatggagtccggccagtctggtgacggggctagccacggccacacgagtacggtggtggagactgccaaggaggaagcgctcgccggcggctacgatgaggaggaggaggactgcacaccgctacctaatgggctcatatgctcgcggcagaattgggaaacgatgtacggcaaattcggtgccttcgaggacgagagtaagtggatttctctgatatatatatatatatatatatatatgtatgtatatatatgtgtatatatatatatgtatgtatgtatatattctctctttggctctttggattcgctagcctgattcaaaatcaatctaatttcttctatcttcattgtgcaccgccctctcatttgtgatttttgacacaatcatttgacagaaataatgaacggacttagcaatcttgtatgttgtagatgcactgcacgcacatatattaatcttatagatgaacacttttcaatgtattgggatgcccaaccacacaaacctagttggggcagtcatattttgcaatttgcatttctttcctgggtcttgggtttgaaggcttgaagggtggccatggacagttataagaacagagtgaattttgggaaccaggagccattggaaggaagcagattgtaaaaaaaaaaaagaagttaactcatatgtatattttcttactcacatttgtcatttggttgtcaatttctgctccagtccaataatcactcgatgaatttgtgtgtccagcggatgcttctccaatgaggaacacggataggccagtgccaccatattatctgccaattagcatgatgcaattcttctcagtgaaggtgatcgagatcatgggaggtctccaatggccactccacgtctatggtatcgttgctacgcgtgactcacaagataacaagaggaacttcttgtttcgttgtgatagagagcactgccagacccttgcctcaccacaggtatgtgcattgtgtagcccttcattatttctggtccatttcattttgttttagttttatttgtcgtcagtcatgaatcaagtgggtgcattatcattggtagttaaccaatttactgctaccaaaagctaaatagagggaacccatgttttccaaagctttcttactgttcctgttatgaaattttggggatgatctcatccttaacctagcacttagcagcaatgagttacagccatgagttattcttttttggaaagagatgcaatcattacttcagtccacattaacaactacagtttttactacccatcttgctgcatggtgacatgtttcttacaaaccgttggattgaagtcatgcgcagtatctttgcaggtgacacagcctatcaaagattatgaaacatgttgatctgattgcccctctttctgtcgcccatgcgtgcaggattcatgtttgagacttacacgtcctagtcgagctattgtaatagtgaaccctgtagttgttgaggttgacttgaaagtgaagggcagcagaggacccccatctgaagacaaggttttaagcgagcatgcttttgttcacaaccacactggtcataggattaaacctggctttcctcatagacagctggaatcaacagaggacagcacgatggagtttgtgtttgcacatctgcagagtgcagtggaggccaccatcacggttggagtcgttgaaggatcgcctgatttcagggctcgttttactgctcgaactgctgggattgatgaggatgtgttgcttcttgactttcaggatggtaagggcctctttagttcgcgaactgaaattttttgcgtgtcacatcggatatacggacacacatttgaattatttaacgtagactaataacaaaaacaaattacagatttcgcctggaaactgcgagacgaatttattaagcctaattaatccgtcattagcaaatgtttactgtagcaccacattgtcaaatcatggcgcaattaggcttaaaagattcgtctcgcaatttacacgcaatctgtgtaattattttttttctatatttaatactccatgtatatgtccaaatattcgatgtaactgggtgaaaattctttgtttgggaactaaacagggcctaaggtggtggtcgatgatgatgggttcgtcgtgctccggcgacgtgttgtttctgttgaagggacagggaagctgattctccggatggaggctacagatcacggtggcgatgacacggctgttgttaaggaagaaatcttctgtgctagaaagacatcaaggagccaaagttacttcatgcttgggttttgtaagctgtcgatcatcatcgcctggtcgttacttccatagatgtagcgccagtttaagtccttgcgtaattgtgtgtattgtgtactagtagtactgctttgactaagccagattggtgtgactctgggttcttactaaagagcatctccaaaagagcaaatcaggtgaagaaaaagataggagtcgatattcatctgatactatcttggtaaagaaaaagataggaataggagactatgcattcattataggcaattaaatgctaagaacaaatactcattcttattataaaaagacctgctagataaactccatagtaatgccttttggtctcacaaagccccagcaacatctcatgttctcatgaataaggtgttggctcctatcttgagaaaagatatgctagtatcttttgatgacattctaagaccatagaagaacatgtgatacatgcattttggacattttaaggtctaactagggtttttttttttgcataatcaagtaaatgtgtgttcagtcaacagcaagtagaataccggggctacattattagctattaatcgaagctgtataactttgaccagaactcactaatgtcactcagttgagaggctttctggtttagttggctattatagaagatttatcaaagttatggagtgatctaattgcatatctaccatcgcaaaagattggattcgcgaatgcgagcatcaggtggcggcggtggcgattcctgtactaggcaacaaaacgagcggcaagcgtaggcggcagttcctcttgggggcagacagaaggcaaccagagggaaagtttgctacatggaactcctctatttgttgctgacaatttgattcgtatgattgtatcatccggctggatcgatttttttctgtcatccctcctgagattgattcctctttcgccggaatcaatttccgttgattcatgccatgtaatttgcattcatcactgctaattgggacgatgacaaaggagattaatcttggatgattttgctattttttttaattgctggtgcccatgacgtgcagttgttgccgtccaccgatcgttgccgtcgagcatcttcggcgcatgaaggaggaagaagaggagccagggtattcttgcgaagtcgttttggttgagtgtggtattttctgaagcatacttaagttatggtaccgtagcgaatctttctttttcgatggtagaaatataattttttgattgtgagaaaacagaagcaatgtctgaacgtagtttcacagttagccgtgctcctcccaacaagctatttcagatttcttgtttcctgacagcattccgaaatgagaaggggaatcatttcaacatttgttcttgttttgcaaaaacagaggtgcagagtgggaagtgctgcaataatataatgcacaccccaaattaaggagaaactaaatcacgatcacacacgtcaatggtccaaccttttcactatcaacaagagtccacatttcaccattcattatcatcacagtgctttcgctcaaaaaattaacacggtccaaaataagcatccgcagtgcacggtacagaagtacaaactgggtttagatcctatttaagagagtttctagctgctgcagcttctttcacagtcataaatttctctaaacagttcggtttttagttcagattctaaaaagctaaacaagtgacaatcacctctagcttaccttaattagttcggacttaatttagagcacatgataatgcccacacattcactaatattactaattaagaattcatttgctatttttattacgagtaaattgcattaacggtacataaacttgtcaggtgcgtgtaatttagtgtatgaatttgtaaaatgcttattttggtgcatgaacttgtttggtacgtgcaaactaagactaaaatggcacgataagattgatttttctatgttgaccattataaattacaaattagtagatgactaacgtgtacgtagtagaaatgttatatttgtaaacttagataccattttatctttctttatttctatcccttgcattattactcggtttttttatgcaatcattatgtcttattatatatttatccttcttagactaatgtttacacagagtttaaatcaacaacagaatcagcaaaattaaccttatagtgcgatgttgaccttgttcgcacgcaccaagttcatgcaccaaaacgagcgttttacaagttcatgtactagattacacccacctgacaaattcatgtaccgccgatgcaatttactcattaccataggaagttagtgtaacacatctatggaagggaagcaccgaccatgaagtgacctccaattatcaaggtgaggcatagccctgatgatgctcacctgcttgggtgcaatgcaagttgcgcgcgcagaggctacctcaacccaggttcacaatcccgatactagatcaaaatccgctcacgaccagtatcattggatccattgataaactaacaaaaaatcgatgaagtacggatagaatttgtcaaaaaataaagaataaaataaaattcggttgttgatttggacattttgatttgtgtacatatctcaaaaacttttcatcatcacattacatatctcaaattattatatatggacacatcacaaattgtgtacgtacatttaggtcgtatctcaaatttttctaatacacgttcaaatcatgtacgcattcttgagatattccaaattttatacacattcggaaactactactccttttttttcacattttctttatatgtagtttttctttagcccatcaaagacacatgctacaacagtcaggggtatatatcatttttttttaaaaaaaaacatacatgtctattgttcagaaagcaaaaggtgagagaaatttaaatagaagagaatactacctgttcttttttctcataaagataaagattttaccttggtttccatttggtttccattagcacgcttttccaactacaaaacatcgttttgtatgaaaactttctatataaaagttgttttaaaataacaacataacactttttcaaatttgtaataattaaaacttaattaatcatgtgataataactttctcgttttgcatgcctgcttttaatctttatctttagaagattagacgatcagtcccattcgtttcctctataaaaactggatacaaatttgatacttttggtacgcttttcaaactgctaaacggtacattttgtgtaaaaactttgtgtaaaaactttctatatgaaagttattctaaaatatcaaattaatctattttttaagtttgtaataattaaaactcaattaatcacacgttattatcacctcattttacgtgaaacaatctccatctggatgttggagatttaaacaccaccgatgttggagatggatgcggggtcggtacagcatagcagaggacgatctgcactgcacgaggaagcatagcaaccaagtgaagaaatcaaacttccacacataaacttaggaaaattgagatgcatattaatatgggcatgaagatgagatgggatcaaaggaacagatcaacagaaaccgaatgcgaggcttgatagagcttataagggccagaccaatgtgaagcctgagaaaatctgggttaatttggcccgtgcaaacccattttacaagtatagccgaagacatgcaaacacacgatcagaagtttgctcctctaatacactaagtattttcctctttcatcatagggtataacagtacagtatattcgaccacaaaattttgcaaatttcaaccatggatacccggaagagaagacggccaagataaagctatactcctaacaacgcgctgttacatgtcacgcaagataacgctgcactcctaggaacttgggaagttaagtttgtgccctatcagaattctgaagactgccaatgctccagcaaaatgttgatgtggcagaagattctcaggtgttgcgctatactttttgccgtttcgactgcgactgcttcatccactcgatgcactcctccgtggttccccttggataagcaagctgccacttcaacagtcgttgttgctaccagaacgaaggaaaaatgtgttaaaatgtgttcaggaactagaacaattcagacatagtcgattagtgtcaggtatacccattttccgataagtggacctcccttgacctgcataatccccataatggccttcccatcaagcaacggtttcatcttccatacgccatcaagctctggagaagaggtagtaagatataaatcagaaaatcttaacaaggatatgaataagttggttttcacattgaggtgttcagacagtaatacaacatcatgtagaaagtcataaggaagtcggcagtcatcagttgattctttacccagttcagttattaaacgttcagctcttgtgtatttttctttcctttgatgtaattcgtctggctggccgagagaatcaccaccactgctaacctccgggtaggtaagagtgcagataaacagtgccacacgccaaaagtcctttatctcccgaagtataagccctgtaactctcgaagtcacaatttttagattactaggcaaattaaattcccaaattaagcaactggcacacaaaaatagtacagtaaatactaaccaatataaattattttcaaattttaaaatcaaactctctgctgacctgccaaaacacgtttaactgagtctgttgggatctcaaggtattcatcatccaatttctctttcacagttgtcagattttcattcgactcaaggagattaattaattcagcaaacttttcacttgcagcatgtacgttgacaaccttcaagtgcagaacagattataagttgatttattttctcaccgtacaaagtaacgggaataatattcgaggaaaaaaatagcagtaataagctaaaaaggacgatgaggcctgctcaggaaattgtaccgtgtcagcatcactagcttttaacttcagagagtcacgaataatatagttagtgacaggaatctgtagatgatgcaacaatcttgtcaggatacttgctacaaaacaatacaatacaaaagaaagtggtgattaaatagttgtttggttagtaaaatggttcactgctaataattgttgtaggctctgttctgatcttctagcccattttttacattaagttgaatatagctgtggcagttaaaacaagcaccagctatttcctcacacaaagatattgtttaatagccacggttcgtcagcaaccaacctcaaaagaatttcaagcacagtaaagctaattaacagaaaactcagggatatgtggcatttgaaataagatctgattatctagatgctacaaaccagttaaatctacaatttgccaactggttttactggagaacataaattaacagtcataggtaaccaatgctggcattgtacaattgtacagaaattaatctaagaactactctacatattcagctcagtccgtagaaacaaaactatggctacatatgtatctaaatggtcacaatatactctcttcactctttgacagccacacaaacaacctgacatcttatcaaaacttaggatggacttccaggcaaatctaagcactacctcataatattcagcatctatacttctatactcctttaaaaagactccaatggtggtggcagtgaatctgccattccacctactcccattgaacttttacatattaccctttgaacttcttgatattatataacagctaaatctaaatggataaccacatataaattaaagtaaggccagtcttccctataaaaaaaggaaggtacgaaatttcatgaacaatatacttttatttattttataaaatattataaaatgttttcgattgtagcaaagcacaggcatttagctaatacctaaaaaaaatcttaaccatgatgcacaaaaactgctctcaagaaattctagtacttcacactgcaaaatacaagtgcacccacaagtaaactaaaagttgaaaaaaaattttgctagtacaaaaatgaacgaacttgatgaacttactgttcagtctgtacaaaaaaatatggccatgatgcatctagcctgcactctcctacaggggcagacaacccaggtcccaggccacctgggccatggcctgggtggcctaagtctaaagcccatggaagcctatgtaatttcaccatgtattcactgtgggggccaatatacaccatgggttgcccgaggcctggagaaatgctgggttcgccccatctctcctgctaacctagtaggaagcaagtctagctataacatccttgtagaaaagggagatgatttgtttaaccaaagtagattaagctgacataatttacctgcttaaaaagttaaaagcatttacataggagaaaagtgtggaggatgcatgagtaagaatttagacattaccttcttcgactttttatccaaatatattgtattccgaacaggagtgaatagtgcactataaaagcaaagccttcggtgctcatcctaaacacaatcacagatcttaatgttaggaaagcaaagatacaccaatgtatagcaaattggttaattcggtttagccataacatggaaagtgtaacataggaaccaatcacagaaataagatgggactatagtgaaaagtttagtgtcataggtcctctgaataataataactattattttttactccaaaacttaatggttcaatcaggtgtacaaatttctgtaagttctctacgtcatttattccaccaaagattaagggtgactatggtttgttaattatttgcagggaagttattgaagtaccattttgaccataaagcaatttttgtgtgtgtgtgtgtgtgtgtgtgtgagagagagagagagagagagagagagaggttgtttgacttaatggtgtgtgcttaacaaaaaaaaggacacattctgaagtttctcacacctgtgacttggaatcagaaccaccactgaacacagagcagccaatagaatgagcaagattccatgcaacttcaatatgtgaaacacaaagcctgcatacaaatataagattaggagataaaactgtcaagtgaagcacacatgctaatggaaataactagaagaagctctacaggtacagatgtctgaaatgtaattgtgtggccctttagtagaatgaattcaaaacatatagtagatatatgttatagcaagaacacaccggtcacatttgtcaggaactggagggtcgggcttctcaggaaaagcaaagacaacataaaataaccccaaatcacgaatataacacattgcattaacaggatgtttgtctgac

SEQ ID NO: 50507 - DNA, 11027 bp, Oryza sativa
gttcatgaagaaagaaaagaggaattgtaggttggctataagtaggaccaaattcaattcttatgaccgaagcgctctttgctattcttgctaccaagttcagacttcacctttcatcagaagcagcatctttaaatcttcagttaatgtaaagttgaatctagcagctgtgagagatatgcattagtatatgcaaaagaaatgcaatgttccatgcacgctattcaatgataaatctataaacaaggtatccagttcaattatcagtagacaattacatgtctactgatatcatgcctataattatcaagctcttatatgcaaagaaaattcaaatatcatgattcgtgcacatgataacataagcatataaagtgaatctaaactggctattgatgaacattcagcaaagagtatctaacttgaaacagaaaagcaattctggagttttcagcggccaatttgcccagtacgaatgcaattaaatatgagatgttatttacttttaggaaaataaacttgtcatgaataaatctgtaatctgaaagtatatttgtgatgataatgatgataacaccatcaagtcctaaaaagccaacaacaatggtatagcttagcataaaattagcaatggaaatattgtatatcaattaaaaggatgttttaccaaatcggattgctcgaagaactctaagggggtcatccaagaaggtagctttggcaggtaaaggagtaacaataagaccctttttcagatcttcaataccttcatggaatatgaaatcaacatgattacaaacagcatgaacatttgaaaaaggttatgtatatctaaaagcttctatgttaggatccaacaaccaagctcacctcttccggttaaatcttccactgtgttagtgttgatattgaagaataaactgtccaagtttgaatatagaaagagtttactagacaactcaacattgtagcaataaaagcattactttaaatgcagagcagaactgatctgaaaacaaatacctatttattgttaggtccctacggaatgcatcttctttggctgtaccaatctcctgcgtattgaaaaaaatgtcatagctaagagggagatcagagttaaaaacatgaataacagaataagcaagaaagaattatagattgctcccaaaaatgctaatggttatttaggacatctgagtcaacaaatgtaccattccctagtactatacccatataaagccacaccaaaaagacacatgtcaatgcaaatttaactaaaaactcagatagtcagtacatgcaaatatataatggaaatatgaacataacagcatatacacaattctggaaaaaaaaacaatgcttgatatgtgtgcataccacggtaggaatccgactgttttcagcatatttttcagacctcaagttgacaaagtcaatccaaatgtcgaatataagcatccttgcagtttccaagtgctttgattgatcaggattgctgaaagaaattacgaaacatcacgatcccatgacagcatgcttttggcattatacaaatgccaatatgaggaagcatgataaacttaaggtacagaaagtattcataattttcttgcactaaaggtcatgatactctatgagaaggttatttgtttcacaaattcaactgagaatattttgtaggactaactcaaaccaacatgaaacttataatggcaaaaaggtcgtggaatttatttgataaactgtgtgctgatgtgctctgtgatctcagtgaattaattgctgctgctgagcttgaccaaataagtgataaaaacaaactgagataacagtaataggatatactcgctgggaataaaattataaagattgcataccactgaataacgccaattcctttctgttcctcacccaataattctgaatactcatttactttctcgcagaaattctggcccgtcatattatcaagtgcaatatcaatgtcagtggagtctttccccaatagctgacgattatatgaaaagagaaaggttgagtcagcaaaactactcaacaatatattcttattagagatgagctgcaaatgacaacagtagtgcaaatccttgtttttcaaagcagggatctacctgcatctcctttgactgtttgtcatacaatgcagtatccaatatccatcatgcaaaccttgaatgtgtaatacaacattcacatagcacacatccaataagacccaaattatgcatatcaacaaggaaatattcacttctctgctcttaaaggaagatgcctgtaaattacactatgccatgtgcaggtgcactatttgcatctaaaatttccaactaaatgcagtggaagcacatgtctcccgcttacagactagaagaagccaagaccaacaaaacaagttgattgagccattccctgagcccatcagcctgacaatccccacaattcacaggcagtcacctaatttctcctgtcaggaaccctaaacatagccatacaaggaactctccacaggaaacactaatttgaaactataacagccaaaaatccactgatttttttttataaaaaaaatgtcaatgacatagcaaaacaatgtcttcaaaatgcccaggaaaaaacccctaaaacttacatgacaaagcacacattccagtacctaaacaaactagtatcgagctcttcaaagttaaaattcgaagggccacaaaccccaaaagccctaaaccaagtttcccaagattttttttctccaaaatggtttgatacaatcactacttctcgtactgttctccatgtactctactgacaatgcggaaaaggagatgtgtccaccttttctcaaaaaaaaaaagggaaggggggggaactcaccttgtccctgacccagccgccggcgacgcggagctgggtgccgaggccgaagtggcggacgacatcgagcaggcgacggaagatccgctcctccttctccgtcagctccacgccctccctcacctccaccacgcaccgctgctgctgctgctgcggcgtcggcggagacaccgccgccatgcccgagaagccggaggaagcgcaggctcgggcgggtaagccggaggaaccgaaggctctagatgggatcgctgagacgagcggcggaggccaaccgcgaaggaggcggcggcggcggagaagaagaggggagcatctgcgccggcggaggaaagggaggaggaggagcccgcggaggcgaagagacatgggcggcgagcgatttgcggttgccagccgccgcctgttcggctctgcttcttgtgggccgtctgtgtttgggcccttttgtgtgggccggtcgttttctggtggctggttcgttgggccgtgattccagtgggcctactgcttgcgagctgtgcttatacgctttagggcatgttcggtaaatctccaactcgcttcaggagcttggactggagtagagtagcaacctaactccgctcgtgtttcatgtggaactgaaattttttggctgggctaattggagttgtaccaaatagacccaaactattccataactccactctatacctaactcctgtagttaaatttaggagttaaactctaccaaacaggccctaaccacctgagcccttattcgttttgtttaattgtttttgcagaagacggtagtacaggggttcgcatcctctgccattaggaggtaaatggcagaggggaacagtaaaacgtgagtagcgctacagtgttttgccattgctacagtaccgaacagtaaaaatcactgttcggttattttattggaattactgtatcgattgatctcgtacgtccacgcttgatccgacggatgtaagtggctaatggcatggatcactgtagccctatgccattccagttggaatggcagatgatacgaacccgtagtacaggctgaggtagcctatgaaacatgacaggaaagcttctggcgccaaaacggtatagcccatttctctgaatttctgaaccacgaaatgctgtacctgcctgtcgaacaatttctgaatattgtttttttaggaatacgcaaggagcgcattttttttcattaagagaaataaaagttatttacaatgaaaaatgaaaaacaagcacgggactgatactggagactagcgatctaacgggatatctcgcgctagatttggctaccacgacctcgcagagataatatggaagggacccctgcatttgccgacttccaaagtacggcttcttccaccattactttcgctacttcgatccaagacttggactgctgattgaagatccgtttatttcgctccttccaaatcgaccaggccaccagcgttgcaatggtgtcaaagccccggcgatgttgctctctcaatttcatccggcttccacagagccagaggtgaaaggatggttcgttgatgggtagacaatctgaatattgttttggtgttgatcagtcactgcaagttaggcacaggcaagaatgccaaaccttcatcatccttaacaattgtggttcgcaagcccggtgacgacggcccaggagcaggcagcgcttcatcagtggcagaactaccttattatactagtcagaaccccacgcgttgccgcggggagcttaagcaaaacaaaatatttaacatatgaacaaacataaagatttctgatgggaaaatttttctatacagaacacctataatttacatagacaaaagtgtattcgagaaatattccatcctataaacctagaagataaatacctaagtagaaaaaacatggaggtgacatgattttaattggaagtacaaacatgacaaagtatgacaaatacaggtgattggctgcaagtctatgatgaacaatggactatctatgctcaattggctgttaacctaggtagcttgattccatctatgattttattaccagtattgactctcttactatgtgacgttgagttaaaagacagatcagatttcttgcaaactcatcatcactgacatcaatttgtagccagcacactctgaataatcgacaaatataagaattaatcttaatgatttgtttttgatatggtgtataatacaaataaagagcatcttcacatgattcttcgtgaactaaagcatcagatgaatttagaataagaaatgtcatatatgaagggcaatatgtacttttatgaatgataatttcatccttgaatagagcaatagatcatttacaaacaaatagaatgtcaacatgtatatgagatgctctttttttttcatctgtggatcattgtggaaatggaaaccatgatattaaaggtaatattcatggcaaggatattgcttgtaagatttgactgtgtttaagaaggaatttaccttcggaagtaaagatggaataacacgtgcagagccgtaggatattgtatgatttgaatgtaaagtctgattaacttgtcagtaattttgcatagctggcatcacaaccatcaagctgcaacatttgtatcaagacataacttaacagttagcacatttgaatgttgcgatccaaaaagaaaaataatgcaaaagcttttgtatgagataaatatgagtaaatccaatgtataaattgcaacagagcatctcctatgtatgatttatgagcctttttaccattcaacatttggtatctcgaggtacgacaaagtgttggatggcaaaattgctcatgatttatggcacatgaaaatgaattgatgtatgtatgtatatatatatatatgtatatgtatatgtatatgtatatgtatatgtatatgtatatatatatatagataaattaactggtgctacatggagtataggctccaacagaatccaccgtgtacgatgctttgagatccgtgctacttgaaaccggagtgttagacatagtaacgggttaaacccgattagacctttgtatcctcatgatttgcatgcagcgtgtgcacgacacgatgagaatccctttccatataagagcaaacatgcatgtactacctctcaaaaaaaaaacatgcatgtactaattttctggtgattgcatgataatttgtttccatatgattgcgtgattatttatttccatatttgagataacattgaattgatccacaaatttcgatgtaaatccactaattgcgttgtaattgatttaattatttccatcataccgattagtactttccattttttgtgtacatataaaatgatggagatgacacactccagtcgactcaatgctactacaccgatggccggacgtcggcgagcttattcgtcgccaagctattgcaccaccggcctgacgtggccgacatcttcttaattcgtagcgggctgctggtcgtttgcgagattcgtcaacacacaaccaggtctccgacgccaatctgttgcttttttttttgcgccgccgatcgtccgtgactctcaagctcgttcctcgccatgaaaattttttaaggtaccttatgtatgtatcgatgatttttcgttttcaaaggtattttactgatctgggagcgtaacatatgttctgtcgcgcttccgtgttgtacgtagcttcgtcgccacgcgcggctcgccgccgccggtcgtctttgagattcgtcgtcaccgccgccggcatcggtcatccacgatcgcgcagccttgtcatcgtgtgcttcgtcgccatgcaccgccatcaccagtcgtcggcgaggttcgtcaccactgtcggcgccggtcgtccacgatatgatgttcgtcgttaaccccgttactttcaatttgaattatttgattcatatgtatgtatgtatatatatgtatatgtatatatatgtatatatgtatatgtatatgtatgtatatgtatatatatatatgtatatatatatacatatatatgtatatatatatatatacatatatatgtatatatatatatagtagtactcattttccaaaaatacagctagccaccgcgtgatgtgtacttacgagacttttgaatttgaccaacactatatcttagcctctttgtttcaacttaaaaactattatagtttagattatttagtcaaattactataagttgtattataataagatatcgtataataagtatgaggtatttgtttctctggattattggagacatggattattgggttttgaaaagctaatgtctataatgacctcagctattttggatgccttgatcatccttttgtcccccatatccaccaaatacataatttgaaatagctaaaaaatattcccatatattaataaataaaacattcatgcatattttttttacaataggctgaacacaaaattattatctcttagccaagagagtatagggttggagcttggggaaggattcacgcgtggggtggggtggggtggggggcttggggaaggattcgcacgtgactggggagagaggaagcagatgtgcgtgcgcttgagggagagaggaagcggatgtgctcgacctgttgggtttgatggcgctagttggtaatttgtataaaatttttaggggtggtgggtctttaaccacccaataatctgaaaaaagcatgtttagaggagattgccagattatactaatctggcttatagattataataatctatcataataatctacatgtttatttctgattacggataataatatagactataataatccaagctaaaacaaatcaggctgacggttcataattaacaaataaaggatatactctagcataaaattataaaattagatttacttttcgtaaatatatgtttgctacaaataattatcattgggtcggtatctttaccacaagttgcaatctactacgtcatataaaaaaaattgttaacatgtcgtatcatcatttttgtgaagtgtacgtatttacgggctgacttttgaatttgaccaacattatcatttagacggtccataattgacaaattgttaacgaccaaatttgataaatttatgtcggatttggagttaaggccgaagcggatttgggaggaaatcgttaatggaaacagggtatgattcggcttcggaaccgcatctgctacagtgtgcatcggcagttactgaatcggataaggcaagccgatgtagttcattccggcaaggtgatattggaatcattgtcggattgagttgatatgcttcatgatgattgccacgtgcggatcgagtccgaagaaggcagttgtatctattaattaggaatagtttgttagtaggaaagtgtgtttagtgtcctataagtactttatgttttccttttatctttaagaaagtttctttcttgtccgataaagacttgtatcaacccatgtgtataaatatgtacacccggggtctatgtaatctatcttcacaatcaatacaattcggcgcatcgccaccttttaccttttctactttattttatcgtccgggggaacttggcacctgacgcgaggctgcatcggtgttcgatctccggctaaggggtaagtccaatgttccgccggcccaggcaatagtatcgtttacgtcggcgtcgttcaaggctgcatcagtacattcgacctcttggattgctctggtttggatgatatattgcctacctatttatcatatgtctttgttaatctagtattagaatatcaatttagctctatcggctgcttctcgttttagggtttctgccggtatcgactaaatcgcgttgctagattagattagattagacatctaccaccctgaaaactcagtcaacggctttattgtctagatattatgtttctttttatacttagtgctacatcagttaagtttgatctactaagtcatgcttagaacccataatatctagcctgcttcttgattgccaataagggtttcattggggtttcagccggtgagttatctggacgttgcatcggctcataaggattgcgtatacatataagttggatttagccgatgacaacaaaggtttcactgtttaatctaatcttgtgaatttcatgacatcggacctccagcctgtcggtgatatgggcccgggggtatcccagctagagggaggaggccgcctcaaacccacgtggctccccccgaggggggtcgagcccagggtgaagcggcggctgccccctccctgcttggggtcgagctgtcccgaccccctccacgtatcagcccacgtgtacagggttaggtgggtgcgcttaacgcccacctaaccacatttaaagcggtctatgcagccacgccatgccgcatttaatgcggtgtgctgcgcatctaaccggtcgaatgaccgatggacggtgactatataccatcgccctgtcagtgtgtcaggcggcgcgcaacgtgctccatcctatcccatcattatgatgaggggcttcacagcctcttatcccggtcagagctggtccaaccactctgaactgacccgggtatctgtttcctggtgtgaacaggaacctggaagtcctcaaccattaaacggcgaatgacaaggacgccccgcatgatctgatagaccccacgcagcagccgacgcgcagatagctttgggctaaggcacaagacatgtaattaagatagagattattttcccttctccctaggtagcactcgcagcatatgtgggatccccttagagtataaaaggaggaccatgcctagcgagagaggggatcggattctggatccccaaactaaagcttctctaaccctagcttgtacttgggagattaagaggctttgcaagcatagaagaatcatcatacacacaggagtagggtattacgcttcatagcggcccgaacctatataaatcccttaggtctcttttgtctcggaaaaccttagatctcacccgctcccccggccgaactcacaaaggggggtctcacgacctctcgctagagaggatcactcctcgacacagccgatgtgtgctttaaccttcggatcgatgattatttatcatatcattattttattacatcatcatcagtcgattacctttatatcattatctacattggacgtatagccgattgctcaaaaccctatcgctaccggctggtatcggcatcggctatcggctggaactactccatcggcttgtcagccgatcggctgttttgatctactatttgtatatcttgtcagttgcaggatcaaactgactggtatgcctgcatctcatcaagatttggacctgcacaggagctaagcagatctctcaggccggtgtgttcgattttttcgtcaacacaaattgaaaattatgctctcgcataaaattataaaattagatttagttcccataaatatatgtttgttgcaaatcattgtcatcgagttggtatcgataccttgtatgcccgccgtcgtaaaatataaaggattttgcatagaggagatatttccaagaactataaatctactctaaaatttcacatctgtccaaactgaacggggggagtaagatataacccattatttttataaaataataacataaacatgtcacatcgttatctttagcgatttagcgatttgttcgataactgactgatatatggagcattatactccctccgtcccattttaattgcaaccataaatttacgtgtccaactttaatcgtccgtcttattttaagttttttcataattagtatttttactgttatgaggtgataaaatatgaactttatatgtgacttatgttttttaaatttttcaaaaattttttaaataagatggccaatcaaagttgtacacaaaaaatcatggttgcatttaaaatgggacggcgggagtaaattactagcagcaagcagtagatcgagtgattaattaagcatttactccgtaatttattgatttaattaactaactaattaatcaagcacgtcatcgtaattaatcaactag

SEQ ID NO: 50508 - DNA, 2597 bp, Oryza sativa
gatggtggggattaatttgtgatgccccttacgttcgagaggcccttttaaaattttctatttcctcgtttttcatgcgcccattaagactcatagtactaaatagtaagtgtgctttctcaaaataattataaaaaatattctgaaaaattatagtattaatttattttaaagttattttaactaataattaattaacctcagtccctggcagcttgggacatggtatgcaaacccaagaataaaggaggagttctgggagtcattgaccttgaataccaaaacattactcttctaatgaaacatcttgacaaattcttcaacaagcacgagctcctatgggtaaagcttatctggaccaaatattatctcaacgctgacctgccccctcatgcttgcaaagaaacagggtccttttgatggaaagatattttcagactaattcctatgttcagagcaatcacgacaataacaattcaaagtggagacacggctcttttctagaaagataactggaattggacaggcaactccttggaacaacaatttgccactcttttctcctttgttgcaaaagaagatatctcagtctttggttttctatcagaacaaaatttagaaaacctgctacacacacctttatctacccaagcaatgcaggaggggcaaacaatccagtccaatctcaattgggtttcccttaatagctcagaagacacttggacatacaaatggaacagtcccctttatcggacgaaagtggtttactccctgttctttgctcatatcacacctgatctgcctctctctctcattaggaagagcaagtgtaccctgaagctaaaggtgtttttaggctacttcttgtggatcgtctcaacacaaaggaacttctttacaggaaaaatctatttgtcagcactgggcccaactgtgttctatgccctctatcaatcattgaagatttcaaacatctctttttcacttgcccctttgccatcaattgctagaactatcttggaatcaactggctcacaaaccaggacttcatgatcatgataatctctgcatgaagaagtttcggccacccctttttttatagaaaccattgttgtggatctttggaatatttggaaaagaagcaatgatttcatttacagcagctgtcagccttctttccacacttggaaatctctttttagagaagattttactctacttttgcatagagtaaaagctcaggaccgacccttctgactgttttcccgtaaaaaaaaagaaaaagagttaaaaccttgtgttagaacacaacctaaagttgtaatgttgtggcatctccgtaagtttataagcgaaagcccagcctatttaggcaccatggagttcaagttcgccgagatcgtcaatgcagtggaggcaaccatccaggttcgagtcaccgaaggatcaagggacttcagagcacggttcttcgttcgcacagcggagcatcgatgaagatttcgtgctacttaattgattctaaggacgagaagaatgtcatcgttgacgatgatgatgatggcctcatcttgtttcagcgatctgttgcagtggtggagaatagggggaattgaggctgttcatgatgaggttgaagaaggtggtggtgctactgctagctagtccggtgaccatggagtacccgttcaatcctaggacagctttgaggagcaagctagggtgggtttgaccttggtttttgcaagatggatatcacggttgctacttgattggtctatgcttccatagcttaatttaccatgcatgcagtgacgaaccctgaataaaaattaccgagggttcaatacatattaattatttaattattgattaatatattaattaatataatgtaatttagataggatttgaataatctatccagggtcctgtgactccgccgggtagtataacgtagacacgcccctgcgtgcatggctgatgctcgatgcaaagcgagttaggagtaacaggtcgaagtaattgatcgtgtgtgcttttgcatgtagtaacttaatgaaatgtatggacatcttgtgaccctaatgtgaatattaagtaatatgactttttgagttttggggcgtagtgattttgtgaactgtcgatgatggggcgtagtgtctattttgtttctcattttcccaatagttttgacgaccatgaaaaaaacttataaaaaaaactggataattagtttgttttaattatgcctacaactacaattacattatcataatcaaccgcagtataaaagtactcctaatcaattacaatatggcatgtaatctctatatttgctagattagcattcaaatcatgtgttgcttggctacagataaacttcttctctcccacccattcctctatgggtctgtttggcccaactctaaacttcggcaaatagtttcagctccacctaaaatagaaacggagcagagtggagcgctctcacaaaataaattagggagatggagctgggctgggtttaaccagcttcacaactacactacagacttaactcctgaagttaaattagaagttagagctagctt

SEQ ID NO: 50509 - DNA, 923 bp, Oryza sativa
gtctgaccaagtcagacggcttatgggctgattcagaaatatctgaacatataaacaatgtttagatcatttgtttattagcaatttttatacgtagaaaacatttatgccatgagtattatgcacaaatgccaaaatatgattatccatgatactcttatcgctgtatcgcatggatgggtgaagacagaaccatatttcctcatcaaactttttgattgaactttgaaccatccaatgtacagttatacatcaaaatgtgtttggctcaagcgcaatgtaatttgatttatcttttgaacttattggaacagtcgcaacaagctgtgttttctgaatatcatttttgtgtctcatttttgtgccgtaataatatatgctgatttgattaaatagcacattaccgctaaggaattatttgctctatgttaacaggtcctggcaaaatcttctaagatgattccaggtgagttgcattgatctatgcatgctatgtaatgtaccttacagaacattatctacatctgaatagttcttctgatcattaatttgagcttgggtgggtatactcatctgagcagtttctgtgtaaaaaaaaaagtacactggaaaattggattttggtttggcaccacaatattggctgctttagctgttagtacgacaatacttgcattttttttgtcaaaaccatatcaatttcatgacaagagcatttccattagtgctgatatttggtggtcagagtggtgtaggtaatagagcaatcagtgttaagaataacttttaacagtagccctttcatgtttcatagtctgtatagtgatgtgcgcatatctctgaccaatgatttaatatgtacagtaatgctgatgggaactatactgtatggtgtcaagtacacatttccggagtacatttgc

SEQ ID NO: 50510 - DNA, 730 bp, Oryza sativa
atgagcttcttaccggtaacaaaccaaatgtctcttactttcgtgttttcggtagtaagtgctacattcttaataagaaggctagatcctcaaagtttgctcctaaagttgatgaggggttcttgcttgggcatgggtcaaatgaatgcgcataccgcgttttcaacaacacctccggtattgttgagatcgcgcgtgatgtgacatttgacgaaactaacggctctcaagtagagcaagtcgactcacatgtgttaggtgaagaggaggaccctagcgaagcaatcaaaagattggctcttggagacgtgcgtcctagggagccacaacaaggggcctcttcctcaacacaagtagagccacctacattaacccaagccgacaatccctccacttcaagcttggatcaaggtgaagaaggcgagcaagtgccaccctctccgataaatctagctcacccaagaatccaccaaagtatccaacgagatcaccccaccgacaacatcttaggagacatcaacaagggagtatccactcattctcgtattgcaaatttttgtgagcattactcgtttgtgtcttctattgaacctctaagggtggaagaagctcttaatgatccggattgggtgatggcgatgcaagaggagttgaacaatttcacccagaatgaagtgtggactttggtggagcgaccttggcaaaatgtgattggcacaaagtggatctt

SEQ ID NO: 50511 - DNA, 5382 bp, Oryza sativa
  unsure (1)..(5382): unsure at all n locations
cctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgagccatagcactaatggcggcagttaactagaacaccctctaaagtttggttaaaagactaacttataaaacttgtagtctttataaacaccgccagcctcctgcaatagtttcggctgctgtgtgtctttggaaggtaaatatcccactgtttggactttggctatggattaagcttactttggttcaaccaaaaaacaatccctaccaagaggtagaaagaaatatttgaactataacacattgaatatattgttgacaaaaaaaatcaatatattgcttagttccaatgatagtcatgttgggttacatgctagttccaatgatagtcatgttgggttacatgccaagaataaagctaataaacttctagaaagtcaacatgaaacttttctttgcaacctgctcaacaagacttggtatgataacaaacaacacaatgcacacatattcctattaaaatgtgagtatcattaacagaactccaaagaagtaccttcccactttcgcttgcaccataggtcaactgggtagtttgcccatcagagaaccccactgtatgcaactcatcatcccgcacatacgcaatcatgctcccatctggagacagatgtgggtcaatgatgggggatgtggctgaactttgcagcttgagtacaggttcagcaccagacaaatcctggaagtaaacctatggaaatagaaaagatatatttccatgaaactcatgatatttagcatccttgaaaatttacaaaggttatctgaaacatcaaaaactaccagaaaaagaatatccatgatacgctgacaacacaaaactaaccatagatgacaataatcaacacaacagaggagttttatttctttgaatcagtagcgagatcactatttaggaacatgtcagctacctaatccaccaatacaagatgcagcactataccaagaatgcaggaagtgcgatctcaagcacagacctgcaggcactgataaactcaacttcatagccatcactaacgactacagagcaaatatggctcatcccgcgacatccaaaccagaaccataataatggtcacccaacactgccccacaaaaccaataccagccttccattaattcaacactcgaaacggaaattaatgagcctaagcctatccatgtgcagttgctgatagcaaaatcagaatgtcaacctcataccaaatccttaatccgagaaagtggtccaatacacaaggataaaagtataaaactaccgaatttgattagggcaatgcgtatcatctaatactaagttactaactcaactgaattggtaataatataaatcaaggaagaactaaatgggggaaagggtttgcggtttgagagatacgaaccccagaggggagcggcacgacaatgccggcgcgggaggcgggggtgccggggaggcgggcgcgccactcgtagcgcgtgacgccgaggccgcgctcccgtgcgcgctcgcggcggaggcgctcctcggcggagaggttcccctcctcgaggccgccgccgtcggggggcccgaagaggagctcctggcgccgctgcgcggggtcgaaggcgtacacattccggtgaagcgtgccgtcggggctgtacaggaaggccacccggcggtcgtcggggctgaagctaagcgccacgggcgccccgtagcccgggagcgggtgctgcacgatgtccaggagctcctcgttaggggaggnggagaaaccccccgcccccgccgccgcgccgtccccgtccccgctgctgccggcgccgacgaaggcgtcggcgagcggcatccgggcgagctcctcctcctcctcctcccccgcgtcgaaccgcggcttcttgcggctgttcccctgatccgacgacgacctcaccgcccccgccgcctcgcccgatcgcatcgaccgaccgccacaggcagccgccgctaccccgcaagatcgccgccccaagaaaacctcccccctccctccccaacccgcgatcctccacacccaacaacaaaggcggaggagaaggtatggtgccctttgaaggcagacgaggatctcaaatccgaggcggagatcggagtggaggaggagagagagagagagagagagagaggatcggaggagaggtggagggcgacttggagttggtcgttcgttccaagaaggggaggagagagagagagaggcggcgctaattgtaagtaagtttgttgagaggagggaggcctttgggatgtctcggtttttcgttggattggatcatggatggaagagggcggtgtgaggagggtggtgagtgagtgtggttgctttgcttgactgggtctggtctttcttgccctttgcctctctccaattctatcctaggcttccatcggttgccattttgcttaaaatggcttatttggtttattagaaaattaaagttaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggctgctatactctcttttttttgttgttgttgttggataagaggaatttgtaatggttagttgtcttgaaattaactgttctgtagatataaaatatcatactttccaatgattggatctttcttgtctcgagatgaatttgaccaaattatcttccatgtgcttctttttcgtctttaacatcctaaatagtctacctgtcttgtgttaattttggtaccatccttattccaagcacagttatttgttatgtgttttttaataacgttgatataaaccttagcttgtgtccatagttctacatattgagttttttttaaaaaaaattggttaaaagttctctaaaaattaagttatatattattaattatggactaaaattctgcaaagacacttggcacgtgtatgccaccttagtaaacatggataaggaggaatgattgcacatgcaaggacatatgtatgagagatggaactaccggtgtgtagtaatgcactaatgcgccagtatcaatagaaattaaataattccggcaatcctagaataccaaggtctggctgatgattttctcgattgacttgagccaagagcatccagacttcttcacctggcatcgggagagccctggatgctactcgatgtgatctgcttacaatgcgatgttctttgagagtgtcaacttcccaacattcctaatttgggagagaaaagcccctagcgttgctagtactttgcatggttagttgctaactgacgatgttggatgaccgattggctgagtaagcgaggtttgcctcacccagccttaagtgtgctttatgatcaacaggaagaaacaattgatcacatcgaaacatgtatctcatcaattttggcagctgatcctgatcgccatcgggcatccatgcttctttgcaaaaaaaaaaactttcttcctctcatggtggtgtgagtgcaagaagaaagtaagcgggtagcttcaccgaggattcgacaccatcgtcactttagccacctggttgatttagaaggaaaggaacaatcgagtgtttaaccaatggcaacagacctagaccgaagtgacacgtgatgcggaaaaagatgtgctttggtgtgaagttgggctgctaaagtagcatcacaatatagtatcttggtcgcacaatggatgtcatgatagataatcttgtttacactttgtgtttatgtttgtttttctttttcacttgttggctgggttagcaagatgcacattaccctcttcttaatacaaaataaacacacatcttatgcatattctgcccccaaaaacaaataatttttgtctagaagcactgtagtttgttataaatttacaacaactttcaagcggactaatacttgtctcatgggcgggggtgctagcccttgctagatagatccggtagccttttcaaaattaaacctataaatgggagacctatcatgcacatgtgaggactaaaatagtaaagaaaaaaaaccctatgtcgattttgtttctaatttcgaataattctaatacgaatagtatacggaacgaaaatggtggtatgcacattgaggaaattcctatatttcttcctcacgcaacactccatcagcaacttaggtcttgtttgaggagcttctagtaacttctcttagaatctaaagttttccaaatactgcagattcttacctagcaatggtggattaggctcatcataaaagcccataaagcaattgaaccagcccaacaattgcatgttactgtgctacatgcacccagccatcccacacgtgcaatccccacctccgctccacccgagcctcgtattggtagttcagtggcattgtcttagcatctctcacccaagcgtgccgtgcgccaagccaaatctcgcctcccccctcctcctcctcgcccttgccctgttcgtcatcccactctccgctcccctctactgctgctccatggcccattcctcttcgcaaccattgtccctgtccccgtccacggtggtcgcacgcacgccactcgtcccggttctcttcgtgatcggcgactccacggctgatgtcggcaccaaaaactacctcggataactcacccgcgccgaccgcgagttgtacggccttgagttcgacactcgccacaacacggggcgcttctccaacagtcacatccccatcgactacatcggtatgtatctatgtatgtgtcgtccccttctcggcactatggctagctcgaggacatcctagctggtctaccgagcataaggcaaactggcgcgtgctaaccatgacagggtcccgatcatgaatttgttggcgacttcgatagggaatgatcactcttgcaatagctgaaaccccacttctccaacatgggctctcgcaccaatcttgatcaagacaacatcatgaccgcgatattatggagagttgttgaaaactgatcgccaggtgtttg

SEQ ID NO: 50512 - DNA, 10251 bp, Oryza sativa
  unsure (1)..(10251): unsure at all n locations
tttctgtacaacaagattggccgatgaaaaatacccacaattccctcgatacaatagatcctagattcactcctacgatactgtatgctggtccgaccgatgtgttattgctggtcagaccggacgcatcgatcggaccgacgggtgtaataccaccagtccgactagaggcagcagccgatccgattggagggacatcaccggtcagactacgctcggcatgtttcgtagaatcagctcatgtctggtgctcctctaaaagacattgacatgtggggtccacgggctgactcaacaagattggataaactgcctcctaaaccgttcaaggagtcaatttgtaatggttttgtgagttggaggataggttatagggatgcgattcaaccatgggcatgagttgagggaagcaaagtagacttagggcctgttcactttgatgaaaaaaaaaaccttaccaaattttggtaggcaacttgccaaaattttggcaggatttcttatatagttatcaaaatttggcagcaaattaaatatagtcacttttttggcaaatttactaaaatttggtaaggttgaaaatgacatcaaagtaaacaggcccttattacccacgggaatggtgtggggtgggctggtaatataagcccagaaaccaatccatccagcccagcaactgcgaggtcggctgctagtctaacgtgcacccaagccatcaccccacacgtgaaaaatccccgctccacccgcgccgcgccgcgcccaggtagttcagccgcgcgccaacccaagctcgctcgccggccggaaatggcgctccccttcctcctcctcctcgccttcgccctgctcttcccgctctccgctcccccgcgctgctgctccgcggcccccgcctcctcgccgcccccgtccccgcccccttcccctgcggcggcggcggcggccccgcgccgcacgccgctcgtcccggcgctcttcgtgatcggcgactccacggcggacgtcggcaccaacaactacctcggcacgctcgcccgcgccgaccgcgagccgtacggccgcgacttcgacacccgccgccccacggggcgcttctccaacggccgcatccccgtcgactacatcggtacgcgccccccaccttctcgatcggcggcgccatggctgtggcccctttgctctctcgtgaatcctccccccccccgcttcaaaggttgcaggtggttctggaatcgtcgatccgatgctgctttgcctctcgtacgcctatggatgcagcatgttgtgggtttagtgtaatctgggttttgggtttctggtatacgaaggttttgcttagttgttggttcctatgaatttggggcatctgatctcatacatcgggggtatgtggatttttgcccaacaattgctgaagctgaagagtaatcagttcatagcactctcctacacagctgaccacctggatctcacatacatagactcctgcggcttcctctccttgatctcacatagcaatgttgtgggtttagtgtaatctgggtatttgggtttctcgcatgcgaggggcttgctcagttgttggttcgtctgtgggtttctgccgaacaattgctgaagctgaagagtaaccagttttgcagcacaaccaccacagtctgggcatcatttgatcctgctgttcttagcactcctgcagagctgaccacctggatctcacgtatctatatagaatcctgcggcttcctctccaaatcagtatccagtatccaccaccgttatcagccgttgaggcaatgcattggcagaatgccagaacattaagaagtgccatcataatgtacaccattagtccatgcatccagaaaacattgccagaatcctgcaatgtatccatttgatagtcctgagtcccgaccagttgtctacatgctccagtctctttgccaccacacactgttaaatctctcttgtccaatgtccaccacattctggacagtttcaaggtcctcacaggaagcacagctgcacaacctttgttaatgttgctttaagaaagtcatatctactcattagtttctttgggagagtaaggagggaaaaggcataggaaagaaacatttaactagggctactggctcactatgtgaaagatgtttcccttcaatttcatttagctggtgttctttatctcttttgcccgtctctgtcagtacttatgtttttcatgaatcaatagtatcttgttctttcttctgtttttaaattattttttccgtgatttcttaatcttagacttttttgtgcatttgcagcagagaagctggggcttccttttgtgcctccataccttgaacagaacatgcgcatgggtgtcggcagtgtcgacctcagcaacattgatgggatgatacaaggtgtcaactatgcatccgcggcagctggcattctctccagcagtggttctgagctggtttgtcctcctaacttcccaacaactctatttcacgcttataatctagcaggaatgtctttgtgagacccttctctagaggacgaatcagaaggagggtgtttcaacaacagactagaagcaatgactcttctcatagtgtctacatcctctctagttaggaagaatacttgctcaaccatttgaactaatgctgaaagattctcctgttcggctgctcccttccttccatgtgttccaactagtgtggattatcagggcatcaaattcccttcttagttcctaggaattcatgacttatatatgcttcctaccagatgtgagattgtctacacgagacgattgatatgctggtgctgatggggggtttatttatgctgctggccttgtccaagtttgcttgtgaagctacagtgctataagttgtatggttgttttattttcctgcacgcataaagcaaaaggagatatatgtagccatctactcaaagctaatttatcataatttttttattgtctgaaactaaaaaactgcatttgttctatactatggcttttgggatgatcaaggagttagtaagaatcactgatccggcaccaatgtgatgaaattgatgtatatcatcctgaacattccattttcatatcaatctttattcctgcttatgttgttgaatctccaatctttgtgcccaaaacaacaaaaacttgtggagctgcaaatgctaattttgtcatttcaataaaacatcatggtggtgtctaaagaggagaaatgtttacgtatgaacattgctgcaaagttttcctttatgtggctatatgttttaactttctataaaggattggagcctcttggttagagtcaagcttgttgatttgcataccttttcattattcttaaatgtacttgaaactaaatcgacatgatcattaactatataacaccagtctaaagaacaccaatctaaagaacacacttaatgcttctctatgaaggtttctcttttggtatgtaatacttgctcatcggatgtatccttttttgttactattttgtctcgtgaactatacatttgaagattattttgtggtggtattctttactactgcggcattccagcagctgtaaaagtatgtgcaattatactgttaaaaaatctccaacattggcagtcccctagcttggaatctgtcgatattttctgtgtttatgttatgatttcttgcaaacatattttagattcttaaattttaatggcgtggttgttctagcttaaatatgtttagaacaagggatgtgacacctttactttgtgcagaataaaccttcatgctgatctcttgtgtatcaagccttcaggctaggggtgtaagtggctaacccgcgaaacccacttataggctaaaataagccgcgaacccgtttattttgacctataagtgggttcgcggctgacccacttacagccctacttcaggcacatgaggatcaatcatttcatagtgtgactatttgtagttatctgtatggccgtaaataatggcctctatattgttctgtattggagtatctctctactatttttttctctgaagaagagcattcttttacctatttttggttttcataatttaatgtgatgcataatttgattctgttcttttttagataaaggaggctaatttgattctgttcttgcaattgtggatgcactgcagggaatgcatgtgtcgctgagccagcaggtgcagcaggttgaggacacatatgagcagctctctctggctctcggggaggcagcaacaactgaccttttcagaaagtccgtgttctttttctcaatcgggagcaacgacttcatccactattacctgcgcaatgtgtctggcgtccagatgcgttacctcccatgggagttcaaccagcttcttgtcaatgcaatgaggcaggaaatcaaggtgtggttattgttctccagtttattctctctgtgcaacatttcttgcctccttatgattccagttttagttttttgatcagtgtgttgcatattgcccaaaggctgtagtatcgtgcttagcagtggccaatgttgtgagtatgaatttgatccgtaatttacggcccgtaaatattctgtgcttgaaaggtatctgctctcagttccaccacccagatgtgaatagttctttgtactcctggttaggaatatgtttgagaaaaggaggagtgtggacctctggggactgcagatacatgaattatggaaaactagctatgaacattaatttttatgtttcaagggctagaaaattttcaaatgtttatagagaaacctgatatagtacactttttctgtaggttaaagttttcaaatggtggatgagtttaaaaccgtgtacagttttggactgaagcttctttgagttactgaaatcctcaggctgtacagtttttctgtagttatgaattaggttaaaaggataggagggtatttcatctgtacatttgtaatatgggaaagttaactgataaatacatggaattgattaactcaatggatatttatatcgttggctgttagcagttctgtggtgttatgtactttacattctccgtctaccgtaccttagtttcagatttgaggtagtacgttgcaacgttgctcaacaaggacatacttgttttttatatgttcattttgaattcttaacattttgatcagataaggcggccccaaatctgatagggactgatgtaaagtcgatactgaatattgtcttggactgaatactgtgtttgagtcccttagttcttggtctgcgcatacttccagagtggattgtactttgtactgcctcccatttggaagtgcaagctaaatgcgtgttacttttgctcaacttgtaggacaccatgcacactaccaatatgcccatgatcttaccatgatacaaacataattctcacatcatgcataaatgcataatgcacaatttgattttctccctaatttatcccctttccttttttgaacggataattttaatttgcaaaagaattggtaaaaatggccccaaatttctattcagtaaatctttggcagagcatgcgatgcacattgattgaggctgcatgcgccatgagtttatttgtactgtccaacatttgagagcagaaatttctgttaccattgtactcatccaagttgacttgagatgttgctttcttgtttcttaaccttagtaaatcagttacaatgatgcatttttttattatttagccatatgcagttcttgtcagattagattattaagctatttatatctatatataagagttctgtacttcctgcagaatttgtacaatatcaatgttcggaaggtcgtcatgatgggcctccctcctgttggctgcgcacctcactttctctgggagtacggcagtcaagacggggaatgcatcgactacatcaataacgtcgtgattcagttcaactatgccctgagatacatgtctagtgaattcatccgccagcacccaggctctatgatcagttactgtgatacttttgaggggtctgtggacatactgaagaatcgtgaccgctacggtgagcagatgtatcattgttactactgtcagattgcctttctgtccttagggaagaactcacattacgatggaatcacattgtgcaggttttctgaccaccactgatgcctgctgtgggctggggaagtatgggggcctgttcatgtgtgttcttccacagatggcgtgcagcgacgcgtcgagccatgtctggtgggacgagttccaccccacggatgctgtgaaccgaatcctggctgataatgtgtggtctggtgagcataccaagatgtgctatcctgtggatttgcagcagatggtaaaactcaagtagaactgaaccaacccttaaactccattgtagttacttgctcagcttttgtgattttctgaccaaaaaatgaaaaacttaacaaggcggcacggagaagtgtatatcttgagagctagtaaaattttttcgtagatacagatttgtgtagaaataccatgttcatatgtgggcactgcactgtaaaggatctgtatggccaaactgcatgaggtgcttggtaggtgaacataaaacattgctgagaactcacctggtgtgcttaactccccaattctcacatgttttgtttaacttctgatacggttatagatttatggtgaaatgttattatgtgttgcagttttctgcttttctggtgaatccatatgggcaacatcaaaggtatttccaagaacacaagttttatggtactctggtactagctatgttctgttatcaactgatttatcctcttatagatcaaaacactgcttccactgcctcctactgcactaatcaacaagcagtaacatcttgtcctgctttacacggtcagtttacaaaatacagccttgcccataacagagagacaaattacaacctccatatcaacatgccccttaattacaatcaactcctcagctgaccaccttgtagcttgtttagattctgatttgcaatcctatccttccaagtgctgacagctggagctctctctgttgctgcaactagagaaactctgaattccaaagctctgtatctgaagtcctgatgctttagcaagctgagctatctctcttcccatggtttggccatactcataagagaaaaatataaggaagagcatggagagtagctgagtagccatggatgctacaactcttcatcatcaactccagagttgagaacaaaactggggaatgccattgttatgtccctgaacacgaaaatcgacaaggcaatacatcagaatttcatttatagttgaaagcaatgtaaaaggtaactacggtgaagagaaacctgaaaaattgtagatggtacttacttcaggtatgggagggtcatgttcttcagcaaagcagggtttttacttgcgaacgccttccattcatccgggtcgatcttcccgtcgctgtttaagtctgcttgcttgaacgtctgtcaaaaagtagcataaattcaaacttcagttatatggggaagaaataaattgagactagtattacatcttcatgtgctttacctgatccacaatctgctcaacagcgtcatcagaaaggagcagatctgattcattcagaatggcgagcaccatttcgtacaactgcttgattcataagggaaaaaaaaagaggtttcagtaactttaggattttctctgtcaaaatgaaaatgcagtacaaatattgttccgaaacaatactttgtatctccagttttccacgctcagcctctggatgttttaggatttaaacaagtctttaacagggttcaatacatatattcttcaccatttatacaaccattatttatgcatgttttctttgatatcgccaagaaaactggtgtaccatcgccatcagtactgaaggctagctatgcatggaaattacattatgttttgttatttctacaaaatatagccaattagtcatattctttagataatggaagctttattgaacccagccaattacacatcaaggtgttcaatggaaagaattaaggatattgtttagtaactcaatatacctcttcacgttcgatgtatccagttcctctcagatcatacaatctaaatgcaactgcaagagggaatactgtcagatgccaaaccaagaagtgatatatgaataaaatgaagattgatatgacatgaacagaagacaaaatttgactgcaaacaactccaggatgttgaaaagcaaatcatgacaaaagatgaagatgattcttggcttataccagaatactctgaccaactaactgacttatttctgcttctatcttttaaaaatccttgattaccagcaagtattgttttgaggtagttttaatattagcgactaagctatttcttaagacaactgagaaaagaagattgtaattaagtacaacttaaccatatgcaatgcaatgtggaagggctgaagtagggtatttcttacaggcaatcttctctgccaaaggcgtttccgggtgaaaaatgttgagggatcgaacaaactccccgaaatcaataacaccattgcgcttaagatcaaagagatcaaatatctgcttgaaatgagaagactctgtcagtctttcacacatctggaattgttctataatttaacggaaaccataaaattgtgcttaattagctcagaaaagcttttgcagtgagacagcaaaatactcagaaattcaaaaaaggcaaaccgacccgatcggcgaaaaggttcttcttgttgctgttcctgaagagtgctagctggaactcctcctgttcaagaaaatggcagttcagaattgacaaaataccagaatttcaataccaaatggtcacttttgtcaaaaagatggcctccattaaaaatgaaattcaagagagttaaccttgtgaataagcccatctttgaatatggaatggcttatcttcttgaacagctcatacagggcctccacctcactcacagaaactacaagacgtaaatcacacaggagaaagcataattaatcactctccattcctgaactgaagaatggtgtaattcagtgagttcttacatgtggtctctttggccaggatagcaggatcctcatgctctgcagctcgtttgaactgctttgatgatatgcagcccatacaaaccacacctttatcttgttgttaagaaacggctttcctgcataaagtgataacagtcacctcaaagaacaggataaagaggctgctaacaaaaaaaagtgaagtgacatgaaaaagttaagtgaaacattaaaaacacaagaaacacagccaaacaacaagacctcctttggaacagaggaattagactaaatcggatgaaaatcccataaaaattcctgcgttccaaaggagccctgaatcgacaaacacagaagaattaatctcacctagggaagaaacagaggtgcctttgaacttctggacatcaagaagaagaagttgatgagcaaaatagagggggggggggggggggggggantnnnnnnnnnctgngtgtnccaaatacctccaagcttattgcagatacaatggacatagaagaagaagatggcacatatatttatatatgcacatgcatagcaagcatctgggctccacagtgtggcacagccccagctgtgccgaccgtgtgtagcaagagttgacttgaaatggttccctgttacacgatctgcaacattaaattattactactgttttatattgctcaagttcagcatctgtcattgctgaaaaataatcagcaatggcgggaatagattaatactagtagtttacagtgtgtatctagcctagatgtagcaatatatacttgttgagtaatggaccataagaacgacggttttgttcttagttaagtgatgttaactaggccgtaccaaagatacatgcatccaaaacgggcgtattgtgattgatgtttaacgaaaaatgtcaacgtcgccttgtagctatcaagcgtggttttttttatatatatggaaggagggatccaaaggtgacgcatgctcttccgcttaacaagggatggagcgcctgttcatcaaggacctaattttggcgttattttctcccgtctaccgggaggtactagtactgggaggtacaaaatcaaatctgaccat

SEQ ID NO: 50513 - DNA, 1941 bp, Oryza sativa
atgagtttccaacacttaacttattttcaccgttatgtcctctatatttagagcacgtgcattgttactttttaggggatctatggaagagagaaggagagagtccactctatacgttgcatgatttttctaaataggtttcaactttcaaggtagtaacaagtactagctatggcaccgaatttcaaaggagatagagggtacattccactactcatgagaggaagagatcaatccttaaatctacttttaataacaacagatctcacccgtaacacctttgctagttctctacattatagatttcttaacgaactactattctcgtggtgaatctcactcgtagcatcttcgctggtcctacacacatcaaccatgctcttagagcaagtttaatagtataaccaactactacctccaatttatctatagccattctaatagctcgttcatacaatagctacatactatactattaatacacggtcccacctgtcgtgtcttgaagtccgtgctacagctggctataaatctgtagcccgctgcccttctctcttctcatttatcttcttaaaatatgtttgtagctggcttatagcatgctattgtacctgctcttagctagtcactcagttagagagacaggagggggagagaaatggccctggcggcacggtggcgtgctgatgtacgaaccatatataggtgtagtagactaagcacaaggttcaaattaaatttgaattagttaccccggtaaaagcttgttaaaagtacctacagaaaatcagcgtaagtctaagggtaaatcaatggagaaaaaaaaacagcatatataaatcgtgcaggatttcgcatgaacagagtgtcaggcacgcgcatcagaaaccatatcgacaatgacgagctagccgacgacagcgattgcctggctgccaactaggatatatataatgtaacaagaaaattaattaattgggtgagatcgatacgtgaaacatgctgattaattatcttttaatttggtccacttgtagtaagtttgttgtgaaaaccaatgatttctaattatcaggggaaagtgaatatattaacattgcccgtggaactcgaatcttgcaaaatatttggcagggaaagccaatcagatgctaaattcaacccacaccaagctaccatgttgtttatgtacacttggctgcagatgatagtgatatactataggctgattgtatccagacatcttatactttttcagtaaagctgggcgtcagccttttgttctaaaattagggttgaaagtgattcgaataatttccatccgaccggaccttttttcggattcggatagtttcggtcggatatatctgaaaatttttgaattcggatttttttttcggatatgaaaacgaatatgatataggtgatatccgtcagatattatccgatattttccgtcggatatccgacttacacataaggctgccataatccataagccagcccaacccagaggagtcaaatcaaagttcttgaaaaaaatgaatttcgaattgaattttatgatactgaatgaactcatatgaaaaagttgtcaaaaacaaagttgtagaactcattaagatctaccaattttattttggtcatttctccatccgagtttcattgaactatataaaatttgaattttaaaatataagaaattcaaataattcttcgggtagtaaatgatttcaaatggaaaaattgtcaaaaacaaagttgtataacttaccaagatctataacttttattttggtcattttcctatatgactttgtttgaacagtttgaatttgaatttgaaaatatgacaacttcaaacaatattttcaaatactaaatgatttcaactgaaaaagtcatcaataacaaagttgtataaatcatcaagatctataa

SEQ ID NO: 50514 - DNA, 6165 bp, Oryza sativa
tactgcttcaaaatatcatttgaagttttgaaattcaaatttttaattgataaaacaaagtcacaagaaaaaatggccaaaataatagtagtaaaaacacaataacatgatagagcatgattttagaaacatttaggaaaaagaatcatccaatttggagttcttatgagtgagataaactagtttcaaatttttaaaatttattttcgcatacggctcattaacgtctgtatttttccatgcggtctcttaagtggtccgcatgcaaaaatgggctcattttggcatcttaaggagtagtatgcgaaaataccaatgcggcaagttgtggtccgtttgcaaaaatcatagggtcttgtacacaaaaatcgtttgtgtagtattgaggggtttttatatttcgattaatattcatcaccgtattcgcttcgcttcgtattcactccatatttgtattcgataatattcgatttcgttttcatatttgggtttccgattccgattttgattccgaaaaaattatgaaaacgaatataatagagctagtttccgaccgtattcgatccgttttcatccctatctaaaatatagtataggctgataaaataagatgggtcgtaactgtcgacgtttgatagtcacgactagggaatttgaatagtatgggatcgttggtaccagggtatatgcgagattgaggtaaaagagatgcagacagtgatttttatacaggttcgagccccttatctgataggtaatagccctacatcctgttggccgaagccggtgctgctctttattcatctggatcacacaaatacaataattgggataatctatctatccatcgtcgacttggcggctatataaccaactcgtagtcgatgacagggtaatcttcctcctcgaatctgtactcggcgagaacagagatggcgctagatacctcttgccggcccatgtaggtgccggatagggcatggctaggctaatctctgatgttgatatacaacggcgtattggcttgtattggcttgtggctttgtagattgtggtgggtgtgtcccctctcctcctagggggcttgtatttatacccacaggtgaccccttgtccaagtagaactagggagataaatatggatacgatctgagtagtgagtagtccttgtcgtttctatgtagaactcttcttctccttccttatccggaactccttctatatacgaggttttttttccgtataagacatggcatgtggtgggccttgccgagcttagtcgattactattgggtatccataaccctgacagtaaaaacttcttaacaatgcatgcaaaaatgtattcttgagtaattaaaggtctatatttaaagaatatgacaaaattaaatatatattaccataatattggttacaaatataataattctttttttaagtagatatgattaaggttcaaggggaaaatttctattgccccttaataaatgagggatgtttgtgagtgatggtggttaagagtaagatgaattgaatgaaaattgattgacaagtactagtattcagaatgcttatgtttatgaactaatgttaaaccctttagttgattgactagggagagtacacacacacatatatattttatcaacgcttagaccattcgtcttattcaaaatttttgtgtaaatataaaaatatttaaatcatgcttaaataatatttgatgataaattaagtcacaataaaataaataataattacataattttgttgaataagacgaatgcaaacgtataaaaaaaatcaacggtcatacattgaaaacggagggagtagcgaaagagcttgtagcctagtggttagagcctcagtagcaccttaggtcctgggtttgactccccataggagtgaattttctaggatttaatggctttgtgctttcagtggtagatgacgtacccgtcaacagcgaagcgtctgtgttaacttcgtcaatttccataatttgccggcccagtcttcgaagatgctcataggggtgagtgtgcgtgcattgtgagtgtctgtgttgtactgtgtaatttttttttttaaaaaaacggagggagtatataccaatcacctattcaaccacgatctagctagatcaccatctaaatataacaactcataattttactcttttattacttaagcaattccacttgtgaatattttttttactcaagccgtttggcagttggcaccaatgtactcacaattttactctttttacaatatctatttacatattaacactaatgtaaatcatactcaagttgttattgtgcataaaataaaaccacatataaaaccgcacatgagttatttaaactggtttcagtacttcatgggtagaatatgcagtttcatacttggggtagcagaccaacctcaatcggtagtactacatttataaaaaaagtatatgtttcttatattatatcgcagctagcgcactgtataccttatagaatgttatgatgtgcgggaatgaaattttacgtgctatgtatttgtgtactttgtatataaatgtgagtaaaaagttttactcacaacatgtggtttagcccaagcggtttttatattatgcgactttagatgatagtttgtttgaataaatttaggcagttgaaaaagagcaaaaccttgaagttctgtaatcttgtttgataaaactgcttttagaccttgtgagatgcttttctttttcatttatgttgccactaaaccatgatattgttccatcctgaaaacataaaacaattggagaagaattgacaaccacacatatattggagaaagccgaaagacgagtctttattacaagaaacataaaaagcaaaaggctaggaacacacaccaccgttgggacgacgaccggccaggcttaaacccaccaccactcaaattaagacgcaaaatatagttaagctggtcaccattatttataactcctcaataatacaaaagattaatgatttctcgaacttaatcgaaattttccattatttgtaacacgcttaattctctgcaaaatcttagtttaaaatcatccctacatatataacctgtgaatctggcatattaatatagccaaggtcgtcgagtcgtgctcgatctgtggacacgagcattctgatcaaaagaagaggaccaaaatttcctgagtgaaattaaaaggtataaatcaaacccctgtccgccgtgacgacgagctgtcagccttggatgcactgctcagatgatgacctatcgattcgtctacgtaagggcaccaaatttcatgttataaatcgttttatcttttttcttaatcaaacttgtttaatattgatgcagtttaagaaaaacataatatatatattttttaaacacaaaacatattcaatgttagatttaattaagctaatttattgttttaaatgtttttatttttttctataaataacttagtcaaactcaacaaagtttgattagaaagagttaaaatgagttatactccctccgtttcacaatgtaaatcattttagcatttctcatattcatattcatattaatgttaatgaattttgacatatatatctatctagattcattaacatcaatataaatgtgggaaatgataagatgacttatattgtgaaacggaggaagtaatatggaacgaacggagtatattcaagtcctgtgtatcgatcattcatgtatatgatcagtcggaatctcaggttgtacatgtatgtagtggtagacacctttgatagctatccattttcacagtagtttcgtgtgatctccacagcctccacagtacatgagagatcgaatgaagagggaggctctactacatatggtcacctgcggtccatctgtcccaggtcaccaccagtacatatggtcactatatatatatatatatatatatatatatatatatatatatatatatatatatatatatatatatatatatatatatatatatatatatatatatatgttgactgatgcatagtttcccatgcataaattgtggtagtcgatcgataatatagaccctgtttagatgtgactagtttttagtccctatcatattggatgtttggatactaattataaatattaaatatagactattaataaaacccattctataaccatggactaattcgcgagacgaatctattgagcctaattaatccatgattaccctatgtgatgctacagtaaacatgtgctaattatggattaactaggcttaaaaaatttatcacgcgaattagctctcatttatgtgattagttttataagtagtctatgtttaatactccaaattcatcagatatgacagggactaaagtttagtccctagatccaaacaccaccataatgcatggctgtagacgcgagatgaggaagcgtatctttggtgactagaaatttagttagatttacgcctttatggatttatatattttatagcctctctctatatatattgcatatgttaaaggggattatgggcatgcatacataagtgtattatgtgcgtatctatctttgtgttccgtgtagaagaaataaaagatgtggctacctatcttactataaagttataatccacaaatcttaaagcttaacatgcaaacatgtcacctcatcatccacaagcaataattacatacaaaacttagggcctgtttagatgcatttggaatggcaaatggcaaatggcaaaagtttggtggcaaaagttttggtattgcaaaactactagttggagtttagatgcatactaaacttttgccattctgtaggatcgagatgtcgactagagggggggtgaataggcgatttaaaactaaataatacctaatcaaatttaacctaagttgctaggcttggtgagggagaactctaactaagcaactaagttatgttttgcaaacctagggtgatagtggctcaaatatatctctaggaaagtaaatcacgctcctatgtcgatgttttgcaatcctagggtgatatgatctcaagtgtgtctctagaaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagctggcccacggagaggactacccaagcctcgatcactcggggtagttcttccttcactccgaaggtggtgaactctaaaccactcacaaaccggcgccggacctcctccacaatcttctcggagaggtcaccgggcaactcctccacaagccgtctaggaggcggcaacctccaagagtaacaagcaatgacccggtgtggagatgatcaagtgccacactagctctacaatggaagcaaatgcacttgactcttggctaaacaaccatctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggctggtcagaccgacatggggtgcccggtcagaccggcctcggctcggtcagaccgccatcggctcagtctgaccgactacggctccgtcggctctgtatcggccatcccgagcagcatcatctcggcctccaggaggccggtctgaccgggaaagtgccgccggtcagaccgccactatgtagccggccggtctgaccgcccctggtcaggccgaacccagtgaatttgtgtaatgaaaaagagagcacaaatgaaaatgcaatgacctaatgtggcaattaaaatcatctctttgctaggtcattacccctcttaatagtgcggcgaaactaaaattaaactagc

SEQ ID NO: 50515 - DNA, 3299 bp, Oryza sativa
ccaccgccctcgcccggcatggcccggccgccgccgtggccgcccccgcccagcataggctcggccgccgccgtctctccccgtcacgggcccggccaccaccggccgcttctcctgcagatctgaggaagagaagagaggaaggggagaggaagagatgagagggaaagaggaagagatgaggaagagaagggagagataaagagtggaggggaggaagagataagagggtgacgaggactcagatcgatgcgcgcgcacggagaaatgatgaaagagagagagcgagatgtgggaaactgatttgtagtcccggttggtataaacaaccgggactaaagatctgatctttactcccagttgtttataccaaccgggattaaaaatattagaagacttgccacgtcgtgccaaaaaagattatctttagtcccggttagtgttagatcattgcacttttaaaccgggactaaaaatgctttttagtcccgggttttttaagcaaccgggactattgttgtttttgggcaaccaatcaaagatggtttctcccgtagtgattggacaagtatttttggaaaaaaaaaggctacatcttgcttaaaaagttaaatgcatatgcatatgcaattcaaaaggcaaagaagagagagaatatgagtgggattggctgagagcgtccgaaagtattttcctcgtcttcctcgatccacgcttctcgcaagatccgatcgactcgatcgacaatctcagctgctgttcgttcgtgcgtgcgtgcaaccggatgtgagatcgatctcccgtgcgctgtgagacgcgcgtgcggagatcgatgaggaaggaggagctggactacgtgctgatcccgctggggatggcgctcatggtggggtaccacgcatggctgctcctccgcatccgccgccgcccggcgaccaccgtcatcggcgtcaacgccatcaaccgccgcatctgggtccgccacatcatggaggttcgtccgtacacttgatctggttttggtggcgagcgagatgagaatgagatcgccggagtgacggggttcgggtggatacaggaggcgtcggggaagcacgcggtgctggcggtgcagacgatccggaacaacatcatggcgtcgacgctgctggcgtccacggccatcacgctcagctccctcatcgccatcctcatgtcctccgccggcggcggcggcggcgatgggctcctcccgggcgcgccgctggtggtgggcgccgcgggcgagacggcgctgtcggtgaaattcttcgccatcctggtgtgcttcctggtggcgttcctcctgaacgtgcagtccatccggtactacagccacaccagcaccctcgtgaacgtgccggtgcgcctgatccagcgccgccgccgcccgggcctcgccgtcgactacgtcaccgcgacgctcaaccgcggcagctacttctggtcgctcggcgcgcgcgccttctacttctcctgcccggtcttcctctggctcttcgggcccatccccatgttcgccgcctgcgccgccatggtctgcgcgctctacttcctcgacgtttgcgacgactgggaggaggaacaccaagaccacgacgagcaggatggaagcgggagtgatgagagatcaggagaagcgaaggtctgagcctatgtgtgttaggatgctacgtagataatttttttttaaaaaaaagtacttcctccgtttcaggtaataagacgttaagtcaaaagtcaaactagtttaagtttgactaattttttagaaaaaaataatagtatttttaactcaagactaacatattatgaaaatttatttaattatagatttaataaaagtatgctggtgttgtaaatattactacatttttctatagagttagttaaacttaaagtagttgattttgaccaaagtcaaaacgtattataacctgaaactgaaacagagggagtaatttgaaatggataaccaactcaattttccgcaaaaaataataaaaagttctcttgtatatccacagacactgcacataatcagtcctgtgaaataaccctccctaggatgagcaaaatgcaagaaacaacatatgcaacgatatatcgctgtaacaggcaagcaaatcttacgaatttgtgagtatcaaaatataagtaatctctccatcccagaaaaatataagaatcttcgattagacaagacacttcataaaactacaaatttgaataatctacatgttcagaaatgtcttatccgattctaaactattaaattttagacattttagaccgagggagtactaaataattaaagaaccgcagcatagtaataataatctaggtgtgcaataattaaagtactactagataactagaacagaaccgagtcacattctaccgtaatttacctaatatatcctaatccacaggtataaacagatcagaaaagatgctcatcttgaccccataagtttatcctcgtcgttttcacgctctctccctatttacacaagtagatgcacctgttatcaacatagagatgcataattctctcgatatgtggttgaacgacaaatatgttcactttatttatataatgttagaggaattttataattattaagatgtaccaaaatttagtacaaatttggaaggtcaaatttggtaccttccagtaccggagggagaggtacaaaattttacattgggggctgttcaaattgatgtcatttttaaccatactatttttttttgcaaaactatcaaaaaaaaaatattcacgtttagttttgccaaactttggtaaatacataagaaatcctgttaatgcctaaattttgctattgccaaagtttcataaggtttattttggctacaatctaaacatcccctagaaaatagggaaaagtccattttacaccctccaactctttgttttgtctaaaatacactcccaaactctaaaaccggatatttcacaccctccaactttcaataccgttcactttacaccctcgagtggtttttcagctggttttcgcctatgtggcattgacgtggaagtctagggtggaaataaaaaaaataggaccaaatgtcagtccatagccacggaggcaaccacctcttcttcttcttccctcatctcctcttccctttctctctctatccttcttcctcccagagctatggcagtggcattcttgagctcgtggagtaggagatcggtggtggagactctttgaggcgacggagctcaaacacattcctagcctttc

SEQ ID NO: 50516 - DNA, 1753 bp, Oryza sativa
ttccgcgcagggcagcaaggtccaccgctgttgccactctcctcgctggcgactgcgtgcagagcctttcgctggcgactgcctccgcgaccatggcagcgccgccgccctcgcagctccacgctgacgccgcagccaccgccctcgcagctccacgccccgccctcacaaccacacgccgacgccacagcctatgccctcgcagctgcacgccgatgccgcagcctctgccctcatagctccacgccgacgccgcaaccgccgcccttcgcagctccacgtcccgccctcgcagctccatgccgatgccgcagccgccgccctcgcaggtccacgccgccgccgccaacgcgaacagggcagggagggagagagagtgaatatgggcttggcccatattatgttgtggactgacgtggcaagggctgatgtggcatccgacgtgtcaaaaaccaccgtaaaaacagcccgggggattaagcgtccggtattgaaagtttgagggtgtattatattcggttttatagtttggggtgtattttggataagcataagagtttgagggtgtaaaatggacttttccctagaaaatatatgatgtctcccaatatcttcttaataactataaaatcactcataattttaaatatataatatgtatatggcatgtttatcaccagcacgtctagaagacctgatggagcaaggaacttacaacaactaatcaagaaaacagtagatcaaaattaagaagaaaaagtgctttcttgatcaaaatcaataaaacaggagttctgggctagctagttgctaccaaccatgatcagccccactgtcttcttcattgtcaaatcttcgtgctgaagccaagggtggagctcggaggacgtaggagatatgctaccggcgtgaaggctgacatcagtatacaaaggtcaaagggggcaagcgctctggatttttcacaatttggtcctttcaaaaaatcatttcgcaaatagatacctgaaaatacttatcccaaaaatggtcctttttgagcgccagagtcgctggcgccgtcctcctaccaccgtggcaggtcggcgctgaggtggcagggggagcgtgccaatgtggctgccccccccggcccccgcattttttttatttttcttttattattttgatattttttcatggttaggaatataccagaaccaaccatagaaaaaatgaactcaaatggacgaaatacgtgacttgtagaatttttcctctctagtgtagatgagagagatgtgcaacttttttatttttattttattgatatttttttcatacttaggaacccacaagaaccaaccgtagaaaagtttaactcaaatggacgaaatatgtgacctgtaaaattttccaaagctctaccgaaaagcttctcgtcttgaaaacacaatcttgaaagctgaatttggaggttttaatctcgctgaactcagcaaagccagggagaattggatgtaactttttctgtagatgtccgtggatatattatttgcctgattctaagtccgtatgagaaagttacgcctgttttaagaaatgacactcaaatatagcagaaaaaaccctaacttatttttttataggatgtaaaagaggttaaaaaaggctaatagtatgcaaaatctaatctactttttttggtggggggagagggggggggctataggaaaaccaaaacaacgaaaagcatggatagcgcgggggaggg

SEQ ID NO: 50517 - DNA, 6151 bp, Oryza sativa
ggtaaaaatggcggccgggggggggggggggggcacccactctggcgcgctccccctgccacctcagcgccgccccaccacggtggcaggaggttggcgccatctactctggtgccctgaaaagaaccatttatgggataagtttttccaggagtttatttgtaaaataagtttttcaaaagtactaaattgtaaaaattctagggcaggcgccaacattagcgtggaggatgggggaagggagtagaggggaggagccacaatcgcgccggcatgaagaggttgggagaagggaggaagcggcaccgccccgccggcgtggaagtggagatggagaaaatggagcgtcatgtgtgatgatgtcagggatcgatgcttttaataattcggtgaagcaggtgtgttcggcactttcccctctcgtttgccgcgcgcatgcttttcaaattgctaaacggtacgttttttctaaaatgtttctatatgaaagttgcttaaaaaatcatattaattcatttttgaaaaaaatagctaatacttaattaatcacgtgctaatgtaccgctccgttttccacgcacactgttcctggttgggaacctccagtagcaaacacaccctaagggcatggccaacgcagggtacccctcaaatgccacgtgggatggggcaacactctcaaaaagctaatttcctactgtgctagtttctccaggtggtagcctcatatttttatttcagtccttggtgtttttcattttagttctcacaatttttcaatttatatagatgtttaaattttatactaaacaccctaaaatctagaaattaatataaaatctctcctcctccctcttctccccagtccccaccaacaccctccccatttcacgcctctatagctctcctctcctctcctctcccctccccggcagcgatcgaagcggcggcggctgacccatcgacgcagtggcggccggtctcgacgcgccggcgtgggggggggggggagcgatgcgaccgttctctctagtccaccccctctccatctgcttccccgcgcgggagcagcaacggcgcgtggcgacggcttgaggtgaagcatctccccaacgcggttcctctcctgtttcttgcccaaaagcaccgaaaagctgacgaaattatccggccctctgcaggggtcgcggcgctctaccgggatacggtcctgtccgagctggcacaaatatactccttggaaggggtgagatcacgctccacgttggagcgttgggcatggcctaagtttccactaaagctggtcttttcagtttgggcctgctcaaattaatttatgagacaggccggccaacaagcccaatgggcgactacgcccatccctactatcttcccccactaacgtgcagcctgtttatttggcgattgttactgctacatccgtttcaggttataaaactttctagcattgtccatattcatattgattttaatgaatttagacatacgtatgaatatgggtaatgatagaaagtcttataatatgaaacggaggaagtacttggttctttgtaattgtgactttgtgcatctccctagcttctaggtgcaatgaatgatcagtaaattgttccattatgagtagtagaaaagcctatttgattgtcaatcccttaaaagtacagtaagtcttacacgttaacaagatttggtgagtccaaactccgaagaatttattaattaatgatttatttatttattattatgagctagataaagattaaagattttccttttatttcatctttgctataatattttcctacttccgtttcattttattagttgctttgactttttctctagtaaaatatttttagatttaaccaaatttattaaaaaagatagtaacatttataacatcgaattagtttcattaaatataacattcaatatattttaataatatttttttgtgttaaaaaatattactatatttttctataaacataatcaaacttaaaaagttcaactaagaaaaaaagtcaaactgacttagtttagaagagtgtaggtaaggttggctgattaactgcttcgcaagatttttttttctttttatcttttctatatctaattcttcttctttttaattttctttgtttgaagagtctgttactattgtggcagtgttggttcattcatccgggagtgcgtctcaaattattctatccacccaaatcacagtgtgaatgccacacatgacatgatgggaggttggtaacaaacttgtggaaaccaggagtctagggaaaaaaaaaaacaaaatcttctcactgaaacaaaaacgtcgattatatatagttgggtttattcttcttatcgatcaacttattgtgacacattccttagcatggaattcatacatatatataccaaattaccaatccagaggcatacaaaaaagatgatgaaaattaaggaaagcacacatacacacccaggaaaacctgatcaactactcgtcaatggacttgcaacacgaaaagatctttattataaaatcatttcatctttatcaatcgcttgaagttaaccggcgcagtgaaccgggcagggccatcgtaaaatgcagaggcggctagcttagcagcccgctcagtcgtgtaagaaagatcccaaaaccagtactgcttgcggttttggcagggtggttcatgttcaggtgtgcaggggggaatacagcatgtgctgttgatgttcacaaaccctgcacatacaagatataaccacaataaatacattagataaacaaggacaagtagcatttccatggtttgtgttacagtccatctcatgatcctctatcccaaccacaaaaaaagtgttcaataatttcgattgacttaccgtaagcccgagggttcatgaaggtggcatttgagaatgcgtagaagtcggcgatggagtaggagagaccactcagctgagagctgagattggaaaagaggggcttgaggccatcgttgaattccctagcgagactgttcatggagtcattgcagtcgacattgttttccaagttcttcctcatccatggctgacaccctaagggctggatgttgatgatcccaaacttccttgcacccaggccatacaactgcatgattatggccttgtaggaggaaagtgtatatggaatgttgaatggtgatggctttctggaatatcttaatactctccatatatttacagacagatccatggtaccaatgcttatcaggaataaagatttggccaacagcttgctcaacttctggtggcctaggttagcctccatctggcttaccgtgtcattgaagttcttcacttggtacacgaatggaatcgttgcttcatcgttctgcatattcacaatatagcatcaattaaggttatttccagggaaaacccagtattttatctgttaaataaccatcaaatgtttattaacactttgatctttcatcttgctagcagatctgatcactcatattcttagcatgcgtatatatagtataaccaagaaattcatcagtttgtggtagctacttttcatcatagatttcaatatcctatataaaatgttgagttactacaaagtcaaaataagctcttgatctaccgactaaataatattgggtataattttcctgatagcaaagagtaacgaacaaattgaacgaagacatgtataattgtagattgcccatgaaatggcccagcgaactatcagaagttgacagtcagagatgatattatattgatataaaattttccttatgtcactgtcagaaattttttgaaaattacaatgccgacaagatatctagtcacatgttactctcttctttcatttgcaatttccaatcattaattaaccatcatgaaagatcatgcttctgataattagtgatatagatatgcaacaattcaaatatgtttatatgaccaacttggatatataatcaccatttcttgatgccattgccatggcagcattcacaattaatattatggttgaatttgcatttaagcatatattctggagttaccatgatgatctgaatgccagcacctgctgaagcatagttcactccggtgaaattggtctccatttttatcgaactgttaagcgatagataagctggagggctcattttgaatcccatatcctttgctgcatgcatagcacacaccaattaaagttgcatgcatataccaaaaattaacttgggtatttttctcaaataaaagaatacttgataatatgcactacctttctcaaatatagaatcatatatatcaatgtaacaaagaaataccatttgcaaaccaaacattatgaaatgctgaatcgtcgttagtatttctttatattcatcattttttttttacaaactacaataacattactacctttatttgctaatgtcttctgaaagtcaatagtagtatagagcaacgaccacactaccaattagcattaattcattaattatttgtagtcgtgttgggtatattgtgggcgatttattctaactgcttgaaaacacttaaaaaatctttcggctaaagcaaaaaaaaaagactgtataataaccatcaaacatccatctaattcacaaataactatatgaaaaactatgacacagaaaatacaatttaatggtgacataactgtaaaagataataagggcaatatgatcgatcaagtcgcttaattaccaatgaagtcagccatgttgtatccattactgaaccttccagtgggctcagagccagggaagtcgatgccatagtaggggtagtcagcctggggggcgtcagacggcaagtagttgttgttgccaacgtccagcatgccgtccccgaacacgaagatcgccggtacagccgtcttatggccttcagcagagccaagcacttgaaaggatgctattatcacaaggcttagaactatgatcctgaagtgccccatcatcatcaccaaacaagccaattaaaactcaggaacactactgcatatgttatttatacagcattcatgtagaatgtatatatatgattgaactgacgattgataggaagtaaaagtgcagttagctagctagctatttatatgcacaaattaagtgtcaactatgttatcaaagtccatggtcttaattaaactgatggtatgaaagtcaaagtcaagtattgagatatgacgcttattcagtaattcctatcacatggctcatgcttcgtagttaaaagtcggcaacctcaaaccttttaaaagctaagtcatatagctctactctcaatctcttggcctacgtagattttttttttgatcttgcctaaatagaatttttagctgtacgactaatagtacttgtctagttgcagttgatttattcagggtaagcgcatgggctaattaaattaaaggtgatcaatacatccactgtgagctgagtctttctagctgaaagaagcaaggcatttacagttttggaggaagtcagcaaggtatggctggagagtagtgctgggagagcaaatgcatacacaatagcagactatgaagtttctatatgtagcctaccttcaattggatgtgttctatatatgtccctgaacatctatatagtagttgagatttataattttcattcaacgaatgcctaagattcttaagccagtaggagcatgcttgggagttgggtaacccaactataccagtgaaataatagccccccattactgaacatccacggctagatcagtggagtaaggtgcattactgatccaaaaaatgggtattgtcgtattgagcattgcatcagacattgaatttcagattgaaacatcaatttggaactacaaaaattgataaatcgattataaattcgtagcattgatcatcaaaatctcggaatagaatatcaaattgaggtggaagtagcagcctctttacaagaattcaagagcacataaggcaactatgtcaacaagagctcgataatttgtgcagacaatctgatgaacaaagcttgaatccctagattttaataaacgtaacacgtcggcttagctgtccatgaatcacacttgagcacac

SEQ ID NO: 50518 - DNA, 1424 bp, Oryza sativa
ttagattctgagaagcagctgtttagtagccaacttttaaaatctaaaaaactctgaaactcagcttctccaacttctagcttcttaattcatttttcagaatatgtaactacagattctcagaaactatggattgtttagaacagcttcggctagctgtaaactgtttagggcagcttatagcagaagcagcttctaggaaaagctatagctgggacaagctcccccacactttctgttcagattctgaccaaatgaccgatcgagttcagcaccatcgccatcgattgtacatcgccatcgagttcagtagcatatcactgcggtgacgtgttttaccgtcgaaagaaagaaaaaatggggtctgatctgaggctgctactttgatttgtacgaacgaatccttgacttcgcagcaccagccctaccaaactggtactctcagcctattttttgactcaagtactgcaagggaggccccagtagtgtggattttctttattcagagggtagaaccaaagtacaaagggaaaattacaagtcattaatccaaaaaaaagtccctctttataggattcaggcgaacggagaggagttggtcattcttgtaaagagtcctccaattttgggccaaaggtgttttgttcttaaaatttttgcaatccctttgttttcaaatatgccactctgcgaagcaagccgtattgctactttctctggcctcctttagcatctcacccagatcaagaggtattccagtgtattgagatcaagctccagcattgcctgctgaatgggcaatcaaaaaataggtgtaggaatgtttccctgtatgttggtcacaaagcacacatgtcaaattactttcttcaggtgcacaattcttcctatcaagcatgtctttggtgttcagcctgtcaactaggagtggccaaccaaacgctttttatcttcattgtacacttggtcttccagatccatttaagtgtggaatctgttgtgtaaacatgaagttccttgcataaactttctgtgaagaatatatatcatttccccaggtatacacccatttatcatactcagagatggggctgtaattgaagtccacaaattgcatatgtggcatctcttggtgtgcttgttccgacaggggtaatgcaaatgccaaatggatgtctttttgtaacgccatagcaattgactccagcattattctataaaaagaaggccaagaaatatcacgattttcaagttcattattttcacaattcctgaccaatctcaagggtgtatacagtatactactgtatagtatgataaaaaaaaacttaatttgtcaacagatggttacctgacaaaagaaaaatgtttcttatggctcatttgaaaaggaaaacccaggaaaggaaatttaacatttctgt

SEQ ID NO: 50519 - DNA, 4068 bp, Oryza sativa
ataggaaacatgacttaacatcagaggaaaacatggcttggcaatgaatgatgtgaaattttgtctacaaaagataacttatcaattatccactacttggacacatgactaatacccaattcaatactagcatcttttaatccattcaagcgtgcaaaaatgtttgatagaatgaacagaacataacaagttaatcgaatgaatatacaaactcaccagctgaagctggaattaggtatacccccatcctaatcttgtggactgtgctaaatagttgacataatagtgcgcattacccaccagctaggttcatatcatccagctgcaattataacaaacctttccataccattaagtaaatatgtggtagatcagaaggatctgtacaattattcgagttgaatcattaactaactcatcacaaggatcttggagacatacatacaactttagagggaaaaaaatctatatttatcagagagttacaaccctgttaaccagtaagcatataagtgcaaaaagaaaggaaggcaagacttctaactgaaaattgcattgatatatcacatgctacaatcacttttacaccatacaaagctacatcaatctgcatttaatcagtcaagtataaccattgtccatttcaagcagcaatggagaatccgattggaacgatgagcaggatgctgcgcagaaagcagagtatgcaaggccatccaatttctttaattatactgcctaatcactaggaaagtatgaatgtgaaacccccattttcttaaagagtcagaggtatttatccttgattaattttagtatctcctcaattcttttgatgattttagggttcatcaagtcccttgcttgcctaaggagagtgccttctctgctgttataatatgcatcaacaatagcactggcccaagtgtgtaatacctctggactcctgcaatccactaactatgtcaccaagacttgacaagagaaaggaagaacagccacagaatctattatgaaagggatttcaatatattgaacacttacgtgtataatgtatcaacattatccccctgaagttcaggcccaggagtaaatgcgtcattcaatgcactcaagcgttcttctggatcctcaatcattataagatgctttagtattctgatatcctttggcatttgtctctggagattggctactgcagtcatgtatagatgaaacattatatctttagcctgcacaatgtattgcattccagtgagcactcaaactgatgaatttgtaaattaggtacatatatggcatagctactctatgttccaaatggtacttgaatgcttttctgttttacctcagattttgtgatgtcagtaccctttgcagctgaccaagcttttgaaagcattaagactaacgcagaatccaattcctttttctcagctaagtcatctatctttctgcatgcagcatccacggaaggtgaattcagtatatctttcaactttaattcagcagcactcagagcttcaagactcccagatgtgtcatcatgagcttgtagagcatctacacaatcatttccaagttgtgccaattctgcaagcaaaccagtcaaaaaggaaaatgataagctcccaaaatactaatggctgaaaataaagggaaaaaaatatgttccaactatacaagcaagtagacccatgctacatattgtacaatagcatgatatacattcagtaaggactgagaaaactagaaaatagctgttgttggtggtgtagtgtatctatattcctcgacatgtgattcatatgggaagttactagggccttaatacaaggaaagctatgcagagtaccaacatatgttacaataaaaggccaaatgttgcaaatagacgttcttgtgtatgtctcacctctttgtttttcagggtcatcatgataagactctgcaacataataaaggtggttgaaaaattccaccgtgaaatctttatggcgcttagcaataacagaaccaatttcatcagatggtgtagattttactacttcaagtagttcattatgcctttgtacatcttcatctatctgaaaagtgagcgaggaaaaaaactgttatgaataaaggctaaatttaatagttgaaataaagcatagataggcttcctggaaaccactaaagtgaatcacctctttcagttttctagcaagcctgagaagattgtgcttcatctcagggtttgattctgcatctgctctttcctgacagcgtttgaaaaaatgtggccttatgttatcccattccctgctaaaagacaataactttctccaatctgttggtgtaggcttatcgaccataaatacaccaattaacttgtcagatattttaatcattttttggttttctttagacgtctggtttgtcttggcaacccttcctgccagattatcttcatgtgatgaaatactcgtagcaacatttgtagatccactgcttgagggcatgttttctgtataatcctcaggaactgctgtcacatcaccaactgcttctagattagaggttcgtggttggcgttgactaagaaacaggtgacctgtgatcagaaaataaacacattgagggtaaaaccttcaaaattagatagatgccccatatacaaaaaatctatggagaccatcagatacaagaatagagccattacagatggttacactgtggcaccatgcagtgattcgtgcatgcctaataggttgacacaagagagactaatgctgagatttgattgtttcattgggcacatggtaaatcctgaagggatcaaatgccagcaggataaagacttcgtttcaagtggtaaacctgaattctaacacacaaaaactagagcaaccacagatagaattccagaatatacagtatggtcacaggaaacaaccatatagggcatatgcatgaactattgatgctgttaattttcaagactattgaacttatcagtaaaattttgcacctacaggagtactacagaagaagaagaagaagaagaagaagaagataacacggcactaaaaccttaaaacttatagatgttgaaggaaaacaagaataggctagcagaccattagaggatcacaaagtaagttttggttacagaattggttaatcgtctagtttgatctagtttcagagcagattgattctcaacaaaggactcaaatcctcagtaaagttaaacatcataccagcaaccatatttacgctaaaccttcgtcctcactcatcattgctatttacacagcgctattaatttgaaattcaaaatggaaaagaaccgaaaaccatatgacgctgaactctccccctgtggtaagaaacaccggactcacgaccgattcagaaatgccaaaaaatcttaatggtacgagctccaatcgtatgcgcaccataagctattcaactggaagtaacggtggatctacttttgagctctaattgcaacgattcccgctcaggtgaagtccaattttgcaacaactcacctttggaggcgacgggggcggcggcggcggcgccatgggagcggaggcgacgggcgaaggagagggtgcgggcggcaggaggtggggtgagcagggggaggccggtgggcggcgcctggcaggaaggggcggccggcatcgccattggcggcggcgagaggaggcgggcgtttgctagggtttaagcggaggcgtacaagtgggggcaaggagtggctgggtggataggggagaggtgacgacaccgcgagcgaggtgatctcaccctctcgcctcatcactttctttgtcatcttgttgggttctgaattgcgaaacacaccctggaatttggaagaatctacaaatcaggtgcccgattcgtagtaaaaaaaaaaaagttaattcgctcgacttggcccgtatcgatttgttgacgagctaagccagattcagctaacgagtcaaacacaacagcccaagtatccaactatctaacagtgatgtgttaatatgaccctataaaaatattaccatggctgcagga

SEQ ID NO: 50520 - DNA, 9823 bp, Oryza sativa
cccccttataaggtagagaagaacatacaggacacctccatccctctttttagcacactcgttcacttgaatatctgctcctctttgctctcgctttcacaccgtcaactaggtcacattgtgaccgcttataggccgtagcggcaccaagcccccaagcgtcaccctattatctttgttggcctcccaccatcgctaacccttcacctcagttggccccagccactagccctcttggccttgcctctgtcagccctggccactggtcctcacctccggcaacaccaagttctaggccctcgacaaccacctgcccagccagagtctgaaatgttttgatgcaatgttttttggacatctattatctagccaattgtctctccgaaagagggttttctgtccattgcccagggtgatttttatgcaggcttggaaaaagtggatatccactgcattgtaagggagatccatttgttctcaaggcctggatgggtttgtccaccttagccaaatccatcttaatcttaaggccgaggagaatttttatagatctatgatttcaagtccacccagctactttggtctgcaaacagtttgccaattcaccaaactagcccctagcttaacattttctggctcctcacctttccaaaggaaagcccttatgagtttattgattcttttgaaaacccatttaggtattaaaagagctgacaaatggtatattggaatggaggacatgactaattttaccagagtttctcttcctgtggagctgaagaatttgcccttccattctggaattcgcgatccactcttttcaattaaaggtaggaagtcaactttcctaagctttcttaagtgaagagggagtccaagataacttgttggaaaagattgtattgagccaggaaaatcttaggtgagtgattgtacatcaatgttgtcacaggcaattggcaaaatctacgttttttttgcacattgttatttaatcccgatgccttgccaaacacctgttagagattaagctttacgataacactcaataacccttgtggtccaacacagaacatcgatgccgggcctcaactaaaccctatcactgatgaggatcatcggtgacgggtgctcacttaccgccagtcactggtgctttcgtcctacgtaccctagctagcggtccgatgacaggcgctgacgttaatctgtcactgcagatgtcgaaccaccgccttctctatccagccggtctatctggggtgaactttctcctaacatcggtaattcactgtgccagtgttatcgcccatcgcccgtatcttctggtggcttgtggagtgggattgggagtgggagcgaggatgggcgaaagtagtgggtagcagtatggctgggttgattgatatggagtacaaactaagtgtagcaatatagtactccgtccgtcctaaaataaatgcagttttgcactattcatgtttaacggttgacggttcgtcttatttgaaatttttttatgattattatttttattattattagatgataaaacatgaatatactttatgtgcgactaattttaaaacaaattcataaaattttcatataagattgatggtcaaacacggattcccacggttgtacttatttaatttgagattgaggtagtacttaataaccactaagggattataatccatcttaagactaggggttacttgcgtatctacagttgactttaactccgtgtgattataactacacatcagcttgctggccagcctctcccatcaagagttcattatgcagcgtagcagtagcactcttgcggtgatggtggtgtcgtttgtagtgctgctcgccggtggtgcaggcgcggcggccgccgccgtggcgcagccggtgccgctcttcgtgttcggcgacggcacccttgacgtcggaaacaacaacaacttgcccggagacgaggacgtcggggatcctcctcgcgccaaccacccttattacggcatcgacttccccggcggcaaggccaccggcaggttcagcaacggctacaccatggccgacttcatcggtaggagcagtatatgcatgtggacaaaacgtctataactttttcgaaaaaaaaaacacaatcatgtacttttttctgtctacaaatatatgctttaaatttgatccataaataaaaccattgctaaggtggtgtttggatccagggaaactttagtctttgtatttaaacactaatttatagtattaaatatagactacttacaaaactaattacataaatgaaagctaatttgtgagacaattttattaagcaatagattcgtctcgcaaattagtctaaaattatggatggattttattaatagtctacgtttaatatttataattagtgtccaaacatcccatgtgatagggacttacaagttttagtctcatctaaacagggtctaattatatattactagtcctatgaatcatatctcgtctaaatttcttcacatctcttcatcccaagcatccttccaacccgatgcattttatatttcccaacaaatggaatatacattagttattaactgttagccaagaaagtgaaatgtttgagtatgttttgagttttgactagtaatgcacgtccatgatgcatatgcccataagctcatttaattatacatgatatgtatggcaatgcggttgaacgcagcaaagtacatgggatatgagatgagccctccagcttacctgtctctctccggtccggtcaacatggacggttttactggagtcaactatgcttctgcagatgctggcatacggaactccacagtgagtcaactctactccttttttcctttttaagcaaaggagcttagagacacagtacgtcagtaccatgtgaaggtgttttttaaacacaaatctacaccactattattgtcacatatcaaatccttatatattattgtgttcattactgatttaataagatttggatgtacgactagtttgcatacattaatagatgatcttttaagaactgagtgagtacaaaataacacatattaaagctacaccatgggattttcgtaattaagtatacatgcacacgttattaagaaggttacagttaggtcaagaattttacgttggtctctattttctaatatttcttccgtcccatattataatacatatattttttataattaaggtatttaatgatattttgaccattatttattctacgttatgttttcaacaaatataaaattagtatcacatgaaaaatactttgaactgtgaatgtagtgatataacatatatatatatatatatatatatatatatatatatatatatatatatatataatatagcataatatggttagtatgattattaatcaaaagttaccgagtttaatttttcttaaaaagatggtgtccctataatttggaatgttaggagtatgtgttaggggcacactcacatactcggtgtccttcacttgtatgcgttctgtgtgtctgtgtctttcatccatcatatatggcgtgacaatgtcaatgttatgaaatcaaatcgcccaataatcagcatgatgcatacagaacgcaggcttgaccatcccactgtcgaagcaaatcagctacttcgccacgacgaggtcacagatggagtccaagctggggcgcctcgccatgagcgacctcctctcgaggtccctcttcctgctcgccgtcggcaccatggacctcctcccggactgcaactacttcctgacgttcccgccgtcgccgccggacaacaagacggaggtgcagcggctcgtggagctctacaacgccagcgtcacgtcgctatacggcatgggcgccaggaggttcgccgtcgtcaacgtcggcctcgtcgggtgcgggccgacggtggacacgcgccgcggtggcggcagcggcggcggcggcgggtgcgacgcgaggatgaacggcctcgccgcggagttcaacgcggctctcggggcactcctcgccggcctccggtccgagaagcgtcgccttcgctactccctcgctgatttctacgccttctccaacgccaccttcgccaacccatcggctgccggtaaatcctgatctctcttctaacgcgcacaaattaatgacaccattttgtcctcgcaaaaaagaaaaaatgacaccattttggatatcaacacacgtatgctattcaatatatttgtaactttgactgttttatttctattgtaaaatgagacctttttatgtgcttggaattaattaggatcgttgatctctaatgatctaacacttcaaagagagaaggtactaggagataggtattaaaagggtgggctggaagctggaaggttaaaatggtaattgagttttattaattgactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaattttttttaaattctccatgattagttacactctttgaaattatatttgaatttttcagagcttaattgttaattttattaatacaaacgtcatttaacaattatttacttggaaaaagaaagaaaatacttccttttaggtttgcttcgaaataaacacattcaataacttataattgtaatgcttctgaaaaaatgagcactaaaaatgaatttattctctttttttgggcctgagggacctaaaatagacttatttccggcccttgccggtcggtccacggccttttgtgcacgcacaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacgacgcccctcttcccgcgagcggcggcggcggcgccctcccccacaaccaacggcgcggcgccctctccccgaacaacggcggcgtggaggcggttgcggcccggcgggagcgggaggggcggcgggccggacctcgcctccgccagatctggcggcatggaagcggctgtggtctggcgagggcaggagaggcggcggcgtcgtctctttctctctctctgtgcatggtggggaggtgcggcagtggtggtggtggcggacgtcatggaacgccggtcgggcctcgcctccgccagatccggcggtgtggaggcagctgcagcccggcgggggtgggaggggcggcgggccggacctcgcctccgccagattcggcggcatggaggcggctgcggtccgacgggggcgggagaggtggcggcgtcgtctctttctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtagtagtagagttgatgaatcggattcgttccggttttttttcacccggtttttttgacagacgatggaagcacctcttattttttaagtagtagtagatttgtacggctaaggacaaaatcgtcttatttttatatctgtatcctactcctatccgttacaagacaagctgcattcatgcagcacaggaggaagaacggtgtgcttcttttcgtagttaaacgtttatatcatacttttaccgatatgtacatatacatctgcacacctgctcaccgccgtacgcgcccgccgctcaccgaggccgcacgcgcccaccggtctcagccgcttcacacacgctgaggtcgctgctgttgtatgcgccctccggtcacagcaaactaatgcggcagtcggtcgtcgtctccgccaccgcacgcgcctgtctcggccgcccgtcgtagccgacgtttgcggtagccggtcgtcatcaccgccgccgcacgctggtcatagccattgctcgcgccagccggtcgctgccttgcacgtgcttgctggtcgccgccgtcacgcgcgcagcccctgctccttgcatccgagctcgttcaattgggattggagttgattagggttaagcactgaaatcgtggaagggaatcgtgaacactaggcaacggatggagaattggtgattggtcaattactaatctatcctttgtagtaataatttttgttcctaaattaccctttgtgaattaacggtggataccaattgatttaggaggcaccataaaagaccgcttgtaaaatatatgaaaattatatacgatcatacggccataagtattagtcagttaaccttttttattatcaaacttccaaaagtgtggccatgcagatatttaccttaaaaaatactttcatatataacgcccataaacgtgggttttgtgaacttgtttaaataaaaaattatggtcaaattggcatattgaagactagaaaaaaagttcacacgacatatatttatgaatagaatgattagttttacgaaaaatatgttttccatatacgaattgcacccgtccaatcgaatttttttttaaaaaaatagtggcgtaaaattttttaaaaaagttttgtcagtctaaatttgtaacagtttaacttagcatttttctcatgatcgaagggctctaatatttcattttattccttacctctgatttctccaagctctgaatttctgatacggctcgttataattttgcagggtttgtgaacatcgacagctcgtgctgccccgggccttgcatgcccttcccctacttcaaccaaccaccctgcgacaaccgcgcgcagtactggttttgggacgggggttacaccacggagcaagctgccatggtggctgccgctgcgttctacaatggcaccgcaaagttcaccacgccggttaacttcaagcaactgatccgaaggaaaaagtgataactccacgctcgatctcatgtagcaaggcacggcgcccataaaaaaaatcttacgacattcgatcaataataagttaaatgttctcctttagaatggaagaattttaataagaattgatacaattactgacatttcaatggataagtggtttgtttatatggattttgctatcttcaaacaacattatatgtaaaggcgtggtcaagatccctagtcaaactgtttttttttaactcatacttcacaccccgccccatggggaggggactttagtacaacattaacactgggtgggaaactcctagtctggttaaattaacacttactacaaagggagtctttaacccctatgctataaaaaaagtggctgctttacctgtgtgccacaaaaaagtttggagtcacctgtatgccatgagaaaaaactttcgttgacccgtgcgtccaccttctgttagaacttaacagttccatagctctgacatgtgggaccatgtataaaaatgactaatttgcccctaaagattttcagctctattcttctctcccgctatctcccgtgagtgcctgctctctccccgttgcgctgcaagccgccgtaccctaacctagccgcacgccgccggcgcctcgccttggcggagccgaagccgccgccgcctcgcctcgccggagccggagccggagccgtcaccgcctcgcctcgccgaagccgtcaccgtctcgcctcgccggagccgtcgtcgccgccaccgtcaccgtgcgcctaggccggcgcgccgctgcgccaggccgtcgtgcctcctcctctcctcctccagggcccacgcgttcccgcgtcctccctcgtcgcgcggcacgtgggcggcacgcgcggcgggtggtggttggttcgggagggcggcgtcgtcgtcggtcaccaggtggtgcggcgccgtcgggccctccgtcgatggccgccaccgcagatgagcgagtgagatatttgcggtggtcacgtgagattcgaatcacgatgtgctagctgcggctactgctctcgtgctatctctcgatctctcgctctcgctcttgctctctcgtgtggggtttcgagatgcatctgtatatggtttggagttctcgtcttttgcgagaaacggaatttggaattatgcgattgcttttggaaattggtgccctttggaagctatatgtgtatgcttgattcgaagcattaaataaaaaaaagggcatatgcttgttttcatgtattggacaataatacctgcccacatgaattcctgtcactcacaccaaactacaatatttgattacccgttattttttggtatgcaatggtcatacacctgtttttttcttttttacaaaatttatttctgatttttccttattttttccaccattttctaatttttcccacattttcctaatttttcccggatttttaaacatttttaaaatttattctcactttttctgatttttaccttttttaaatattatttttcatttttctggtttttaacgcttttcctaaattatttttcacttttctgattttttaaacccattattgtacacaagggcaaaactgtctttacacagcctctaacacctctgttatgtctccatccatccaaaatggcacacgggtcaacgaaagttaggctcatggcatacatgtaactccaaacttttttttgtgacatacaggtaaccaacactttcttaatagcatagtggtaaaagactcccacaaaagtgttaatcaccgtaagcttcccacctaagctaacatggactagttgatgcacgaaccgatagggttgtattaatatcggtttatgacataaactggtagtgatatgcttcaatcatatttcacgttcgtaccacaaattaactgaaaatgaactatatgctgtgacactaactagcaactgacattattcgagagcaacactattcactcttcactcccggttgggaaacccctttattactcccggttatacaaccggaaccacgaatccgggactaaaaatacccatatttagtcccgggtgaaataaccgggagtaaaaatgtatttttagtcccggttggtgttaccaaccaggactaaaaatggagacaggctagttcagttgctccttttttttattgtttttaacactgaatgttgatttcactccattcccaaatcatccccaaatcccaaatcatccccaaatcgtgaaattttaaatcgatcatcacatcacagatcaaaagaatccttcaaatcctcaaatcaatcatctccaaaaacatcataaattcttaaaaaaattacatcacaagttctaaaaaatcaccacaaatacatcacacacaaatacatcttagatctgaatcaaaatcaccacaagtatcatctcacacacaaaatcaccacaggtacatctctgcac

SEQ ID NO: 50521 - DNA, 4921 bp, Oryza sativa
ttttgttttgctgcgggaaattcggattccgaaaaatccggtgcgtgaaaacggcgtggagtccggataagttacgcgtgacttatccggttcggttacgcgggcgccctgatccgccttcacgcaacacacgcgaaatcaatctagggtttgcctcttactctgtactgcgccgtcgctcatagactactccatcccgctcgccggcgtgcaccggcgatcgggagagtaggtctccggaacctctgccttcgacgtcctgcaccgggagaaggcggtaataaggtttttgggaaacgcttcacgcgactgctccctgttcgtccgcgacggctcgccttcctctccgctcgtgtgctgcgcaccttcatcgacgcccgcaaccgtgagtagttcctgccgagcaaccggtctttccgccacctcggtacgtgttcgacatattgtgcatatttgatctgttcatgttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgatgcactgaggccagataaattctccggtgtgcactttaagagatggcaaatcagggtcactctgtggctgacagctatgaaatgcttctgggtgagtactggcaaacctgaaggaattcttattgctgatcagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatgactgacaaccgttctatagtcgaacaggctcatgagatacaaaccatggctaaggaactcgaactccttaagtgtgtcttacccgataaatttgtggctgggtgcattattgcgaaactacctccatcttggagaagtttcggtactgcactcaaacacaagagataggaatactccgttgaggggttgatagcgtctcttaatgttgaggggaaagctcgggaaaaagatgctgcgtctaagggtgatagtgggcagtccagtgccaatgttgtgcataaggctcagaacaagagcaaggggaaatacaaagctcaacagaccaccaactttaagaagaagaagaagaacaacaacaatcctaatcaggatgagaggacttgctttatgtgtggccaacctggtcatctggctaggaagtgtccacaacgcaaggggatgaaggcacctgcagggcagacttctaagtctgctaatgtgaccattggcaacactggagatggaggcgggtatagtaatttacctactgtttttttagttaatcagtctactaattggtgggttgatactagggccaatgtacatgtttgtgctgacatcttattgttttcttcttatcaggtcgcacggggttccatcgtcctaatggggaatgggtcacatgcttcttttcatggtgttggcacggtagatctgaagtttacttcgggaaagatcgtgcagctgaagaacgtgcagcatgtcccttctatcgataggaatcttgttagtggctcccgtcagactagagacgaatttaagttggtttttgagtgtaataaagtagtcgtgtctaaacaggatattttattggtaaaggttatgagtgcggaggactgttccgcttttccctttctgatttctgcaataagtctgtgaaccatatttgtggcagtgtggatgatgaggctaatgtttggcactcatgtttatgtcatattaattttgacttgatgtctcggctttccgcatgtgtttaattcctaagttcttcactgtcaaaggttctaagtgccatagttgtgtgcaatcgaagcaacctcgcaagcctcacaaggctgtcgaggagagaaacttggcaccactagaactcctacattcagatctttgtgaaatgaatggggtgttgacgaagtgtggaaaatgatatttcatgacgttgattgatgatgctactatattttgctatgtgtacttgttgaaaacgaaagacgaggctctagactatttgaaaatttataaggcagaagttgaaaatcaacttgacaaaaagataaaaaggcttaggtttgatcgtggtggagagtttttctcaaacgagtttgacttattctgtgaggaacatgacatcatacataagaggacgcctccctattctcccgagtctaatgggattgctgaaaggaataaccgcacactgactgacttggtgaatgacatgttggacaccacgggactacctaaggcatggtgggggaggcattgttgacctcgaatcatttggtaaatagagttcctacagaaataaggacaaacaccatatgagatatggattgggagaaaaccatcactttcaccagcacatgagggtgcttggccaaagtcaatatccaataacgaaaaagcgcaaattgggacctagactgtggactgtgtctttctgggatatgctcattacagcattacctatagatttttaatagttaaatctgagggacctgacatgcatgttggtacaattatggagtctcgtgatgctaccttctttgagagctttttcccaatgaaggatacacatagtagttcgagccaaccctctgaagtaattccccgttcaatcacacaaccagaacaaactgaacatacacataaacatgtcattgaggaggatgtcagtgaagctcctcgaaggagtaagagacaaaggacggctaagtcctttggtgatgatttcactgtgtacctcgtggatgacactcctaagtcaatttcagaagcatatgcatctcctgatgcagactactggaaggagactgtccgtagtgaaatggattccattatcgctaacgggacttgggaggtgacaaatcgaccctatgggtgtaaacctgtggggtgcaagtgggtgttcaagaagaagcttaggcctgacggtactattgaaaagtacaaggctcggcttgttgctaagggctataatcagaaagaaggcgaagatttcattgacacttactcacctgttgctagattgaccacagttcatgtgctactttccctagcagccacacatggtcttctcgttcatcaaatggacgttaagacagcttttcttaatggagagctagatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatcttcaggctttgcagtcaatgaggcagataaatgtgtgtactatcgctatggtgggggtgagggagttattctgtgcttgtatgttgatgacatactgatatttgggacaaaccttgaggtgataaatgaggttaaatcattattgtctcaaaattttgatatgaaggatttgggagtagctgatgttatcttaaacattaagctaattagaggtgagaatgtgattacattcttgcagtcccattatgtggagaagatcttgaatcgctttggctacattgatagtaagccttctccaacaccttatgatcctactccctccgtcccaaaaaaagacaaaccctggtttccgtgcccaacgtttgaccgttcgtcttatttgaaaaaattatgaaaaaaattaaaaagacaagtcacgcacaaagtattaatcatgttttatcatctaccaccaataaaaatatgaattataaaaaaatttcatataagacggacagttaaagttagacacggaaacccagggtttgcctttttttggacggaaggagtagattgttgtaacaccctgaaaatttctgacaataaaaatcactaaaattttaaactttttagaacttttgcatcatgctagatgttatggttgctattgcttgccaaactattaattttcacgattgaagattaagctaaagctgtacaactaagtagtaattagaataagataattattattaatcctataaatatttgtgcacatgatagcaagccgaataaagtacaagtcaattattaatttctataatgcagactacaaattgaatgttaaatacttgaaccatgttgacaagtgtcaggacatctaagcaaccatgaaataatcgccactacgatgaccctatataaaggagcgttccactggaatatttatattaatatttataatgttcattgagtctctcatggaatagattcactcatataaaatatttggtcatgtaaataaattgagtaaatataccaccacccttataatgtattctatggaaatatattaattctatatcacagccagcaattatttaagttaattatagagtaacccaatataatgcaaattcatttggaaataagtaaatattcaaatacatatttgaattcccaaaaccaaaatatatatattacatctcaattcaaattccaatcccattcacttttgcagattagcccctccctttccttcctttcgcttttcttccttttctctcttttcctagccgccactgttcattgcccgaccctgttcgacataggcccagcccagcagatcaggaacgcatccatcccgttcccaacccttgcagcactgctcccgtgtgccgcgtgcatcgcatcgatctcgctaccacccgacgccgcgccgcgccatgcctccg

SEQ ID NO: 50522 - DNA, 13277 bp, Oryza sativa
gcgtccatcggttaaaattgcgcatccctaccgcgcccgctggacaaaacaatgcccttcctccagctagcgcctagacctgcagtacataggttatagatgcgatgattaagccacagaaccttaatggagaaggagataaacccttatccgcgtcgtccacctcatattccttatccgattgccattagagctctagctcatccaggccatgtgccggcgatcttatccccatggtttccttacatcctaagctaagcccccaacaaaaatccccattcctctcagctttcttcccgaatacatttcatcgagcaccttgcgatcactctctcaccaccgctagagatcagcattgcgaggctccccggccggagctggaggttggagggagtggaggaagagccgtgctgccgccgtcgccattgagggagctgaggaccgctggacaccgggaaccacgcgtcgaacactttcgggcatcgccgaccgctagccacctctgctttgtctgcaccgcaccacgcgtcgccgcccttcgccgtctctccatcctagcgtaatccctcgaccccatagcatcctctaactctctaatagctagcatcggctccaatttcgccaaatagcacccgtggccgtaccggcctggccgccattgcactgccggcgagctcgccgtggacaagccatccgggagctcccctctccatctagctgatgaaatcgaatccccatacgccgtagacgctcacgccctcaccagtttggtcggaaaccctccctatcgccctagcacctagctgcccgagctcagccatgctgcgccactcgccctcactccgccgcgcgtcgctgacggtggtgggaggtcgccggagcctctccgtactttccgcagccgccgccgtgccggcctcgcgccatcccggctgtgcccagcgcgcatggcacggctgcctctgcccggctggaggttgaagacgacctccattcagccactgacaggccgggcccactcctatatttcccctagcaaaaattaatccggtggaaaaggaataaacccggggtcccacatgacagtcaatgtagttgtggataggatttcggattaagaacaaatctattaggaacagtaacttttcacaatttctcggattaattcgaaattgaatctttaaactagtataacttattcattttagctccgattcgagtgaaacttgaacctaaatttatctaaattcataagctttccaatggtatgtaactcactgtttagtaaaatatatttataattgttacataattaatatcaaatgattagattatgatcaacttaaaaatatgctaataaataaaattgattattgtacagtaaactaggtgtgaggataattctctttaccatgctttatcactgtaaaacccatgtaaactaattagaagcatatgtggtcatactcctaccataactcgatagatcaactctgatttaatgaaatgtgtatcccatttatattatgatgattagatcctaaacaagccgccatgacaataggaatgattaagagattatccgtttgcaaacacgaatcgaccccaacaactatattttgcttgtgcatatttgattgaatattggtttttctcgcgtattatagaatttgtatatcggttagtcgtgaggcaacgtatgcagcttccaggaggtgaaggttgatcaagattatatcaagaataagaactatcctgagcatgcaagtcatcaccccaccccttgagcatgttgatcccaattgcgaaattgttttgtttacaaataaaattgcatgcaatgatgaatatcctacttgttattatgccatgcctttgattattgcttatctcattattcccttgtacccataattacgtatgagtccatagtcacttgtgacaaatgctgagtaatgctaatttagattcatgcattctcatatttatcaaatgctttatgcttgggcaactaccttggggagggtagttgagatacggcatgtagagacatgagtgccacattgccatggcattgatgagatgatttgtgaaagaaaattaaaactaaacaaatgttttcgactggggcggctggatgatttgggtggtgtccggtaaaggctagtgccatccctggtcagttaaggacagagccatgaagctaagcatgaaacgaccccaatacaaccgtacttctcgaatgggtatagacctagcggagtagatagccgagcggaggcagtacccctgcatagtggtttcacttaggtgtgtggatgaacaagcagtctgttggcggatacccgatacggatggccagatggcggatacccgatacggatggccagagactgacttgtcaagactacaagactacaaggagatacccaaaagaggacagcatagattgggttcaactacaggatgcgatgttagacttgcgtgagttttcttcctcgggagcgccagaactcctctcactgctagaaacttatgacgcctagagtgcatgaggacttaagttcatggagcgggtactgccaatgtgaggttattgaaaggctttgccgtgacgcgtctcatgtgttgggacgaggctcatgtgttgggcagttgcggagtacgggtaaagtgtacatccactgcagtgtgagtaaaacaaatctattcgaatagccgtgctcgcggttattgagcaccgggacatgtattacacttggctagactctaatttcttaatctgattgggatgggatatgcatcatgattttgtactagtggatcaacttctcgagaggcgagaaggggtagaccccagaaaaccatgatggccagtggcgggaagctatccttgggaacacaatggatggtggatagaaccgtcgctgtttaatgaacaatggagttaaaacttgatcagtttatgctaggtcttaggtttgtgaaatgatatttgaaaactcagctttacgcaaagtaaccatagccactccttgtattatcctgtacattactacattttgtgtggtggcttgctgagtacttttgtactcattgttgctctatatatatcttttagcagagtgttgaagagaagcccttgttagtgcgcttgcgtacctaacaagatgatcggagtttaattccattctaggtctcgtttcccagtcgactgcttgtggtatgtcaaccgggcccctgtattattttgtcttccgctgttgtttctctgatagttgttggcctgccaggccctaatgtaagcatttaactcttttagcctgaattcattcatgatatgttgtgattcggctatgtatgtgtgtaccaactactgatccagggattggtactgataaacataggagatttccgatttccaaaatcggaggtcgacaattgttgcttcgcaagaacaagagaattgctaggaatcaactggaatactcccaaatcattggctcgctgatgtacctagctagtgcaactaggcctgatatctcctttgttgtgagcaagttgagccggtttacctctaatccaggagatgattactggcgtgcgcttgagcgagtaatgcgctatctgaaagatactatggaattggggcttcactattctaggtatcctgcggtactggagggatatagtgattctaagtggatctctgatgtggatgagataaaagccactagtggatatgtcttcacactgggtggtggtgctgtttcgtggaggtcttgcaaacagaccattttgacgaggtcaaccatggaagcagagctgacggtactggatactgctactgttgaggcagaatgactgcgtgatctattaatggatcttcctattgttgaaaaaccggtgccggctgtccttatgaactatgacaatcaaacggtaattgtcaaagtgaatagttctaaggataataagaaatcgtctagacatgtgaaaagacgattgaagtctgtcaggaaattgagaaactccggagttataacgttggattacatccaaacagctagaaacctggcagatcccttcacgaagggactatcacgaaatgtgatagacaatgcatcgtaggagataggtttgagacccatgtgagttatactatggtggtaacccagtctatgtgatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgatgtcctgcagagcattcttgaaagaactcacctttgtaagcttgactgttggtcgcagtctatagagattttgggtgaatcttctaggaatcttactaaagatctaggagtatgacttatacgctccacccgaggggtagtctacagacggtctagtaccagataagactctgagtgaaacttgcttgcacaagacttgcaattcaaggcgtagtccattgttcaagttgtgagtaagtgtagcttggagttctaggtggatgtttaaccttaatcggtctccatcgaaccgctggtatataaacagtacattggaaaaggcaaatctcagtgggattttgagatttggtgggggattgttggaattaatagatgggctaaggcccattcgaagattaattcttttgaaaatcacaaaagcccacctcatgggatggcatgcatgtgaagtttagtaccaccttgctttttctatgagagggggacctccttaaaagggaggatgccctcctagccacttgaagcatgtgtggtggagagaagaggggaaacacgcgcgctcgctcacctcgcctggcttggcaaggcaggcggcgcgcgtgcacgacgtacacgtcaaatggtccgcaaaattggctcctcacccttgcgcagatgtagtctccttttgcagttttgttttgctgcaggaaattcggatttgttttgttttgaaacattccgaaaaatccggtgcgtgaaaacggcgtggagtccggataagttacgcgcgacttatccggtttggttacgcgggcgccccgatcaagcgacctatttctatataaaccgagccgccgccttcacgcaacacacgcgaaatcaatctagggtttgcctcctactctgtactgcgccgtcactcgtagactactccatcccgctcgccggcatgcaccggtgatcgggagagcaggtctccggaacctctgccttcgacgtcctgcaccgggagaaggcggcaataaggtttttgggaaatgcttcgcgcgactgctccctgttcgtccgtgacggcttgccttcctctctgctcgtgtgctgcgcgccttcgttgacgtccgcaaccgcgagtagttcctgccgagcaaccggtctttccgccacctcggtacgtgttcgacatgttgcgcatatttgatctgctcatgttttactgcttagtttacatgtgtagatctaatgatgcgttcaatctagtttacatctgcaatgtcatgatttatttatggaataaattaaatcattatgcgcttataatttcaacatattgtagccgcacacgtagcatgcagtcctggattgcttgaatctatcggcatcggctgattgacaactaatcaaacataaccaattgaccttgaccatatcatcaatcgaacctttcactggatatataagcatgcatatacacactataggcatgagattttatatatagagagagagagatagagatctgagttgaccgccgtcgacttaattagcattcaagtttttaggagatattctttttatcttggaagcaatgtacatcgatctgccatgcaagcatgcatggatcatggatgcattatgcatatatgcgtgatgaggaagcattatatgcatctggcatctcaacacttgacttaattatctcttgaggccacaatatatagctaggataaagtagccgatcaagcatgcatgaagcacttgaaaccttgtgtgcttataagtagctagctagctataggggcagctccaacaccttgctactgcagaaaagtgtaaaaaatggctagtggatcggatgcaatgggcactttccttgcgatggcagcgttaaccttccaagtgatgcttcttggtggtgccgtcgtcgccggcggctgcaacgatacacggcggtcgtcggtcccggcgatcttcctgttcggcgacggcgcgctggacgtcggcaacaaccaatacttgccgtcgtccgaggccggagacccgatccgcgccgatcaccccttttacggcatcgacttccccggcggcaatgccaccggcagggtcagcaacggctacaccatggccgacttcattggtaattaaattcatttcctttttctctatatgcatgtggcctagctaactagctatacgtactaactaccagtggtattattcattataatcccttcgttccattttaagcacggtcaggagtttctaatgtttaactttgatcgtctgtcttatttgatttttttatgattaatatttttactattattagatgacaaaacatgaacagtaatctatgtatgacttatgttttttaatttttttttaaaaaactaaataagacagacgattaaagttagacacggaaactcatggttgtaattaaaatggaacggagggagtatcaaattgggaaagtctgttcatctctagatatgacatctcttcagggagcggacccaagggtgtagtgtgcactggcatacccaagaaatttgaaaaaaaaaatttggatcacctactccttagcactatggcctaagtccagtagataatggttctgtttagttctcttcaaacttttaaaaattccgtcacatcaaatatttagacacatgtatggagcattaaatgtgaaaaaaatgtatagtttacatgtaaattgcaagacgaatcttttgagcctaattacgccatgatttgacaatgtggtgctacagtaaatatttgctaatgatggattaattaggcttaataaattcgtctcgcaatttacaggcggaatctctaatttgtttcgttattagtttacgtttaatacttcaaatgtgcgtatgtatacgtcaaaaaaaatttagaggaggaactaaacacagccaatatagcagattaggcacatgccagaacagcatgtcaggcctgttgtaagtgttaagtgttaaacagagttgtactctctctatctcaaaatataagggattttgggtagatgtgtgacaaatcatagtaatatgaatctagacagcttctctgtctatattcacagtattaggatttatcatatctacccaaattcttttatattttggaacggaagcctggagtagcaacaagtagcagtacatgtgtgagcgcgcgtgctgaactgttgagtgccgacacgggttttggggtagcgccgatgatggccagaaggatgatgtattcacaagcgggagaagctgattaattaattaattaagtattaactattataaatttaagaaataaatttatttgcttttataataacttttatatagatttttttttaaaaacacaccatttaacagttttgaaaaacgtgctatatatgaaaaatgagtaagttagagtttggagttgaagaatagaacagggccttgctcaacaagcacaaagcgcacaattgctatatatcatccacttattcatatttgcaatttcctctcggtcccagtttccctcaaactgaattactgaaaactaaaactattttgtgatttctgttcttaaattaagttgagtgagcaaacatatgtgaacaagagcagtgcctagtgtttatttttagtgatcaccaaagaattcagattctagctatactttgacaaattctttaatttatatctttcattacatagttgcagttatatcttctatctgacaatttttgttaattatgtataagcgtctgaggcttatttgtatttgtatgcataaagacttatatattttcttttaattgacatgtgcgggcacacccaacactagtttttcctgtgtccacaattgcgtctcttcatttttacttatagcctaaaaatcatcaaaaaaatattaacagaatagattcgtgataatcaccaaaataaatattaataaaatagatcggaggtgctcatagtggtaggattcgcatgtgtgttcatagacgtgagtgtgtgcacgttgtgagcgcctgtatttgtactgtgtttcttaaaaataaatagattgttgatatatcattgttcaaattcaatttatatatgtagaaacaaaatagcaaatttgactctgaacagaacataaaaattcactgctaaatttgttgtctctaattatataggctgaatttaaagttatatgtttatgatatatcgtatattgatcaagcttacctattttttttaaaaaaaatgacgttttaaacaacatgcacaaaacgatggggcgttccctcgacacaaacatcatctcctatcaaactataaactaattgtgtcaagagatgcatggtaatatgatattgttttgtgtgtggttggagcaaaggctatggggttagagatgagccctccagcttttctgtcgcttaataatagcctgatcgaagtggatgcgggtttcagcggcatcaactatgcttcagcatatgcggttatttggaaagatttgtaagtagtcaaacattccgtccttcgatccgtgttctactggctcagttctttttccaactttcctaactcaccttcctcgttttccgtgtgcacacttttttcaaattgctaaaggtatgtttttcttaaaaaaaaagttatatatgaaagttgttttaaaaattcatatttatctatttttaaaaaataaattagttaatactaattaattatgtaataatatgtgctttattttgcgtgccaaaaaggactcctcctcctcctgaccatagcctaagccatatatacatttcttacataaaccaaacattttcttacatatacgaccttttcttacataaacaatacagttgggaaatatttccatggaggtaaaacgagtcgaatctcatgttaatttcataaatatttaccattttactatttatcagtcgcctgattttcccaaacaccatacaggacgacgcagaatcagtatcactgccgagacaagtgcgatacttctccaacaccgtggaggagctgaacggcaccgtgaccgagcacgagctaaccgagcttctctccaagtccctcttcctcatctccgcgggcacctccgacctctaccgcatcgccaacatactcgactcgccgtcgccgtcgccgccgccgcccgacaacgagaccgacatcccgcacctcgtcgcctcctacggcgagctcgtcgtccggccactgcacgccctgggcgcgaggaggttcggcgtcgtcaacgccccgccgatcgggtgcgcgccggcggtgacggagcagccgcacagccacagccccgtcggcggttgcgacgaccggatgaacgccctcgcgagggagttcaacgacggattggggtctctcatggccgggctgagctcctccctccccggcctccgctactctgtcgccgatttctacggcttctccaatgccaccttcatgaacccgtcggctaatggtatttaattacttgacaaaatctgtcagattattcgtgaaccgtcacaatttacttcttgcatttctttttaatgatgatgcattcctaatgttagtttgtcatcgtatgtacacagggtttacgaacactgatgctgcgtgctgcaaagggccctgcaatgagcagttcggagcgccgtgtgggaaccggagggagtactggttctgggacgtggggcacaccacggagaaggccgctaagctggcagcagctgcattttacgacggagaacgccagttcaccacgccgcttaacttcaagcggttgatgggaatacactggagatgatcgagatctcctaatttttcacatatttaatagcaaatttgatgggaatacactgatcagagatgatcgagatcacattttagtttttcttttaaatttgctattaaataattctaccccgtttgatttttattataaataaaaaatcacattaacattgatgtttttaaaataagttgcacgtaagtataagagagggaaatatattcattttataaaaatctaacataatgggtaaagaggggataaaaagaaaaattcagtggtacaactgtacatgagatgatgcaaaatttaaaaatttaaaggtatagaagggattgaggaaaaacttgtgggcacatatggaattttctgaagatcaaaacacggcaaccaactaagcctagcgttggaagaaataaaagtaaaataagttgatttttaaaagttggtattttttttagttgttacaatacatgctacttagctcaaatagagcgctacatgctctgtattagttctactaagtcgtatatttcaagtaagaaattttattccaagaacctagcccattagtagtaattttttccctaaaatacttagctcattaatagcaacaacaacaataataatacttactacctttgtttttaatatatgactatgttaacttttttacatcatgtttgattattcgtcttactaaaaaatttaagtaaatactccctctgttttaggttataagacgttttaactttggtcaaaattaaactgctttaaatttaatcaagtttatagaaaaaaaatagtaacatttttaacccaagacaaatttattatgaaaatatatttaattattgatttgatgaaactaatttagtattataattatgagaggggaggggaagtagaggctgacatctaggatccacccttagtcagctgtcacgtcagacaaaactggagtgaaaaccacttaggaacctagtttgcactggttttgtaagttgggggatgtgttgttccggttttgcagtttaaggatgattttgtaactcgatgacaagttgagggaccttaggtgtactttttcctttttattttcttgtggacggccgtaagccgctaaataagccctttgtcgctgtgtttcggcccattctgctggaaagaaagttgccgccgtcgagcttcctcctctctctctccgccgtcttcagttcttcgccaccaccggggcggggggatgtcatggaccggccggcggccgccaccgccgggggagccaccaaccagcctggggagggccgcgcttccctcgctcttcttcttcctgcgccggccgcgtatgtagctctccgcctccacctcgtcccccaccatctccgtcggccgtcgcgtcgctctttttccaggcagcgcgcgtgagtgagattccggcaggcagcagccacgcacttgtcgaggaccctctccgcggccggcgcttctctccggaccgtacgtgaccactctccctggcaagcagctcgaggagatcgatgatgcatcatcagtatttctgcaaacaccctcggttgctggtggtaggttgaagcatcttgcgatttgtttttcttgtgtgctcaagtgtgattcatggacagctaagccgacgtgttacgttttattaaaatctagggatttcaagctttgttcatcagattgtctgcacaaattatcgagctcttgttgacatagttgccttatgtgcccattctgctcttgaattcttgtaaagaggctgctacttccacctcaattttctgtactctatattaatttgccatctgaaaaggagagatcagccatcgccaagggaaaagatcaagccttcaagatcaccagggcccctccaaggacgccccatgatcgcctctccgtgaaaattgcacatttctgtttaccatcgacgtacactacgtctccatttaataattttctctccatcttttattagcatgcaaatttactgatggtccattcatgtcagcgaaattgcgtgtgttgtgaagcgaccaattttttttggcactcccaccatttggttcaaacgaccgaaattagctgcaactgccaccgtgaatccattatttccaccgacagccttgtccatgtcagaataatcaaatataattattgtgacgagtggtgtatccacatcaaggaaattaattttctgaccttgagataagtgcgtcatggaaaattgaatttccccgtgcacgttagtaaaatcaatgacgaccgtcagagctagtccggtttttggtagtttagctcgaaaagtgatcagtgaagacatatgcattactccctcgatgctatgataaatgatactccctctgtcctataatataagggattttaggtggatgtgacgcatcctagtacaatgaatctatatagacagagacagaatgtgtcatatccacctaaaatctcttatattatgggacggagggagtaacacattacaaccctgttgctatgatatatcccaattaaactagcttgttggaaaccaaaaaaacataaatctgctaatggtgcattttattatagcgtgcacaatagctgatgtgctgtgttaacttgatcatcaggctgctggaattcttgcttgctggcttgcacaggtagttgggaaaataggtccctagaatccattgtaattgtgatcctacaacctagagaatgtgagggtttttgaaaaagtacggtgcgacattcgtccatcacggctcgtctttctctgtgttccgatgctacttgtcatcgtccagataatattgcatctcgtgtgtcatgaacgcaattaagctaacctatccagcacaaaagaacatcatcgacttagcttgatcaccgactgcaggcaacaaccacaggttcttttgtgctgaataactgaatgggtgaatatgttaaacatgcaatattatgatatatgccaatatgccatcgtatggccatacatccagtgatcgcacgtgtaacaatcttacagctacacaatattcactgccacagaaacgattttcctggacagggaccttcagattgcgtgcagacggtaactcgtcgcatctgggaaaatcg

SEQ ID NO: 50523 - DNA, 3732 bp, Oryza sativa
gaggggcgtcgcggtgggaggcgtggaggccgggagtggcggcgctgacaggaggctggcgggaggtgggcgccgacaacgacgaggcgggcgccgccgccgacgaggaggaggcagcggccgggagcaacggcgccgctgccgattctagggttttttttgaaattttttttccgatttttattttaccgtgtgggcgatataagcacccacacgtgaaaatcgcgattcacgcagacccttggttgcatgcgggccgaccacccgcatgcgaaaatcagattcgaccgcatagaaaaatcgttctcctattagtgattgtagccgcacaggtagcatgcagtcctggattgcttgaatcgatcggcatcggctggttgataactaatcaaacatataaccaattgatcttgaccatatcatcaatcgatcctttcattggcagacatacacactataggcatgagattttgtatatagagagagagagggatcggatagagatctgagctgaccgccgtcgacttaattagcattcaagtttttaggagatattctttttatcttggaagcaatgtacatcgatcagccatgcaagcatggatcatggatgcattatgcatatatatatgcgtgatgaggaatcattatatgcatctggcgtcgatcaacacttgacttaattatctcttgagaccacaatagataggataaactagccggatcaacacgaatacttgatccatgaagcacttgaaaccttgtgcttataagtagctagctagctataggggcaggcagctccaacacttcgctactgcagaaattataaacaattgctagttgggcagtggatcggatgaaatgggcactttccttgcgatggcagcgttaaccttccaagtgatgcttcttggtggtgccgtcgtcgccggcggctgcaacgatacacggcggtcgtcggtcccggcgatcttcctgttcggcgacggcgcgctggacgtcggcaacaaccaatacttgccgtcgtccgaggccggagacccgatccgcgccgatcaccccttttacggcatcgacttccccggtggcaatgccaccggcagggtcagcaacggctacaccatggccgatttcattggtaattaagggctggtttgttttgtagcctaaattagatttaccaatttttttaaagctaaagtttggtaaattttagtatggttaattttgttaaggtaaagttgtgtttgcattgaagccaaaatagcctaagttaactattgaaatgccctattttctttggcatgccaaaattttgctccaaaccaaatagacactaaacactattgaaattaccaaatattggtaaaatcaaaccagccctaaattcacttattttcactatatgcatgtggcctagctagctatatgtactaactactcgaggtattcactcctacagaaatggttttttttttctggatgagacatacgttgcagacggtaatttcgcatctacaaaaatcaacctctattttccgtatagggctccttaggaggaccatataaaaaatcgatttttataggcggacctcttaagggtccgcacgtaaaaataagcctatttttgcaggcagacctcttaaggggctgcatgcgaaaatatatttttgtagacgggcttcttaaggatctgtctaaagtctgagttacatcctcatttccctctcgacacttcaaaatttttcatccttatccatccttctctctcacattctctcctcattatttcctatccactctctcacctcatctcctctctcacctcattggacgagacaggcggtgagcggcacgaggcaggcagcaggcggagggagcgatcggcgatagtgggcggctcggtggctggcggatccacctccaccgagcctgcgatggcctgatccgccaccgtagggtccgcgatagcctgatccgccgctgtagggccctcaacggccggatccgcgggcggcgagcagatccgccttcgtcggcctcgcgacaggcatcgggcggcgggcgtgcgccgatagcgagtggcgggcggcagcgacagatcacgcagcgggcagatgagccccgctcaaatttggcagcgggggccacccagatctggcggtggctagggttattttttgcaattttttttaatttttgttttttgcgtggaaaccatataagtacccgcacgcaaaaatccgattttgcccgcacgcgtggaaaaatagtgaattatgcagacccttcaaagcagatgggccagagttccgtacgcgaaaatcacttttgggctgtatggaaaaaattgttgttgtactagtgattattcattgtatcaaattaggaaagtccattcatctttcgagatgacgtttcttcaggaggtgtgccaggtgtgcactggcgtacccaagaaatttgaaaaaaaaataggatcagctagctactccctagcactatggcctaagtccactatttcctctaacccataaaaaactaacctagtaccgaatgtgacacattctagctagcagtatatgaatctggatatacatgtctttagattcgtagtatctctagattcgtagtactccctccttccaaaagtctaagacttattttattttttaatttttccaaaaagccattttagtcctatttgtaatcattatgtgctaaattaaattattgataggtaccaagaagccattttaggtggtgtttggttgaggtcaggaaatgcaaacgtaaatgggatcagctacagcagtaagggaagaaaatgtatcactttacaggttttgtttggttggccgctgtaacgtctcatgtttgcattacattgtttggatggaacatggtaacgggtaacggctgcttccgaagcagggagcgcttagaacgtgacgtagctcaaagctaaggcacattacaagctacatagcagcagtgttctcaaacacgtgtagcacatcaaagctatgtaaaaatattcacaattttataacatgcaactgtttgatactatcacacattgggaagtgtatacagtcttgaaaatgtgaacatcagtttaataatctcaagtagaaattatggatagtggtagcactctagctagggcatgtacaggaataattcaagaaaaggtcatgtggctttagaattcaagtgatataattggacaacatgcatctagaaactactgaaagtgaataatcgggcaggtcctcgcttcattctaaaaagggcattgactccaaagttaagaagcacacatgcatgtaaatatgttctcatgctcaaacaaagatgcaaggaatccaatttataatgttacttctacattaaaagaaataaaagatgccactgtgagtttaaaggagagcacgaaacccaaaaatatgtgttccacttatgcaattggtaacaagtggaatagtttctatggtttccaatcatacacttttcatgaaatataagttagctcacctgcaaatttaccctccatttgcttctgcaaagtgaattttaaaagaaaatggaaagcagggccatctgaagtcaacttcctggacaagagaaaattaaatgctaatcagaaagtagagcaaatatttgttgaacaatgtcaacagcagctgcaaaaaaaatatttgctaacaaagtttttggaatataaca

SEQ ID NO: 50524 - DNA, 5321 bp, Oryza sativa
ctgtctaaataaagtactgaggaaatatatggatgaacaattgacatgagtgaaactactagattagtagactcagattcagcgagtagattggtttggaacagtccatgctgcgaaacataagtaaattgattatatatgtgcaagatgacaattctgtcgaaaaggcaatgcacgacaaacctttttttttccaatctcacactctgcaaaataatatatcacctggcagtaatgaaaatcaaaattctcaaaatctagagagtaaaatgagttggtccgacaaaatttcggaacttacctacactcgaaaacaaatatgaaagaaccatcaactactattccagatttttcctgcaatcgggaaaaacagattctacaaaactcatgtaaacttataaagcaaacagaactgaggcaggaatacatgcaaccaatcaagaatacaaatgattcactagtataaactacttcatgatttgttaatgaaaagaaaaagatcatcaatcatcagcatcacaagtatatcatcataaagagtggtggtatcagtgaggggagggttctcaccggcgacggcggaaacgacagaagaacctccttggtggctggtgccttcttcgtgtgcctcaagatctctgccatgccttcttgatgctcaacagcctcgtccttctcgcagatccagtcgtcagggatgtggaactcgagggagatggaggagggactgaaggtagcagagcagtgggttgtcggccttgtcgaggcgggcaatctccgggcggtcatggagcgtgcgaggggaggggcagcggcgtcggggcagggggcagcggtgtcgacgacgcacgccgggcagggggagcggcgccagcgacggtgcgctgcaaggtggcggcgctcaaggctaggtcacgttcgctccgctccgcctccgtatcggtaacgcgtaacgcccgatctggagcgtaatcaactttgtattgggctgggattcgtttgcgggctaaccgattacggtccatctaaaacaaacagatgtaagggaatcaattcacgctggtatctgatacgggccgaaaacagcccaaccaaacagctccttagtgtttatcggttacatgctcattggttttgtctcgggtgaatgaattaattgtttttggtcttggtgcaaaaagaaatgacttagacttttgtaaggagagagtaccatagtatgtcacatccggtattagattcgttttttataatatgtcacatccggtattagattcgtttttttatgacggagggagtatataatagcatattaggcacatgtcagaacagcaggtcagacctggttgtaagcgttaaacaaagttgcactttctccatcctaaaatatataagcggctgggtttagggagtatataatagcttattaggcacatgccagaacagcaggtcagacctggttgtaagcgttaaacaaagttgtactttctccatcctaaaatatataagcggctgtccagatttataatgctaggatttgccacatctctcttcaaattaccttatattttaaggattaaagccaggagtagcaacaagtaatagtgcctgtgcgagcgcgcgtggtgaactgctgagtgccgacagagttttaggggtagcgccggtgacgaccagaaggatgatgtattgccaagcgggagaagctgtgcaactgtctttactcaacaagcagaagcgcacaattgctatatatcctccacttattcatatttgcactttcatctcttagtcccagtttccctcaaactaaattactgaaaactgaaactattttgtgatttctgttcttaaattaagttgagtgggcaaaggtatgtgaacaagagcagtgcctagtgtttatttttagtgagcaccaaagaattcagattctagctatattttgacaaattctttaatttatatctttcattacataaatagttgcagttatatcttctatctgacaatttttgttatgtactccgtataagcgtctgaggcttatttgtgtttgtatgcataaagacatatattttcttttaattggcatatgtgggtacacccaacacttgttttttttctgtgtccgccatctgcatctcttcatttttaagtattgctttaaaaatcatcaaaaaaaatattaacagaatagattcatgaaaatcatcaaaagaaatattaacaaaatatatcggaggtacttataagggtagggtttgtgtgtgtatttatagaggtgagcgcgcacgttgtgatatatatcaaataaatcggtgatatatatcactattgtgatatatatcgcatgcgtttgtaccgtgttttaaaaaaataaatcggtgatatatatcactattcaaattcaatttatatatgtagaaaaaaataaatttgactctaaatagaacatacagttcactgctaaatttgttgttttctctaattatatatgctgaattatatgtttataaagtgatacattcccatattaatctatcttgtcaatttttttaagaaaaatatgacgttttaaacaacaggcacaaaacgacggatgttccctcgacacaaatatcatctcgtatcaaactatcagttaattgtgtcaagacatgcatggtaatatgatttttttttgtgtggttgcagcaaaggctatggggttggagatgagccctccagcttttctgtcgcttaataatagcctgatcgaagtagatgcgggtttcagcggcatcaactatgcttcagcatatgcggttatttggacaagatttgtaagtagtcaaacattccgtccttcgatccgtgctctaccgagccataaatatgtatgtaccttttctacataaaccaaaccatctgttgggagttatacacagaaatacaatatagttgggaagagtctcgttccggtgctttatacttgtagtaaaattaatctgaaccgttgatcgtatttaatcgtagtgttgagatatagttatactcccaccagatttaatgaagtagaaatgtggaggggtatatttgtccagagataataattcgcgtagggtattatgtaatttgtcattatctaactgttcaccctctccctatcctatcctaatcgacgccattcccctccatccctcttctccgtcgtccgttcccctccatccctgcctccgtcgccgtccatctccctcaccgcctctatcgccgatccttctccctcgccgtctccgtcccctccagcaccgccgcctcccttggcctcgccgccttctccgccctctccgtcgccgtcctatcctccgccagtgtcgccttctctgcccccctccgtcgccgtccgcctcccccgccctcgccgccttctccgctccctccgtcgctgtccgtctcccccgccctcaccgcctttcccgccccctacgtcgccgtccgtcggccccaccctctccacctccgacgccgttggcgtctcctcccccttcgatgcccttgcctcccccgccgtcttcctaccctaccctcgccgcctccttcgacgccattaatcgcctccatcgcccgaccatctccctcgccgcgtccatcgcctccagcgccctcacggccctctgccccatccgcctcctccgcctccagcgacctcgggtgtggctgtggcgattcgccggtggtatgcggctgtggcggagcagctatggagctgctcctcgtattttcgttgacgaccaatggtggccctccctgaagttttcatctcccgtgtgagcccctctaaaagcctactctttctcccgattattgcagaaaatggctgctcgttcttcaaaccattgtattgttttttgattattttggttgaattgttaggagcagggtcagtatgcaagacggtggcgtgcgtgaaggggatctgcatgccggcaaaggggttctcggtgtataggtgcgacgtagaagcagatgcacgtgagtgacgcggacagcttactgccatgagtcatcccgaagcgtaaggttttatatactgctccttctcattactattacgaccatgaatagaatgatcgttgttatttggctatcggatttgttgtggctttccatttcatgagccttatgtgtgtgcttcactgtctgtgaccccaacgtagcaaaatctgaactatgaaaattaactcaaaatgcaacaacgtttgggaccaatgaaatactcaaggagtatctaaaatctgtaataagtggaagagagcatagtaaggtaattatatcgtggtttgtagtagtggacagtctttaatcttgttcggttcggacttgatcaaaattcctgctaagtcctgtcgaaatattttcatatccttctgcataatgtaaaggtccaattccctacatgcccctgtaatttcacccaatcccttctacgcccctgaaatttgtttgatctcttatatacccctgaatttttatttggatcccttacgtacccattccattagttgaccattagtttgaccgttagttattgtagaaattactttattgtcattggtatattgttaaaagctagaaacgttttgtgtaaattatttgagttgtgaaaaccaataaggaataatttactaaatatttgttatgaatttttaaaaataaaacattatttcattaaaataaaaaagatttattgtaaaaaaagttctgcataaaatttgaaaattacttttcaacaaatatttagtgaaaaaagattcgttgtgaaaaaataaaggggatgtaattagtttgtcacaaattagaaaacaaatttaaaatttttaaataaatttcagatcaaatttgatgaatttcgtatatcttcccaaaaatttaaacctaaataaaatttagtttttgctcttaattttctggtgaaactaatgtatggatttaatcatattttttaaaaaataaaaaataataagttttattttttaagttgggcattaaatgattatattgcttgtattttgtataagttaatttttttcatatgaaaatttattgagtaggtaccacatatgtataggatgggtaatatagtcgttgtaaaatatttaacggtcaactaatggtcaactaatggagatgggtatagagaagattaaaatgaaaactcatgggtatataaggaatgaggtcaaattcaggggtattgaagggattgagtaaattttcaggagtatataggaattttctctaatgtaaagggagtgcattttaaatggttttcataatgg

SEQ ID NO: 50525 - DNA, 10877 bp, Oryza sativa
attcctcgacagctggcgcgccaggtagggggaattcgcgtgcttcaaagagaagttattttcttctgccccaagttttcctccgccttcgacgatcatggtcgaggtcttggaggaggaagtggtggtgcacacccccactccctccgggagtgaggatgctagcgggagccgcggcccccgtcaccaccgccgcaactctcggactccgccccgccgcgacccctcgcggagggaggatcccacccggtcgggtggctcggccctctccccgcctccgggcggggggaagccatggcgcatcggagcgcgacgtcgcctgacatacggtgacggtggctcgccccgaggcgcgcttcaggcggcaggagcccttctacggcatcctcccgtgaactcggagccagagacccccgtccagcgatggttggacgacgtggccaacctggtcaccactgcctagcggcagctggccgcaggtggccggcccaccaccactagtacgtcgcgtacccccaccaccctctcctcgtcagcaaggaggagggcccgtcggtcggccacggcctcgaggcggtccacggccccaacgtcgtcaggggcctcaggaagtcggaggcatcacgatggcctctacggggagcaggatgcttaagcgacgccgggacgagcgccgtgctgcccgcatgggagaaggcgcctccttgttcggagtgccgcattcctcctcgcgaggcggtccgccccccacgttcacccctggagggactagttgtagggccttcgttgcgagtcttgggaatgtccggtggcccccgaagtttcgccccaacctcacggagaagtataatggcagcatcaatccctccgagttcctccatatctataccacaatcatcgtggcagcatcggggggggggggacgaccgggtcatggcgaattatttccccatggctcttaagggtcaagcgcgcggctagctgatgacccagccccctgactccatccactcctgggaggacctgtgccagcagttcattacaaacttccaggtcacgtacccccacccaggagaggaggcggacctgcatgctgtgcagcggaaggacgatgagtccctctgctcgtatatacagcgcttctgccaggtccgcaacactattacgtgcattccggcccacgcggtcgtttatgcgtttcggaacggcgtgcggcacaaccgcatgctggagaaaattgcctccaaggagcccaagaccatcaccgagctcttcgaactagcagacaaggtggctcggaaggaggaggtgtgggcctggaactcccccggcaccggcgcggcggctgcggctgcccccgagtccgctccccactctaagcggcgagataggagggggaaaaggaagccggtccgctctgatgacgagggccacgtccttgcggccgatgggccctcacgggccccgcgcaaggaaaaagccaccggcgacaggccgagctccaccgctacatccggcgagggtcggtcggcagacaagtggtgctcggtgcacaacacttatcggcacagccttgccgactgccgcttggtcaagaacttggccgagggtttcggaaagccgatgaggagaagcggcagggtcaacgggagggcaaagcccccgcgagccctgccaatgaccggcgaggggaggccaagaagaaggcccccgccgatgacgatgatgacagcaaggatctggaattccagatacctcaggggaccgtcgccaccctcgacgggggtgcttgcgctcacacctcccgccgtggcttcaaggccatgagacgtgagcttctggctgcagtcccgactcacgaggcaacacgaaaggcgcgctggttggaggtgaagctcaccttcgaccagagcgaccatccgacagtgctcgctcggggagggaagttggccctcgtggtctccccgaccatccacaacatcaagatgaagcgtgtcctggtcgacaggagggctagcctcagcatcatctccccggctgcctttgacacgctcaaggcccaagggatgaagctccagccgtcactgccgatcatcggcataacctcggggcacacgtggcctctgggtcacgttgagctcccggtaaccttcggcgactccactaacttccgcaccaagcggatcgacttcgatgtggcggacctcaatctgccctacaacgcggtcttgggcagacctgctttggtgaagttcatggccgccacccactacgcctaactccagatgaagatgccgggccccagcggccccatcaccgtcttcggcgatgtcagggtcgctctcgcctgcgcggagtagcgcgccgacaacctggcggcagccatggagccgcaggtcccggaggcctccgcgtcctgcgcctccaagaagcgcctcacctcggccgacgaggtgccagtcaaggagattccccttggcgatgatccgtccaagacagccaaaattggcggtaccttggacgccaaataggaaagcgcgctcgtctccttcctgcgggcaaactccgacgtcttcgcgtggaagccgtcggatatgcccggggtccccagggaggtgatcgagcaccacctcgccgtgcggctggacgcgcgacccatccggcagaaggtacggcgccaaaccccggagcggcaagccttcatccgagaggagctgacgcggctcatggaggccggcttcatccgagaggtcatccacctagagtggctggcaaacctggtggttgtcccgaaggccaacggcaagctccggatgtgcatcgactacacggaccttaacaaggcatgccctaaggatcccttccctttaccacgcatagatcaaatagtcgactccacttcagggtgcgaccttttgtcttttatggatgcctactctaggtatcaccagatccgtatggctagggaagatgaggaaaaaaaatgctttcattactcctgtaggcacattttgttatacaactatgccttttcatctcaagaacgcatgtcctacttttcagcgcatgactcgcattactttgagtaatcaaatagggcgcaatgtagaggcgtatgtcgatgacctggtggtaaagacgcgccaccaggagatgttattataggacttggctgagactttcgacagccttaggtcaacgcgcatgaaactgaaccccgaaaagtgtgtgttcggtgtgccgacgggcaaactcctcggttttctagtctcctcctgaggcatagaagctaatcccgagtaaatacgcacgatagagaggatgcgtccccccagcaaacttagggatgtgcagtgcgtcacgagatgcatggtcgccctaagtcgattcatatcaacgctgggagagagggcgttgcccctattcaagctcctcaaacgccctaggccatttgtgtggacggaggaggaggagcaagctctcaatcagttgaaagcttacctcacttccccccacctatcctggtggccctagggccagaggaaccgttgctactctacttggctgcgaccccccacgcggtgagtgccacccttgtagtggagcgtggcgaaggtgacccgcgtcacgagcccggctatggcaagggaccaggggcccccatgactggcgatggaccctcgtctcccgacggctcgttgcccgaagccccccaaaccccgggagggccccgaggcccccgggggaggaagggaggctctggcgggtggccccgacgcctataatcctgacatggcccgagatacccccgaggcccctaagcacgggcaccccggaccggctgctcctaacaacaaggaccggccccaccgaaaggtgcagcggcccgtctacttcgtcagcgaggcactccgaaacgcgaaaacacgatatccacaggcccagaagatgctttacgcagtcttaatggcctcaaggaaactgcgccactacttccaagcgcatcgggtttccgtcgtgatgtcttaccctctcagccaaatcttgcacaaccgagaaggtactggtcgggtcgaaaagtgggccatcgagctcgctgagttcgaccttcacttcgaaccacggcacgcgataaaaagccaggttctggctgatttcatcacggagtggaccccggtggacgaccctgttgcatccaatgccccccccctcctcggagatggaggagacccaaacgccaacattcgcgccgggcactgggttatgcacttcgacggctccctcaaccttcaaggtgcaggggccggagtcacgcttacctcgccaagcggggacgtcctccagtacgtcgttcggctcgatttccgagccacgaacaatatggcggaatacaaaggactcctagcgggattgagggcggcggccggaatgggcatccgccgcctcctggtcctaggcgattcccagctggtcataaatcaagtctccaaggagtaccagtgcaccgacccgcaaatggacgcttacgtccgcgaagtgcgacgtatggaatgccacttcgacgggctcaagctccggcacgtaacccgacgcgacaacgcagtcgctgacgagttgtcacacatcgcatcagcacgagccccactctccccggggaccttcgaggaaaggctcgcacaaccgtcgttgcggttggacccccccccccccccgagggacccggcgccacggtctctgccccaatccccgacgacccatgggcctcggggcccaagggggtcggtcccgaccctcctagtcaggttgtttggatgactgacatccaggcatatctcgacgataatactcttcctgaggatcgcgcagaagctgaaaagctcgcgcgtatctctaagcggtatgtgctcgtagaagggactctaccgacgcggcgccaacgggatactcttgaagtatatttctcgggagcaatgcgtcgagctcattgccgacgttcatcagggtgagtgcggggcccattcggcctcacgcacattggttggtaaagccttccgacaaggtttttactggccgatcgccttgcaagatgcccaagaatgggtcaagcgatgcaaggcgtgccagttccacgccaagcaaacccactagccggcccaggccttgcaggtcatcccgctctcttggcctttcacggtctaggggctagacatcctaggacccttcaaagcggcccgaggcgggtatcagcacctgtacgtcgccatcgacaagttcaccaagtttcccgaggcttacccagttgtcaagatcgacaagcattccgccctcaagttctcaggggcatcacatcccgattcggagtgcccaaccgtatcattacggataacggcacccagttcactagagagctgtttggcgactattgcgacgacatgggcatcaagctgtgcttcgcctcgcccacccaccccaagagcaacggccaagtcaagcgagccaacgccaaaatcctcaaaggcctcaagaccaagacatacaacgtcctaaagaagcacggggattcgtggctcgaggaactgcccgcggtactatgggcgaatcggacaactccgagtcgcgccacgggataaatgccctttttcctagtgtatggtgccgaggcggtcctaccttccgagctttccttgggttcgcatcgtgtcgcgctgtacgatgaggccaaccaggatgatcttcgccgcgacgatctcgactatttggaagagcggagaaggcgtgcagccctgcgagcggcgccctaccagcaaagcctgcggcgctaccatcagcgccatgtccaagcccgatcactgcaagtcgacgacctcgtcctgcaccgcttacagtcgcgcttggggctgagcaagctctcaccgatgtgggaatggccatacaaagtgatcggcgttccccggccgggctccgttcggctaaccacggaggacggcacggagttgcctaacccctggaatatcgaacacctccgccgtttctatccatagagttgcgcgtcttttgctttcctagagctcgggccaacccccgcgcatcctttggcttgtgctggcttggccgggggctaccactgttaaatatgttgtatcttttcccctccccatcaataaatttttccgcttaagcggaggccgttgcacgccttttcttactctttcctatggctcgtcctggttcaaaggacgatttgcgcttactccagaacctacgtggcgttgggtgacctgaaaaccgccgaaagggagcctaaacacgggccgcggcgaaccctgggggctcagaagggcctacacacggccatccccgacccccggtcgtcgtagcctcggtctggccagacccgctgggtagctccctcggggcgacggccttgcccctcgccacttaggtcccgcggatcgagcgcgaatttcccttttcaccggaacgagcccgagggggggtataaagtgggtaagagcggcaacttaatcactagaaagtcaattgaatacgttagctttggtttttcttctttccttgccgcagacattcaaaggagaaagcaagaacataaaggagcgaaggggaagctttatttacaaacaggatggcacgatggcctaaagtttgaagcgttcaccgcgagcacataacaaaataaaagaagaaaagcggagatagtcacggagtgctcgggcccccgagtccggcgccgctgaccacctcgtcccagtcctcgccgccgtcatcaccaccatcgacctttctcccgctctcctcgttcaaggcaagtacgaggttgaaccaaggggccgacccctcgaagttggagacgattgcgtcggccgcctcccggactcgctcctgagccctcgccttggtccccggggggcagtcctcgagcgcgtgccacgggaggaagtcggggtcgcgagcttggtgactcgtgaggaccagctccaccgtagcccgcgccaaagaagccgacgatgacttcacggcctcgccgacctcctcctccagcctctccaaatctgccgccatcccgtccagccggaacgcaagtgccggctgtgtaggcgggagcttcctgtcctggcgcacggagatgcctacccggcatcccgcgcgctccagctgttcgacggcgtcggagagttggccaggtctaatctcgttggtgaggcggagggccacgatctccccggcttggtcctgcaccaggcgccccaggtcggcgagagtgctttgagccgcggtgagttggcttaccaactccgcgccgctgggctgcccgcctgccaccagctctttctcgcggcctccagctcggaagccctcgccgccatcgccgcgcgctcagcgcgggcgctttccagatgccgagcttcgcgcccgcaacggcctcctcgcgcttcgcgagttgctcgcccagccggcgtgccgccacctcgcggcggttcacctcagcctcgcgtacggcaagcacggcgttccgttcccggcacgcctcctctcgaagccgcagctcctccgcgcaacgagccaccaaaagcctctgcggcgagggtggtccggttgcgctcggcagcggcctcctcacggaggtggagggaggactccgcctcggccgccgttctctcgtgggcggccaaagtggtctcgcgctggtctagcatgggcgcccactcctccagtgcccgggtacgctcctccagcacccgagcatgctcctccacccccgggctcgctgcgcctgttcctagctgcgcccgtcctgttcgcgctggttgcggtcgaggacctcgatccgtcgatggatcgtggcctcgaactcctgcgcggagcgggcacgctcgtccaaggccttacgctcggcctcgagcaccgccgaccgagcccgcaacaaggcatcgacctccgatgcccgcctctcttgggcggcagccgcgtcgaggactccacgggcgtcttcaaccctcttcaccagatcctcggcgtgggcctcgtactgcaggcggatgtcgcccagcacctcatccaggacgctcgaagcgatgagcgccgcctgccgctcctcctccatctcccgcatgactgagtccagcgtctcttcgcgcgcctggatctccgccagttgggcttgatgcattttgtgccccacctccaccatgtcgtccacagcgcggcgcccctcgtcaacccacgcgcggtccgccgcgagctgcgcccactccgcctccagggccgcccgctcgtccgccagggcttgaacttgggcattgagcccctcccggacggtggagtcggcggcagcgagcacctgcaggagtggctccatgctcgcaggagtcggagaagaaaaagtcgcggtccgcccccgggatgacggagtgctattgaaacccccgcgggactgggggctgctctcggcccccttctacgtggccagccccgagggtgccccagatgcagaggggaacggttgcccccgtcccccccgcctcgagccctcgggctgactcggcctcggcctcgggttcgggcccgcccccagcctcggcctctgggccacgacctgctttggcctccactcccgagtggcgctcctcgtgggtcgcgccctcgggatcgccccccgggggggcgccaccgccgctgccatcacctgtggctggctgcacctcggctgtggcggactcggagccagacccagcgtgtggcccgtgggccccgccagggtactgcgaaggccccatagcaccgagtcggccgggtcccggtcatccggtcgctcgaattttgacccctgcgagggatcagacgccgcgaccctctgggaaggaatcccgctaccggagaaccctgatcacgttaagaaagaaaagaagggggaaaagcaagaggccaaggtggatagagagcacctagtcgggtgctagcgatcgtacctgcgaggggggcatttgaaggtctacttcaagggcccgatgaaactcccccggcacggctccgtttgccctatctttcgaagccgcttcttcttccatccagcctcggacgtggcggggcgtttgtggcccgttggtggtcggtccgccgttcgctcggcgccccctctgcgcaggggagaaggcggccgagattcggacacctttcgcttcccgttcgggttgctggccaggcccccccccccgggtccacggctcggactgggcgccctggagccgccgcccccgccagagacctgcggtcgcgccgcagctacccgcgccatcgccgccaccaccggcgccgccccggcgggaccgacccctgccagcaccgatggccgacatcacaaccaggatactctcccggtcgcggtcgctgcagagggcgaggatcccgtccggaatcagcgtttgctcaccacccgccggatcaccgtcttcgcttcctccttgccccagtcccaacgctcacccacgtgggtgcgaatgggatcgttgtgcccaatgtactcccacgcgccgtgggaccgctcctggagaggcgcgatgcgacggcggaagtagtcgccgaacaccatcgcccccattaggccctggcttcgcaggcccctgaggcgataccgcacagcgtcgtactcctcgcctagttccgaaaccgctaaccacgcggcggatcgttcgggagggccggcgaggagccgaagtcgcggatgatccggcagcgcggtgtagaaccaatccttcttccaatcctcccacttgttgtggaggtggctctcaatgtactgccccgctgttcctggccagggctggaagtagcatcctcccaccaccgcgccttgcagcagctgtgggacgaagaaggactggaacagccgcatcgtcggccgcaccccgacgaacatctcgcacaagtgcgcgaagatggccagtgtcatcacggcgttgggtgtgagatgcaaggcatgaatttcgtagaaatccaaaaccttatggaagaacctggagaatggcaggatcaaccccaccatggcgaaggacaggaggtgcacggatcgctctgggtaccgcggccgcggccgtgactcccccaccatcatggcggcgtcctccggcatgatcttgcggatgaggctaaggtgcctctctgccgtgatgcgcgacaccgggagcacaacgtcactagcgtcttgggccatgatgaccggcggggaaacggcgaggagtttggtgtacggaatagcgtggagcgagagaagcgttagggcttgaggagcgagtgtgcgggcgagcagtcggcgagaggaaggggacgaaatctccgcctccctatccttttatccccgcctcgaccgcgctcgcctcctcgtttcacgccctcgcggttgcctcctcgattcctacacctgcggttgcctcatcgtttctcgcgtccactcatcacatcgcccattgaacccacgccccgcgtttagtgcgcctgtcagcggcacactcggcgcggggcgtgcgatgttcacgggcgcgattaggcgggcccgccgtcggtcccatcgcatgcctggcaggtaggggagtcgaggcggcatgggtgacgattctgggcatggccaggtcgaccccctgattttcgcgccctaggcgcccccatcatcagcgcggttaatggcggtcaaatcgccattatggctaatgcgccagcctggccgctcagcggcaaccatctgggttccccgccgggcccacaacctcggcacgggaagtcgtgaggcgccacgtcagactgccctcagggggccaatgtccgacgcggtgccgggggctactatcggagatatgggcccgggg

SEQ ID NO: 50526 - DNA, 3963 bp, Oryza sativa
cagtggcagtggcccgccggtggttgctgctcatgtgtgccgcccctctccctccctcctcactccatgatttctatgatatgaattcgtggtttgttggagctgttgtaggacatgaatattagtggtttgtaggatatgaatttgctgttggagctctcaaatctatcaaagctatgtcaaatttgttataaatgttttaaaaagattcaaattaaaaaactttgatataaacatagtcaaatgagcaagggaaaaaggacatctggcccgtaagttaacaccgttagttggacttcacggaataaggtcaactctgatcttcatttttgaaaaaggatcaaataaacaaacctagaaaaatagggtcaaattgatagttacgtttcgagatagggtcaaataagcaattatccctacttttatagcaaagcaaatttcgatccgtatcaccaaaatgtataactgaccttaggctagcaagctgacactgatctagacgcgtatggttatttgtacataataaaaggttagttgtacacttgtacaaagtcaataggagtctatacgggacagcatcatatgggtccaaccaaattaacaacgcttaccagcaaattgtgggcattctattgtttcttctaattttcgaaattctgtaaatagcatgtgcataatcctgtcaaccattttttaaaaaaaaacaagacaaattactacataagttcatggttttaactatagtacaccgtaaaaagtaaagttacactctctaaatgtgataattacctagtggacaccactcccattatttcagtgtgttcgggctgatgacacatgagagggcccactttttgacacggcgcgatcaagttacccctattgtatatttagactaactggatccgtcaaccctttagagccctatgtcgccaccccaaccatatatatgctctattttgacattgccaccatgacccgttcatcatccctgacccactaggaatagggatgcaagggtgatctcgtgctaggagtggaattggcttgcagcaatggctacactgttgtcagagcagggcgtggaatctgttacgaagctggtgaatctaaaatgggtgtccaaagggtaggctcgatttttctttgttttgattcgattgggatgcatggtttgttgatttcgttgagttgagttcttttcttgatgtacttgcaatggggtagaaggctagatttgcctggccagcgtcagttgtcgagattggtttggcttaggacattgtcggagatatgggccgagggtatgcaaagtgaggggaagttaccttcacatccagccgcgtggctctacagcctggccctacccccgcacctcgcgagtcacagaggcggccggggggcctcggggtgccacgtcatgcccctcaggccctcgcgctgcccctccccgaggccctcgcccaactaccatgtggtggggggagcaagcggggaggagacccaggctgaacggccatcaatgcgcggcgccccaactgtccctcaccgcgtttaatgcggtaagggcggacgtgcggtgccactagactgacccacgtcaatcgggtgtgaccagtctgtgaccggcctgttgccggccacgtccgattggacgggcggccgtgcccccacgtcgcctctgtattcggcggagtggaggtaggtatgtcccgtcccatcggggcgtcatctggggttccctccacgcgaggaccgccacaagtcttcactcatttaagaggaaatgatagggctgtcccccgtggcaggcggggggcggcgccggatcccactaaaggacgaactgccgcttagcttccgggcgaaggcacggatcgtggtccggtcaaggtaaagtgggtccctctcccataaaagagtaggtaggagcggcgcatgtggtatccccttgaactataaaaggaggaccttgcccgctgaaaaagggggacgactcccagcaggcctgagctttagagggagcagaccaatagcactctccagagttggggaacccttgtaacactcaatcataaatcccacacacaggagtaggatattacgctctatagcggcccgaacctgtataatcttggcgcccatacgcgatctggaaaccctgagggtggatacacgatctcgagaggcgaacccttttccccggctgaactcaaaaagggggatctcacgatctcccgctagagaggatcactcctcgacagacatgtttgagccagaccatctcaatttgagccggatacgcttacacaatttttacaatttgaccctttgaaaaaactatttttacaaatgaacctccgccaaaacttatttcaaaaataacccttttttcagcgccaaatcatgtggcgctgaacttagacatctcagcgccaaatagtgtggcgctgaatgtgcgttggcacgctgacttagcctcccatccgcgatggcacggcattcagcgccagtagacgtggcgctaaggtgtcaagttcagcgccagatgatgtggcgctgaaaaaaatgttatttttaaaataagtttggcggcggttcatttgtaaaaatagtttttttaaagggtcaaattgtcaaaatgtgtgatacacttagggccaacttggtcaccctatgtcaaaaaataggccctctcacacgttgttagcacaaatacagtaaaataataggcacaatgttcattagctaattaccacattaatagtgttttcccctataatgttactcttgcgatgtcctaaaggtaaaactagaaagcctcaagattctaaatgaaacattgactatgtatataattaactagactccggtcctcaaaaagcgcataactccataaatatatattctagaggtacatatctcatccttgaaaacaagtagaacatcaataattacactactggtaccacacacgtctcacataagttcataatctggcaaaatatatattgcaaaccatatatatagtggaaacatgtaaactacatattgttgaatcaaaatgcaaaatttgctacatgacacttaaaaacttattatctttgctggtagacgtcgtaagaatgtgattttttcctaatgacacttcgaaagcgtggtaatttgccataggacaccgagcgcataaaaatacaatatccacccaattgatgagagaaaaactatgtaaaatgtttgttttgccctcatcttcttctcccttctcatcttcttctcccttctcctggtcttcttccgacaataggcatcggcggtggagctatcatggacctctgccttacttccctcgcaggacatgatggttattgccgagatctacatgagatgcgcggtgaggttcttggtgtcgatcagagcggccgcctccacgcgggtgctggcgaaccgtctgggccaatcgaggaatctctcaacgacgagcgacatgttggggaaaggcggtgaggtagaccggcgaggcggcactgcgggcaaagctacacaggtggaatccaccagtggcgcgacggaagtattggcgaagcaggcagggtccggcggcggtgagaacatgagcgtgcagtggtagctcaggaagtgcagcgcgacaagcagcaggagtataacgagcaggaggactatagcggtggccgctggggtgatgaggaaaaggtagtgggagtggttgttagcgggaggagagggggcggtgccgctactggtggtggcgggggcaaggaggagtccacaagggcaaacttgtttcttatgaattttctctttttgtttccatcaaatataataaaataatacgttgagtatacgactaattaccatatttctatggtatccacgaactaacatactttctttagataatgtcacgtagcaaagaccatgatattttatatcatgcagcaa

SEQ ID NO: 50527 - DNA, 5782 bp, Oryza sativa
gcccgggaaagagacgatgggagatgccttctgccgataacgatgcttttttttttccgaaaatgaggtgcgcctggtttgcgtgtcagccggtccgtcactgatgtgtacttaccttccgtttttgtgttaaacagacaagatggcagccatccttgctgcccatggactcagcctgcctgatacacactcagagtgcacagctccttttgccttggtgttgcgttggtcggcccacgttttccttttacaagaagcgaaaataaaagaaaaaaatgagcacctctcctgcagcaagcgaaaatagagaaagaagaaaacgagcaatttcccggaagctagagagagagaaatgaagcagaaagaataaaaacacaatcccctgattagaagtcacttcattaggccatgggcgtttctaggccttcaaatatatcagcgccatctcgtttcacttacgtttttttttaaaattacgcagtacaacgcagtcactcacaacacgcaaaccctacccctatgagcatcttcgaagactgggccggcaagtcaccacaggcacctcgctgtcgacgggtacgtcgcctaccactgaaagcataacgcgcaaaccctacccctatgagcatcttcgaagactgggccggcaagtcaccacaggcacctcgctgtcgacgggtacgtcgcctaccactgaaagcataacgccgttaaatcctggaaaattcgctcctatggggagtcgaacccaggacctcaggtgctactgaggctcttgtaaccactaggttacaggcactttccctcgtttcacttacgtttatatatacatgcatcaaattttgtattttaaaacttaagatttaagttgatttttttcttttttccatcgtagattttttttatagtatctgcttttacatcatatgcctatataaaatttctgaaatcttggaccaaattaatcacatagtccttgccaagaaagagtgcatgtcgtttgctgcttgaactgttcatctgttacttaacatgttatatgtccgcaagctggtgttaaagtgcctatatttgtggctctttgcatgtgcctatgtcctagtaatatggttgctaaaactaatgagaatatttctttttatgataaaagagttagttacatctatccattgttttgggaccacaactagagaggttttcatgcttttcaaaattattcgtaaacgaataattggttcatattcgatctatgtgtgcgtccatatgttacaaattaagcgatttttcttttcaatatggcttgacaggatttgattttttttttcttttcaatatgcaatgtgtcaatttttacgtggaaacaccggttcttttaggtaggaggttttttcttaactaagacatgtggcttttttacatgagagaaatacagtggttgagaaagaactggaatgaaggggttctatttttttttattagtagagaactctgagatacacaaccggatactagtattcatattcatgttcgcatatctgaaaaacgaaaacgtgaaccatttcaattctcactgccatgtttggctcgaatctctcgacttgatctgcacgttcatgctcattcaggatgcaggaggaggaagcaaagcatcctgtgcaacacggcaacgccggatccgtgcaaaaccaaacaaaaagcatccatccatccatccatccatggcagatttggcaggcctgcacagagcagagcagtaaaaaagaaaggagagtgcagtcaaaagctctcctctcctttcctgaacgggaaggcacagaaggcgtaggacagtcggaaggccaccacatctgcatgccattctcgtcattctcattctccctccaccgtggggcccacccatcacccctaacctaaccgccgtcgattcagggaggtggacggcaggatggaggcggcgcctcccacgacgcgcgtggtgcaggttcagagcagcagcagcagcaggtgtggcctccacattattaattcctcctctcctctcctctccttcctataagagagaggaggtggaagaaagcaaagcttagagagggagagagagacgacgtgctcatcgatctggttttggttggaaggaggcgcttcaggtcgttgctctccatctctctctgtgtgtgtatcctcttgttgttgttgttgttggtttcttggatcttgcaggagaatcttgcttcgtttttgctttcgcgcggatggtggtggataatctcctccctcgtcgtcgtcgtttttttctttctgggtgaatttgtttctgcgttgcacgcgtatgatatagctatagggtgggttttgatcgatcgatctctacgtgcgtactccatagtagatggaaacacacatccaagtactaggaggatatgggtttctagttgctttatatataccatgtgttcctctgctcgcttccttgctttttctccattttgcttcgattgattgaatgatttccacttggtttggttggtcgatctccatggaatctctcacccatccatacggaaatgccaagtctgcgtacgtctgcgtgctccttttcttgttgttgttgtaggttcatctcgcttctttgcctgctcataacacatttctgcacctgcatccaagccaagcagaagcagagctctcggcatggcggcgccggcggtcttcaccatctccggccgccgtcgcccgctctgccgacgagagagagatgctgccttgatgctttgatgcttgctgggctgtgtagtcactcactagtcaggcccatggcccgttaggagcctttcactggcccacgagagagagagagagagagaggggagaggggagagcaaccgcttgagcaacggagggaggcggcgccggatttttggtcgatttgagaattgagattgagaagatggattaaaaaggaaaaaagaagggggaagggaaaggcataaacatctcagttgcttgagagcactggttgtccatgggagagggacatttaattatttgcaacttttaagatgtgtcaattaagaatttatcactcgctgtatttgacatgtgggtccttatgtgtctatgacatgtgagtttaatggcaaatcctttagaactactcggaagagtggcaaatagttattattcccatgggggaagttatcatgggctgcggtgcgactaagtccgactgaactgatctttgatagttagtgagggtgcctaaaaggtttcttgattatacatttatacttggactgtgtagatatttcgagtttcgcttctatagggctgtttctgatgcaattgcaatagattgcatcacctctgttcattggcagtagttttgtttgctggaactttactggattgttgcttaggctagttcaggggtgcaaatggggatggcattgcctatcaggtcttctcaggttatatacttttcctgtacttgttctgagtgtagtggttcctgaaatgttctgtgctggtttctttaatggaaatgggaggggatctgcccttcttgctaaaaaaaagaagtagattgcaaaatgaacacacatcagtgagttatttcaaaactgtaggattttgtgttgcttgtttcataattattttgctgctgacttatttcaattcttctactgaagcacatttagtgttagagaatctgtaacactgtctaatgttgtgtcatgcaaatgcaaattgaaatgcaatcgtaattcctattctaatcatgaatgaccattgccctgttgttctgtgtggtcctctgatgttctgaacaatgccatatgcacacttactacatccttgcttgatttttttttaactgtggttgtaacaaaggtgcatccagtgctgttttcgagctcaatgcaatgttctcacctgaatatttccgtgtcactcaggtctgccatggatttcacctccgacgagtcagagctaagtgatgcagatattgatgactatgctgacaagtgctacatggacctcaagtctgggaagccggtggtgagtctaggcaatgaaaagttcagatgcccattctgtctggggaagaagaagcaggactaccgttacaacgagctacttcagcatgccattggggttggcgcatccaatcgcgctccaaaggtgaaggcaaaccacatggccttggccaatcttctcaagaacgactatgctgatgcagcaggctcattgccatcacgacaggccattggaccaagtaatcctccaaggccattgcaagatcaggaagcgtatgtttggccatggatgggcatccttgcaaatgttccagctgagaaaacaaaggaggatggagctagtctgatgcagcagctagctaatttcaatcccttgcagtttactgctgtgctctgctccgagggtaggtatactggttatgcagttgtcggtttcagcaaagattggattgggttcacgaacgccttggcattccacaactacttcaaatcacaacgtctgggtaaaaaggattgggcagcacttggacaagagaagtacatctgtggatggatggcaaaagaagaggactacaaatctagtgacccagttggtaggtttttgtcagcaaatggtgatctgaagaccgtgtctggtctggaaaatgacctgtctcgcaagactgagactctcatagctaacttgtcacaccagattacagctaagagcaagtatttggtggaactggaatgcagatgcaatcaaatgaatctctctgttaaaagggcaatggaagaaactgacttgctgcacaaaagttacaatgaaggtacatactacaaactgttcatatgaataattctcatgccatgggcatatgattgctatgttgttgtctacttttattgccaatttgccagaataataatatctattgtgttgtttcattttattgctgttacagaaatgcgaaatatgcaatctgctgctcgtgaacattcacagaaaatatttgaagagactgatcagctgaggaaacagttggatgataaagagaatgccatcgagaggagatccaagcaactaagcaagtttgttgctcaaactgacatagaaagaagaaaattggagagtgagatgaaaaaggtatgaatgtaaccacagctttgctctctttgctttatgttactgtttagcatttgcatttcctcttcagagttctatcttcaggaacagctatgacaatctttctaggggtgacaggatttctgtatacttgtcatgtatctatattacacttcctgttagctccgcatttacagtctggttacgatgatctttgttagaatatcttatctgactgtttgtcttactgatttcccctacagaactctgagcaaaacgactccatccacatggctagaatcgagcaacagaagtctgataaaaatgtgctaaagcttgttgagaaacacaaggtctgcactcttgtttccaattattaatcttatgcaagattcttttaatttctcatgctctggaatttactctggcttgtaaaaatctcacagaaagagaaggagattgctctgaacaaaatcctgcagttagaaaagcaattggatgaaaagcaaaagctggaactggaaatacaacaacttagaggaagactgctggtggtccaacacatggagggagagggtgttgatgtgaagaaacgtactgacgagctgactgaggaactaaatgagaagattgaggagat

SEQ ID NO: 50528 - DNA, 1249 bp, Oryza sativa
  unsure (1)..(1249): unsure at all n locations
ctggcttgtaaaaatctcacagaaagagaaggagattgctctgaacaaaatcctgcagttagaaaagcaattggatgaaaagcaaaagctggaactggaaatacaacaacttagaggaagactgctggtggtccaacacatggagggagagggtgttgatgtgaagaaacgtactgacgagctgactgaggaactaaatgagaagattgaggagatggaatatatggaaggtctgattcaaactctcattatcaaagaaaggaagacaaatgatgaactgcaagatgccaagaaagcgctgatttctgtaatgtgatgatatgctgatctttcctttctactgcttgacagagtctgaagatattttcatttgtgtttatttggactcatttcagattcaatcttattatactatgattgtggctgagacctgagtttgtgcgtatgttttgtagggcttatcagaattgttaggccctcgtagcaccatcggactcaagagaatgggcgagctggatgagaaacccttccttgcagcttgcaagaaaaggtatggtactgctgacggtgaagctgaaataaaagctgctgaattttgctccgagtggcaagaaaatctgaaggatgccaattggcatccgttcaagattgttaccagaggaggaaagactgaggtatgctcaacagaatgaaatcttctggcacagtttttcgcattcgatctcccgacaaatatatgatctacacttccatcactgacatgacaacgatatccgttttcttttctgtagcaaatcatcaatgaagatgatgagaagctagtgggcttgaaggagcagctcggtgacgaggtctacaaggccgtgaccacggcgctgctggagatcaacgagtacaatgccagcggcagctacgtggtgtcagagctgtggaacaacaaggaggacaggaaggccagcatgcaggaggccttgcagcacgtcctggagcagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50529 - DNA, 4983 bp, Oryza sativa
attttaaaagagaagtttctaccgtatattaaaaaagaaaaaatgcacgagaaaataaaaacggtttaaaaaaacgcgtgaggaaaaaatgtcaaaaaaaagcgcaaaagaaaatgcgctagaaaaaatttctgtaatccgtaaaaaaacacgtgagaaaaaatatttccatcgtatgtaaaaaaagcaaaaaaaaaataaaaagcatacgaggaaaaaactgttagaaaaaaacgctaaattgatggacacttggtcggataggatccagtgtttttttcatctcctacacgacttgtgtttcgtcaatctattctcctatattggagaccttgcacatctttgtaggcaattattagactatttttgtgaagtgtagctattattcttgataacatattatatggaaataatattagaaaataaacatattttaattgttatttaaagaagagtgtacaatgactctattttgtgtatacttgaccatacgaggcagcgtaggatttgattggttgcaagaatgagattaaaagaatattttagattatatgcatgttgtcatatgaataatccaattattttaggtaaagcaaacatcgtaagattgccatcatcgaggttgggccattacatttaagatgttccaattttctgattgtcatcgacatggttatgcatgaaaaacgtatattatcattatgtttttttttacccgttgcaacgcacgggcatgcttgctagttacttgaaaaatacaaggttttaatcgatcgatgcagtacatattattgggatccacttaatattattcggagttgcttttagcaagaggatagtcagaccttgattacatcgaatctgcttgtatttttggatctgatggccatcatcaaatgagattttctaaataccttaacatgatggaatttattcaattagcagcgagcaattaggatagttgagattgattttttttacttaaaaccgagtgttaaattatgttctatttctaaattaccctttaagagattcccaagcaccttaagaagtactccctccgtttcgaaatatttgacaccgttgactttttagcacatgtttaaccgtttgttttattcaaaaacttttgtgaaatatgtaaaattatatgtctacataaaaatatatttaacaatgaatcaaatgataggaaaagaattaataattacttaaattttttgaataagacgaacggttaaacatgtgctaaaaagtcaagggcctcaaacatttcgaaacggagggagtatctcgtataattcccaagcaccgtaagctgaaaaaacttatagttctttataacagtaaaaaaatattcctttcaaatttgtttgcccaaaagacaacttttttctcatgattatgttgagtcattgcatcggttcaataaaaaactttatagtcttcaatagaaagttttctggaaaaaaatttatgttcaactattttagtaccccaaaaggtttttctatcacaggttaaaatttcttttactctttatgtgaaaattaaaagttttgcaactcactgtatttcggtaaatactgccatccagggtacaacccttctttttctgaatcttaagcgtaaaaataagaggaaaactcctttgttctgtcagaaatgtatagccaaataaaagatcaaaacgtttcttgatacctcatcccattttcttggtatattaccaagaagccggcttgctgccaaccgttggcctcgtcagctgatgtcttctccatgcgtctctgacgttgtgttcgtccgtaatgctgcatacttccttcagataattaaattgctaagtttttccccttctatcaactactccttccgtccagaatataaggatttttggggttaaacataagtattaagaaaataggtagaattaaatgggagaaggttgtaattggttaagaagtggaggtatgtgagaaaatttagtgatggaggattgtgattaattgagaaggagaatgctggtgacggaattattatatttttgggacaaaccttgagaactatatgttattattatgtctacgagtatcatctagccgcatcatgcatcacctttggattcagacatccagtccatctataaacaaaccatttgatgtgtacaagatgacgtttgacacttttttttacatcaagcacaaactcgtagacatcttaacctaatcggcgtcacttgacattaacataaagaatcctcgagcatatggctcattagttaattcgtatatttctccatataggccaagagcccaagacacaattgtaaactatactagaatagccttggttaatttaatctcagcatttttaactcttcagaaacagtgacagatcgatgatgaaatgaacaataaaacattacattgatgttgcaaggagcctgtagggtcaactcttgttacgacagattgatgtgcagatgaattatatatatgcacatatagtagcatcttcctcctcttcttctaccctctgtccattgtatctgcaattctgcattaagcttgaaagacagtaggtacagagctgtctctgtagctactagatagtcatcctcttgttgaacttcagtactgaaaacaagatctgaatttgtatttgtttcccaggttagattcttctgtgtttctgaagctgttttgtttttgcatgtggcttcactttttcttgtgttgatgccagcaatgcctttctccattttgttttaggttccatctatcactttatgcagtgaaagtttgtaactacaggaaattaagggcgtggtttgtataaaatgggctgtgtatcatcaaagcagttcaaaagagctgcacaacatgaggatcctgctattctggccaaagagactacatgtaggatttgattcactggatacaccatggaaaaatatttacaggttctcttttggaaaaaccctgaataataataattgtaatttattgctattcttcttgcagtttcagtgagtgaagtggaggccctctttgagctgttcaagaagataagccattccatattcagagatggtctcattcacaaggtacttgcttaaaaaatctgctcaaacttgtgagattgaccatgtagctctgaaattctgatgaaaaatatgtcaattgcaaacggccctttccatgtacaggaggagttccagctagctctcttcaggaacagcaacaagaagaaccttttcgccaatcgggtcagtagcagtgatacccagtccatttcatcagtggattttatttcaacatatagaccatgatgtattggtgcaaaaaggcattatctgaagaagcacagttctacatatgtttggctgaattgtagaacctgttcttatgtgaaaatgctgacagtgtttcaccacaagtgcagatatttgatctctttgatctgaagcgcaacggtgttatcgatttcggggagttcgttcgatccctcagcatttttcacccggaaacgcctttgggagacaagattgcctgtaaggagttccagctctttctcattatatatggtcaatttaaccatcttgattttgttttctttaataactaccttctgtttatgccattttggtatttgacagtattcttttttgtagttgcatttaggttgtatgacctgagaggaactggatgcattgaacgtgaagaggtatgcattttagaaattagaattacttatcatctttttagttccataaatcaaacatgctacccatatactgtgtagaaatgattcaacatatagtaatttccatgcattaatagtctacagaactgatggtgacggtacacatctataccatcaaagaaacataaatggtgtgtttccaaatatttgttgaatccagttgatatttaatttaaataaatccttacatatccataagaagcctcaattcaaactggctgagtgtgaaaaactggaaatttgtatgtgtaccgttggaaaataatatgcataccgtcttaccgttttaactgacagtcctggagttactgaaactatttttctttcttatgaatcaagcagttgcacgaaatggtgcttgctcttctgaatgaatcagatctattcctatctgaagaagctgtagaacaaatcgtggatcaggttaagtgcattcagattaaatactaccttcagtttttctatttcccaggcattttttagcagatttcagttcatttctttcacaaagttgccactgctttcatgaataaatcatatcattaacctttatgctaacttgagcttttacagacgttcaagcaagcagacttaaacgatgacgggaagatcgaccccgatgaatggaaaacgtttgcgagtaaaaacccggctttgctgaagaacatgactcttccatacctaaagtaagtctgtctacaagtttcaggtttcactccaattacgttttactgttttacatcactttatcactaaatataggggctgttcagtttgttaccattttcaaccatatcaaatttagcattgtcaaattttggcaaggtagcagtctaagtacatcccaaatactccaccataccttaccatgccaaaattttggtgattttctagaaacctctcgacataacactatacaagaatatttagcatagtaacaaaccaaacaacacccacacacttttctaccctaccaaacttggccaaattttggtattgccaaaatttggaagggttaattttggcatcaaagtgaacaaacccataaaatttgtaattctgatgcctaaattgttcactttgtgttcagggacataaccatggtattccccagctttattctgaactctgaagtttgtgaggaagagttgtaacatccatggtaccctctgtgctccatttatattcctcacaaaggggcatgactacatgggg

SEQ ID NO: 50530 - DNA, 1382 bp, Oryza sativa
cttgagacagtagtcatacacatgcgcatttgttgtgcatggatggaaattttgtagtaggatttgtgcaaacttattccgaactgatcttgtgacgattttcaagctatgtttgatgtcgcattttcttcatttagcaatgttgtgttacagttacataataagtaatgtccaaatgcatatttaatgtagaagttgaaactatttccattattatgaaatgttctattccaccgttgctagaacgatgacaataggtgacatattatattccacttgttgaatctttatgtggttaaaaaatgattatagcattggatcagaagctggttggccagagatagcactcaacccaatagggtttaattctagactagcgctatagaaacacgtgtcattacttcgaggagcaaaacattttttttaaaaaaaaggagaaaaaccgtactcctaggggtggtatttattgatgatttgacattagtatccaccaattttaggactacgtgtgtactgcatgtgtttggtttgagaatgagctgagatgggttggacttatccctgtttttgagatgaaatggtcttatctattcgtttggcatatgggatagggtgatcgtactttttaagagatggcccgcatgtcagcaagagaaaaaaaaggtttggattggtttgccggttttgaggaacaagatgaactcagatcttagtggaatattcccttttagcaatcatcatgttccatctgtcctccaaccaaacacactgaaaaataggttcaacacaatccgatccatcccaacccttaaaccaaacacatgctaagagatggtcaacatgtcagcaagaaaaaataatgggttggattggttcaccagaggaatattccctatcagagaccatcccatcccacatgttctctagtcaaatatgctgaaacataagttcaacccaatccgatccatctcaacccttaaaccaaatacatgctaagtggatatgcatatgcctgagctctacaagattttgatgcctccgatgatacttcaagcttatgtaaagaacatgcatatgcttacgcagtgttgggtgtgcactaaattgtagtactctaaaaacggatggtttggtgatacataggatgtgatatgccaatatggcacacacttaaaaaagtttgtcttcttctctaaatatctttacatgctttggactatcgccatgaaatccattggtttacacctttttttttaggaaagaactgtaggggaagcccccacagttaaaggatattattaagatataaaaaatagtattacaattggtttaaccaggagattaaagttgatctctcatctaattttaagcaaaaaacaaga

SEQ ID NO: 50531 - DNA, 1126 bp, Oryza sativa
tgaatttggcaatacgatgcatgcattcgctaataggtgctaattaactataaatttctatgtggatattcgatctccaaatatgtatatatatagtccactcatcttaattagcctttttggaatgagttttttaatcagtaaaatttcatgttcaagcagatatgcaaccactgattatcgtggaaatgctaaatgatacatatatgggtcaggatttcttatttcataatagaaatttttattgaactcaccaatataattaggaggatgtaatggaaatatccactacaacgaaaatagttattccaagccgccaaaatgccttttgcagatggatcgccaataagcaaatacctataaaaatcataattttcacatatagatccctaagacgcccacctatgttaatttcatcatgcatctggtaccaaattatgtcaatcaatatatattaggaatctctcctttcattctgtaggtgtttatcacaaacactcaagctctctggtgtgccgcacgcttaaatgcaaaaaccacggcaacacaggtgcggttttcgtttatgcagaccacaagctactagcatcattttcttctctttatatatatagactcaaattacagaactaacagccggcgaaatcactcaaccgagactcacgccacgtgttggaaacgttcaagcagcatgcaatacatgcaactaaccacaggcgcatttgtcttaactaatcttgcatacatatctactgcttcaactgattcacctggctaacttggacctcgatcgtcttgcaccactccacatgcatgcagctctgcttggtcttctgacttgttcatgaacccttttgctccatttgcaccaccgcatctcgtccatgagctgaaaccaaatataccatgcatataaactctaacaatcaaatcctttctcttttggggtgttgatctgtgttgatcaatggtgcatgcatgtctaaaagttactctaatgagaataatttttaatcttttattctggtgggcccaagacacagatatcaagtcacagtttgattggccggccttaattaaatagggtgtcgtgctagtattttttatgatgcggcaagaaattaat

SEQ ID NO: 50532 - DNA, 2012 bp, Oryza sativa
ttgttcccctcccgattttctttgccttttctctatcccctccatcagcgcctccctcccacccgcatcttcttccacctccccccatccatccgagctccttcccttccacctcccatccgtcgacgccaacgccggtggtgcggcagccaacggtggcggccaagggcggcggccaacctggcccatgcgccaccgccaccggtgcccaacctggcccgtgcggtgggggcaccgccggggaagcgaatcgaggtggtgagggagcgggagaacacacttctcttgttcggccgggccgccacgcacgccgccgtcgccttcgttgagttcaacgtccatgtatatatatacagcgtagccgagttcgatgtgtatgcttccatttccatgttgttggtagtacctgtgtttgttttggactttgcattggatgtcagtttacgctttggattgtttgattttgacaccgcagcaacgcaatgcaagatttggaagctagcgtgggtatgacttggatgtagccattgattggtgtggtactggacatgaaatttgcagcaacgttctagccagtgaactatatgggataagcctcacaagtaggagtatcaatttaattgactcttgtcaacatgtgcattaatgtcattgtatactgagaaatgcttactctgtctttgtgccaatcatttgctggcaagcttgtaaacccaaatattctctcactactaatgcccagtactaaggactggtttggtttgtggtctaaattggcattaccaatttttatcaatgtcacattttgacaacttttggcatggctaattttggtaaacgtaaaattgtgtttggattgaaccctaaatagcctcaactaactgaggaaatggcatattttcttaggcatgccaaaatttagctccaaaccaaatagacaataaacactattgaagttgacaaatattggtaaggccaatttaggcctcaaaccaaaccagccataagtaaatgaggggtacatgtgtcttttgccagcctccttattttggatgaatagtgcccagtcccatataatgtgggatggagggagtacctcccactgagaatgacctaacaataacaccttttgatttgatttggaagctatgtatcaagcaaaaaccaaagtttgaattgaattacaaccattcgctttcatagaaatccaagaaaataagtcgatttgaactttaatatccgatactgtttaactctaacccactgaatcattcatatttcaatcttgagtttttcttttatttctaatagtagacaaaaacttcaacaagttcataaaaaaatccattttacatttttactccctccaattcacttaatcatgtaactttttgtttattttacttctaaactatcacaatcggtccaccttacatcttaggtgcctacatcttaatagtatttatattttttttctttatacaagttattttaagatgaaatattttaagccataaaaagatgataccattctcaagttttatattctcaatttttttcatggctatttgcttgaattttaaaatatctatgtttagatcagccttacgtaatttcaacctatgtaaaaaaatattgataggtaagttgtaatgcatttattcatcctactgaatttcagtgcaaaatataagttatataaagagaaaaaagcagagaaatagagttatggagtaaagtggatcagtttcaatagttcttagctgaagattagtatataggtttaagtgctctggtaaaatattctttatagggagtaaaatgaactttttttcttcaaaaaagtattgtttgcacggaggagtatttactactgtcgacatttgatgtctcgactacggtatttggacagtatggggatcatcggtgctaggatatacgcgagactgaggtaaaagagatggagacagggatttttatacaggttcgggcccctgaattgtcaggtaata

SEQ ID NO: 50533 - DNA, 1361 bp, Oryza sativa
aactactagataaattttgtgtgagaaaaataaattcaattgaaccagaaaatggtgtttaagacaattgcattcaaactattcaattgtaaactgaacttatcctggttataatatataatcaactgctcaatgcagaattgttttgtgacttttttaagttcacttattgatttatgaaatccaaaaagaatcatatcactacaatggtatttttaatttcataaattcattaaaaaaatcttgcctgctgcaaaattggaatatttcagctaactattcttataaagtgataagcgacatacatataaacaacaatatgtccatggtgactttattaatatcagtcaagtctctcaaatgtgctcatacgaatatgatgtgcttacttatatccatagggatgagtgtgtgtatacaagcatctatgtttttactatgttttgaaaataaagtttgttaacctaagaagatacatttatttagttttaaacattttttctcttattatattttgtttctcctaccaatttttttttctataatatatatactcttatagaggaaatagtagtagtagttgatgataataataatattattattaataatgtatcacatctagttctagatttgttttttaagtacgtcatcttcacatcatctaaaccactataaattcggtgttaacattgaaaagcgtacggttttgagtaaaatagtgtctgatgttgacattgatttccataattttataatagttcagggccggggtgatcttttctaaatttgtgcgctgagattatttctttttcctcgttttaattaggatatcgtacaattaaatttcaagtcttcctggtggaatgaccggattaattaaattgctcgtggttattccaaatttcaaaggctcacgcctgcaccactcaaatcgaccaaacaaacgtcagaaaacttctcaaacgagtactacatccagaaacttcatactaccacctctgttgtcgattactactccttccgtctaaaaaaaaaagacaaacatgagtttccatgtccaacgtttgactgtccgtcttatatgaaatttttttataattaatatttttattgttgttagatgataaaacataattaatactctatgcgtgacttatctttttaatttttttcatatttttttaaataagacggacggttaaacgttggacacggaaacccagggtttgtctttttttttttacggagggagtagttgctaatgttgaatgtggcgcataaattatttttaactattatataatgataaatggaagttgggtaattatataattataataatgatcagtacttaaaaa

SEQ ID NO: 50534 - DNA, 1560 bp, Oryza sativa
cacgagatatatatatgagattggaaagttagtaaattttaaacgctaaaaattagtatgtttcagtacaagaagagtagtagttagaaattggagtatcacatgtgtcgacgtttgaggtctcgactacggttattgcatgatatggagatcgtcggtacctgggtatatgcgagattgaggtaaaagagatggagacaaggattttatacaggttcgggacccttatctgacaggtaatagccctactcctattggccaaagccggtgttgctctatattcattagaatcacacaagtacaatatttgggataacatacctagctgtcgccgacttggcggcatagataaccaacacgtagtcgacgacagggtagtcttccttctcgagtacgaactcatcgtgattagagatggcgctagatccctcttgtcggcctccgtaggcaccatattggatttgtctaggcttatctctgatgtcgatgtttggcggcatgtgttggtgtctattctgacttgtatgtcgatctgtgtgttgttctgtcccctctccttctagggggtcttgtatttatacctataaatgtccccttgtccaagtagaactagagagacaagtatcgatacgatccgagtagtccttgtagtttctatagagaactctacttgtccttacttatccgtaatttcttctatatacgaggtatgattccgtataagatatggtgggccccaccaagattaatcgattactattgggtatgtggtatccataaccatgacagaactcaaacttaattttcttaattagatttggatttgattaagatttgggggcttagggttctttcaaattggggattttgggaaaattgaaaccgattgatctcgtttgactcaaaattgttcatgtcgaaccaaaatggcattgatggcttctaatcacatgaataatctgaataagaaattaaataggttaaagttaagctttgataccacaatgttggagttctaattcaagatcttattgctttagcctataaacaatcacctttcaattacgaaaattaattctctgacctgggatgaagccattgaagctgatatccaattttgcttttggttcttctttctcttctggattttacaaaggaattagttcgtcacctcttctcaatgcattttatcctttttatttgcgttggtggggctctggggcaatccagataggattttttgttttgcgaaatcggatgtgctcatatgcacggacgaaaaattagcatgttgacgaacgaaaacatggacaaaaacaagatgacgatcagaaagttacgaattttttaattagttaagataagatatatttccttagcccctctttcttttatgttagcctgattaactagctggaaaccattttttttattaagataccatgcttaaaacctctgctacctattcatgagcctacacgtaaaccgagctcgagtttgactgagctttacccaacttgagcttgacctacatgaaggtcatgataagttcggcttgag

SEQ ID NO: 50535 - DNA, 3889 bp, Oryza sativa
taagtcaacttgtgctcaaattatggtggtgtattggaggtacagtaatatattgcttgatttcccttgggctttgagaatctctactattataaaaattgaagatgttttcgctagtactttggtatgtcatccgtgtatgagtcggtttttaatttcgttcgcttttggaaatacatattcgtatttgagttaggaagttcgttggttttttgaaaatataggagtcgtacaagaaatatctttgaaaaactcgcatgctaacttgagataatcggactcctaattgcagctcatgattttctatcttttctctactattataaaaattgaagatgtttttgccagtacgttggtacatcatccgtatatgagtcggtttttaagttcgttcgcttttggaaatacatatttctatcttttctctactattataaaaattgaagatgtttttgccagtatgttggtacatcatccgtatatgagtcggtttttaagttcgttcggttttggaaatataggagtcatataagaaatctctttaaaaaactcgcatgctaacttgagatgatcggacttctaattgcagctcatggtttttctagaaaaatatatatccaagtgaattcccacagtgaatttcaccttaactaactcctataacaataataagattaaaataaccttcacccgttgcaatgcacgagcattgtttatagtgaaagaagaaacatgttttcatagttatggataccacatacccaatagtaatcgattaagcttggtggggccaccatataccaagtcttatacggaatcataccttgtatatagaaggagttccagattaataaggacaagtagagttctatatggaaactataaggactactcggatcgtatccatacttgtctccctagttctacttggacatggggacatctatgggtataaatacatgacccctaggaggagagggaacagaacaacacacagatcgacatacaagtcagaatagacaccacatgccgccaaacatcgacatcagagataagcctagacaacccaatatggtgcatacagaggccgacaaaagggatctagcgccatctctgatctcaatgagttcctactcgggaaggaagattaccctatcgtcgactatgtgttggttatctatgccaccaagtcgacaacagctagataggttatcccaaatattgtacttgtgtgattctgatgaacatagagcaacaccggctttggccaacaggagtagggctattacctgtcacataagggggcccaaacctgtataaaatccttgtatctatctcttttatctcaatctcgcatattccctggtaccgacagtctccataccatgcaataaccgtagtcgagatctcaaacgtcgacagtggcacgccaggtatggggattttggtgctacaaggtttcgacaagatgggttcaagagatggattctccgacaacctctgtaagtgtttgtatatgtaatatttgtccgttgatcctcttttcttatatcgccctgtcttgaagtcgatcctatcgttcctttgtgctattttgaatgcgtattaactaagccgtgtaatcagaattggttttcccaacttcatggctggatgctagaatttcgtcatcttcaacttggtttgttataagatttagctgcctttgtggaaaaacgatttttccataaagacagctgggggctaggaagagtcccagactcctattgctgatggaagctttagcgagagtactcttttattgtcatgtgcaaattcaatatattttcaattttaaaattcatattatattgtattacccttggggctatttgtatctaacaatctgtctgagtattgatttcaggatagtcatatttcagagctttgtcacagattccacaactacttgattactcgagaatggttggacaactactcgattactcgagaacgattggacaactactcgattactcgagaacagttggtggagttcgacaaagattacggaatgaagcgatggtgtacccgctgagatgaaaattcttgacttcaacccaaattcttgattacgacaagacaaggaatgtagtcacatactccgcaccttctcgatcaactgagaacggttaagcgatcacgacgactgttgttccaaggtctccggtcgagaacatcaactcgttcatttgcgttgatttcaggctcgtttatggcagttgtttagacttcaattcaaattcacttgtggaccattgatcttgtttcaatgatgttgagtactccatgtcttctcgattgttatcgagaacgaccaagtgagcatgacaacgttgacagagaaaacgcggatgacaacatgaattcatttgagttgaagtcggggggttactgtcatggttatggatacctgatttgtagaattcaatgaattatagatgttgcatgcttgtataagttttgtatgtaattattaataatgtaaaggaaaatgattggatgttgatttgtagaattcaatgaatcctatatacttatatagtttagttaatgatatttctctcttctctaattaagccacatcaccccaattatttctagtcattagatgatagatttatggttcaaattgtctcttctttcttctctcataacaccaagtaatcacaaccatttttaggcctcaaaattcataggtatcaatttatttaagttttattatttagatttcattttatttgaacatattatgcaacttaatttcccatagcaacgcggcggggtattcatctagttatagatgatgttgcatgcttgtataagtcttgtatgtaattattaataatgtgaaggaaaatgattggatgttgatttctagaattcaatgaattatagatgatgttgcatgcttgtataaggccctgtttagatcctccaaaatggcaaaagttttgtcattttgaagcactttttgccattttggatctaaacactagtagcaaaaattggcaatttggcatttggcatttgctagtacatagtagcaaattgtgccaaaaagtgctttgggaccactccctctctctttctctctctcactttagtgctagaatgtgaagcatctaggcccccggtgttaattttggtaattaatgacaagcactaattgtggactaaccgttgtctttgagctatacattttaagttaggtccacgtcatatgcgtgcatggatgattatcgatggattaaaattgacggcgcaaagcaaagggaaagaagacggtaaaactagcgctttaacttagaattgatcgaggtgtagggcgatcaaatttgctagtttaattttagtttcgccgtactattaagaggggtaatgacctagcaaagagatgattttaattgccacattaggtcattgcattttcatttgtgctcgctttttcattacacaaattcactaggttcggcctgaccaggggtggtcagaccggccacatagtggcggtctgaccggcgtgccctggccggtcagaccggctacatagtggcggtctgaccggtggcactttcccggtcagaccggcctcctggaggccgagatgatgctgctcgggatggccgatacagagccgacggagccgtagtcggtcataccgagccgatggcggtccgaccgagccgaggccggtctgaccggccaccccatgtcggtctgaccggcctggccgatggggccctctgacagggctacaacgggtagttttttaaccggtgcaaaataggacggtttggccggccggaatccttcgggtaagaccggcagagcacagagttggggaatt

SEQ ID NO: 50536 - DNA, 950 bp, Oryza sativa
ctatgagcttccatatttggagtattgtggatgtagactttgccatcaccggcacacccttgacggagattgatcaccgcaacctccaactcaatgcccaagccatgaatgccttgttcaactctttgagccaagaggagttcgatagagtgagcaaccttgagaccgcatatgagatttggaacaagttggcggagatccatgagggtacaagtgagtacaaggatgccaagcttcatttcctcaagatccaatatgagacattctccatgttgcctcatgagagtgtgaatgacatgtatgggaggctcaatgtcattgtgaatgatctcaaggggcttggggcaactacaccgatcttgaggttgcccaaaagatgcttagagccctatcggagaagtatgagacccttgtcaccatgctcatcaattccgacatgtcaagaatgacatccacaagcctcttggggaagatcaacaccaatgacatgtacaagttgaagaagaaggagatggaggaagcctcaccctccaagaagtgcattgctctccaagccgaagttgaagacaagagcaagagtaaggtgaatgaagtcaatgaggacttggaggaagagatggtccttcttgctaaaaggttcaatgatctctcgggaaggagaaaggagagaggaaggggctccaactccaataggagaagaaatagaagactcaataagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggctttcatcggggaatgggactcaaatgaggagtgctccgcctcatccgggtccgaggaagaaggtggtgatgatg

SEQ ID NO: 50537 - DNA, 5932 bp, Oryza sativa
tatcttatggatatgcctagcccttgctctagttctagctcgtgtgtttctatttgtgatcctcacttgttgttgagaacaatgagcttaaggagcaagtggctaagctcaacaagagtttggagagatgcttcaagggtaataacactcttgacaagattatgagtgagcaacggtgcatccttaacaaggagggacttggattcattccaaagaaggataagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtaacattgttgctagatatgtgggttcccctatactcggtggtaaaaagaatgccatttgggtgcccaaagctttggtctctaacctccaaggacccaaactagtttgggtacctaaaagagcttgatcttcttttgtaggtgaactaccgcaccggtgggagccattgggtgcttgatagtggatgcactcaacacatgaccggtgatagggctatattcaccacatttgaagtaggagggaatgaacaagagaaagtgacatttggagacaatagcaaaggaaaggtaattgggttaggtaaaattgctatctccaatgatttgtcaattgaaaatgtctctcttgttaaatctctaaatttcaatttgctttcggttgctcaaatttgtgatcttagcttgtcatgtgccttcttcccacaagaagttattgtttctagccttcttgacaagtcttgtgtgttcaaaggttttagatatggaaatctttatttggttgatttcaattctagtgaagcaaatttgaaaacttgtttagttgcaaaaacttcattgggttggctttgctataggaggctagctcatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatggatttgtttggcccaacaacctataagagcattggtcgtaatagtcattgtcttgtgattgttgatgattattctcgctatacttgggtgttctttttgcatgataagtctattgttgccgagattttcaaaaagtttgcaaaaagggcccaaaatgaatttagttgcactcttgtgaaaattagaagtgacaatggttccgaatttaagaataccaatatcgaggactattgtgatgatcttggtatcaaacacgaactttccgctacctactcacctcaacaaaatggtgtagtggaaaggaaaaatcgtacattgattgagatggtaaggactatgctagatgaatatggtgtttccgattccttttgggcggaagccataaacaccgcttgccatgcaaccaataggctttatttgcatcgtctcttgaaaaagacttcctatgagctaattgctgggaggaagccaaatgtcgcctattttcgagtttttggttgcaagtgttatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagagctatgaagaacatgtctattggagatgtcaagcctattgaagtggaagacaagccatccacctccactcaagaagagccatctacttccgcctcgtcaagtcaagctcaagttgaagtggaggaggagaaggcacaagatccacctatgcctccaagaatacacaccgctctttccaaggatcacccaattgaccaagtgttgggtgacattagtaagggtgttcaaactcgatctcgtgtcgcttcgatttgtgaacattactcgtttgtttcttgtcttgaaccaaaacatgtagatgaagctctttgtgatccggattggatgaatgctatgcatgaagagctcaacaactttgcaagaaacaagttgtggactttggttgaaagacctagagaccataatgtcatagggacaaaatggatctttaggaacaaacaagatgagaatggattgatggtgagaaacaaggcaaggttggtggcgcaaggtttcacacaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaatcctaaccatgtttacaaactctcaaaagctctttatggtttaaaacaagctcctagggcttggtatgaaagattgagagattttcttttgtcaaaggatttcaaaattagaaaagttgacaccactcttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacggacatcttgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaatgattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgtgtcatggtcattcaagaaacaaaactccgtagccatctctaccgccgaggcggaatatgtttcggcgggtagttgttgtgcccaattgctttggatgaaacaaaccttgttggactatggtatatccttcaccaaaaccccactcctatgtgacaatgatagtgccataaaaatagccaataacccggtccaacattctagaaccaagcatattgacattcgccatcacttcctaagagaccatgttaccaagtgtgacatagtcattagccacataagaaccgaggatcactagccgatatttttaccaagcctcttgatgaaacccgcttttgcaagttgaggaatgagttaaatgtcatagacttctctaatgtggcatgagatggtgcaccatggttgcttcttttgcatattgtatatttgctcctatttgctcttatgctttggacttattgccatttggttcttcattgcgaaaatggagcatgtcacattaagggggagttttggactcttgcatgtgctctacttccttttatatgtgagcaaatcaactaaaagtgctagtagtgttttcaaaatgcccaagtcaacataagtcaaaagttttgcaaaatcaatgaaatttgaaaactatctcttggaaaatgtttcaaaagggtccctatatgttttccaagcctcacattgctagaaaaatgatttttgaatgaaaaatgctattttggctctcttttgaagaatctagattcttgtttttggccaaaatgagattaaaccccaaaatgagtttgagaaggaatctgagaaaagtttcaaaacaaagttggtagagaggaggatttgaaatgtttttggtattcaaatcatattcaaaatccaaatatttcaaaagttgtttgaaaatcaaattcgcccaaaaacccctatagaccataaatggtcacctcctagcactcaagtaagttttgttgcaaatcttcataaatttcaaatattatgaatggttggcaatatttcaactcacacatttcaaaattgctccaaaattcaaatttttgttgaattttattgtatgggggtagccgaactgtgcaagggctatgcacagtcggctggggggccaggcggtctgaccggcgctatatgcgcggtctgaccggcctggtggtggcggtctgaccggcctctaggaaccggtctgaccggctgcatcctggcggtctgaccggccacgtatagccggtctgaccggccagggatggtgggcccaggactttgtcctttcttcctcctcctccttctacccgacccctcctcatcccatctcatctcttctcttctccaactcaaaaaaactcctcctctctcctctcccaaaccctagccacctccctccaccaaatccatccggttcaactgtcaaaatcactccggttacaccataagtaaatctcctcctcttcctctctctattccatggattgatttgagttcttattgagtttgtgatccatggcatggaaccctaggtgaaggaagaggtgttcatcgatttgcaccaatagagggtagtttcttggtgtgattcaactccttcaaccggtaaatccctctccctcttgtgcattgctctcaaatcggtctatttcaatctttagggttaagggtagttttcccattgcttcaatagacctacaccttgatgttctagttccaatcttgtgcaacactgttctagcaatttttagaatcatttgtgtggattgtggaaggatttgggtgtgctcgtgtcagtggcggtctgaccggacgcggtctgaccggccgagggccggcggtctgaccggccttgagccgttggtctgaccggccgtggctctcggtctgaccgcccctgacaggcagcactcgcccttcctcccacttcactatgtggtttctaaaattgttgctcatccatcctttgctccttgtttttcagctatgcctccccgcactcggcatggtcgtcgtgctcccacgcccgatcccgttagtgagaatgaggaatcaagcggagatgagtatgttcaaagtgatgaggacaatatggaaaatgttgagggtgatgagatggaagtaagtgatgatggtgatgacaatgagagtgcaaatggtgaagatgatgaggcaagtgatgatgggagtcctctcgattcctcgatccaatttgtgcttaatttgaggaatgctcaacaatacactatcctccgtcatcatgatcaattccggaggcctaacgattgtaatgatccaagatttcatacacggttccaaaagtccgtgtatgtacaagtgtatgccaacaaagccttcgccgaacacaaatggatctcttggaggcacattggtgagacaccggagtttgagaatttgcaagagatgttccggaccattgggattgatagaattgtcaccatgaagcaaccttttgatgaagatctcatccggcaattctatgccaccgtatgggtgtccggcgattgtgatgcaatgaagtggatgtcggggaccctccgatgctctatcaaccgccgtgaattcaaggagctcttgcacattcgcttcaacaacggggatgacct

SEQ ID NO: 50538 - DNA, 2566 bp, Oryza sativa
  unsure (1)..(2566): unsure at all n locations
tcaacatagacagctcgtcatggatggtcatgtacatcaacttgaaaaaatgaagacgtcgaggtcgcagtggtgcgcctcgtcggcgcggatgacggtgacgacgtcctcgacgggatgattcgtcgccgcgtgtcagtgaatcggagtcggggcctcctcctcctcccttgcgtcaccgcgcgtcaatgaattggagcggtcgccggcttcgacgccggcttctacgagatgagcttgcggcgctgcatgtcgacgtgacgacgtgtgggcagcggctcctaatgcctgaggcgcgttgcgggctgcgcttccgccgttttccccatcgtgccccttgatagcgaacggttagatgcatttctgtaccgcgaggtacaagtaccgtgaggtacgagctgatggaccggaacaacgctctaccatttaacaaaacacttaccaattcatgccaaaccatatagtccagcttggctgtcgccgctaaccaatcgtgggcagagccaatttgttgacctgacctgcaaaggtacttgttctcaccaaacacattgtgcacatccatgtcaggttctttgttgtccattgcaaaattgtgcaacacgaagcatgctacgataatctttgattgcttctccatacgataaaacagtatgcccttcagaatccaccacttactctttcagaaccccaaatgagcgttcaactacattccgtagacaagaatgctggtagttaaaatctcgtgcaaattttcaggacctttggtatcaagctgcttcaaatgatatcttgtcttgcgatatggggacatatagccttcacgtagagggtaaccagaatccaccagataatagttacctacaaaataagtaaagtcatatcgagtaatttagaatgctaagcctaaatgttatgcatgatagatccttaaactacacttacatggtggtgggtgagggaaatggtcagcattgttcaccgtctctctgaaaacaaccatgtcatggtgccttcttttttctataccattataatatgagtccactatgatctaatggttaagtttttttcttctttttttattaatgtgtgaatttctagacttcacaatgattatggtgccttctttcaaaggtatcttatagtaatgtataatagatggaatagtacaatatatgtgtttcacacttttattatcaaacaatttaagcgaccaattctttgatcttcacctcatttctgtaaggcaaaatttgctacataacactcaaagtttgtgatctttgctgtgagacactcaaaaaacgtgtatcttctcgtggatactataaaaatatagtaattagttgttggacacccgccgcattattttattatatctggtgaaaacagagagagaaacaacaacaaaagtaagaatctggcactatccatacatcacaaattcacaatccacccttctagtgagtggcaagctgaggaactccattgatcacaatcctccttcttgtcgtcatcggagggcattggctcttcttttatcaaattcttccaacccaatcccatcgttgccgtcgtcatcgtccttgcccagcccaccgccaaagcgacagcgactaggactgggatggatccaaccatgaacctgagcccgtgcctcatctcctcggccggcaatgggcgacctcccgcggctgccactctgttggcccgacgaccccgcctagcccgccgccaaagcgacagcgactaggactgggatggatccagccgcaagggctcctcgaccccatctctgcctctatcgtctgctacgttgcccgctgctggcccaacgaccacgcctagatcttgcacgactaggtccacatggccgcacgggacctcgaccacaatgatgacctgccccctgaccacgcccgcctctagatccgctgccactaagcgcacctcgagcttgtcatgcgcatggccgccgaccgacacgccgagctccagtgcctctcgcaccaccgtgccatctccgacttccccccacagcaaccgtcatccacatggccactgccgttccacctccacccacggcggctgcaagggcaaacttgttctttcattgaagtttcttgatctgttttcaccggaaataataaaataatgaaacgggtttccagccgttaaccaccatatttttgcagtgtttatgagaagatatatgttctttaggtgtctcatagtaaaagccacaaattttaaatgtcctatacgnaattttgccttttttaaaaatgttaaggacacgtgaacagaaaataggggagctacacatctttggatttcaacaaacaagactgctaggaacagtatatctcagctctctagtggatcggacgtccgacgcgtagtcacgtcccatttcccatatacgagtactacttacaacacacacttatgtgaaaaatcacagcgtggtcttggctgccctcctgaccagcacagcccaccacatgaccctgtacaagacgaagtaaccctagcatgaccccgacattgacccacctcatcc

SEQ ID NO: 50539 - DNA, 1888 bp, Oryza sativa
aagtagccggagaagaggaagaacacgcccagcgacatgcagatcagcgagttccccagcacgaagtcgggggagacggcgctgaggaagagcaccagggagctcgccatgagcacgatgagccacacggcgagcgcgaagcaggcgaaggcctgggtcgtggcgcggagccccgcgaggaagtagacgggcgccgagaagaggagggacacggcgaggaggcacggcgcgaagacgagggcgttggccaccacgtaggaggagaggcggtaggcgcggcgggacgcctcgcgcatcaggacgcgccgctcgtggaggaggatcgggagggcctccacggtggaggagaggaggaagctgaggctgaaggcgaagaggcccaggcggagcgcgacgccctccgggtccgggcggatgcggaagtagacgctgccgagccccagcccggcgatcaccgcctgcgccgcgcgcgccgcgaagagctccttggtgcggtgcatcgtgcgccagcagcgcaccgccagcgcccccacctccaccgcgcggctgcagtagtagccgtgctcgtgctcgtgctcgccagcgccgctgctttcgtcctcgtcgtcgatgaccttgttgtgttggtgttgatggatggtggtggcgagcgcggcgccgaacctggcgtggtcggcctcgagctgctcggtgacctccatggcgagctcgagcgggttgagctgcatggggatctcgtggccgaggcgggacagggagtgctccagcgacttgagcgtgccgaagtgcgcgacggcgccgcgggagaggagcagcatcgaggagatgtaggcgagcatgcggtagctgggctggtggatgctgagcaccaccacctgccgccgcgcgcgcgccacgtcgcggagcagcgacagcacgtccatggcggaccggctgtccagcccggacgtcggctcgtcgagcagcagcaccggcgggtcgtgcacgatgtccaccgcgatggacacccgcttccgctcgccgccggacaccccgcgcggcgcgccgccggcgccgccgcacccgccgacgtagctgtccgccacctccgacagacgcagctcctgcatcagcgcctccacccgctcgccgcgctcccgcgccgtcacggcggaccggagcctgaaccgcgccgcgaacaggatcgtctcccgcacggtgagcagcgggaggaggttgtcgtcctgcgtcacgaacccgcacatccggcggagccgcgcgcgggaggtcaccgcgcgcccgttgacggacaccaccgcgtgcggcctggcggcgatctcgccgccggtgccgcggccggagaggatgcggagcagcgtcgacttgccggcgccgctggggccgacgacggccaggatctgcgagctggaggccgtgaacgacacgttgttcaggaggcccgcgccgccggtggccggcggcgagctggtcgagaaagaacccaacaaccacgagagcaacccggcgccgccggagccgcggcgagggtcccggcatgagaggttggacacggcgagggtgtagttgggaggcgaagggtggtagaaggagaaggacggcgaggcggagtccggcggcgacgacgacgacgtcgacgtcgagaggagcgccgggtcgagctccgacgacagcgacaggtcctccatggctagctagctatagcaaatgggaacgacgatcaagaattacggccgctcaagaggagcttggaattaaacacaagatcgatcaactcgaaacgaacgtgacgaatatatgcatggttggctagctaagctaagctaacacacttttcttgagcgtgtaacgcactcacgcatgctcgtcacgacacaccatgcacagcttt

SEQ ID NO: 50540 - DNA, 15462 bp, Oryza sativa
ggaaccaagaggggcggacagacgacgcagcacaagccggcacgagtgggtttttgttccagcatgactcaaccagaacgtggatagcggctgcgacctcccggcgtgaaggcagaaagcggcggcgtcctctccggattcgagagccttcgaggtgagttgaggtgaactgcaacggcagattcctgacgttgtggaggtggaagccggaaggcggctattgcagtctcccggagtcgaggtgaacggcgggcatggcaacaccttgcccgagccctgcaccaacattgggcccgagaagaggagagtcgacgatggcgcctctccgcatggcggcatgggcgccccaaactgagcctggacgtgcttcggtacagcgtccacctctgaacacttcttagaacagcgtccaaatctggacgccctttgaaacaacgtccatcctatttttacaaattcaatttaagatttaccacttatttaattcaagacttattaattactataaataaaaaatttggaatattgcttgtgctcatttttaattggttaaaattatttctaaagctttgaaaattccactaaaaatcttgttagcatatttcgacatgtagaactcaagaaaaattccacatgccaatttcgattattatttgcattaatttattagggtttcactcttgctttcacaccggtattttctcgaggtgatttataaattcaatttaggcttgggaaaagaacttcagggtgtgacactcagccttctcttggaggtactctgccatctttttgcagaaaggtgtttgtgtgttagacatttgttgcaacgctatggcccgcctcgtcctcatccacatcgttgtcctgtgcataatgccttctacaatagcagttagaggtaaaggccttaatttgcgaagaaccgcattgtacgcctctgcaagattagtggtcattatgccatgcctagccccattagtgtcatgcaagagtgcccacttatcattcggcttgcactcaatccaatgggtaaagcatttgatattctttgatgacctacgcttctttccatttgatggaataagatcatccattggttccagggcctgggggacatgtacatcctgcgggttgttgttggtctgctttgaccggatatgtgtccttgtcccctcgtcaagttgttttcaaagctcatcgaactttgtagactgattttccttgcacaaccgcttgaacatgttcatcagccgccggctgttgaattgtttgaaaaaattggcccccatgtgccgcatgcaccaacggctatgcatgtcaggccagtagtatgcaccatcaccatcctcctggagctctttgattgccttcaacagaccggcattccagtcatggatgatacatatcgatgtgtgtttttgcaccactccccacttaagatgttgcaagaaccacaaccagctttcgtagttctcgctttcaacaaaagcaaaagctaccggaattatctggatgttcgcatccgcaccaatggctgttaatatctggcctcggtacttcccagataggaaagtaccgtcgacacacagcaccggcctcgagcacttgaacacatgaatgcatgctccgaatgcaaagaatgcccgttgcatcacaagataatttggaggacgaattgactcccaatcctgcacagcaacataggtcccagggttcctgctctttagaatgtttagcatctgtggcaatgtgtcatatgcttcctcaaatgtcccatatcttttctccatggccttctgcttcgccctccaagccttgtggtaactaattgtgtattgttcacctttctccaccagttttattatgtgccgcacaggcaggtcatcaccttcaataatttccttgtagtacttgttcgcgacgtacgccgcggtcaagttgcggtgcgactccctagtattccgaatcagacaggagtgttcctgcaatttggacacaatccagtaagactcgtactttggcacgtgaccatgacgaccgtgtactcagtcttgttagacttcacaaccctgaactgcctttgcatctagaatgaccatgacttcactgcgtcttgcaacccaattttgtcacggaacattgcacccagattgatttggccatccccgtagaaccatattgaatcatgacaagagttttctgcaatataaccagggtcttcaaggttccacgaagcaggcataggtacttcctcaacttcttgttcatcttcgtcatcattctcttcagcagcgaggttttcctcatcttcgactgcatgtcggtccaccctctcaatttcttcaactatagcaggtatgtcctccccttcatcggcttcaccagttggatggcggttgaccacttcatctccttgtatggatagattttgaatgtcaggaccaacatcgccaccatgatggggagctacaacttcatcttcttcgtgtgaactagacccatctcctcacgattgttggattgccccgctgcgctctccgtggggactcttccttgacatgcttgcaccagcatgacatattcatatccccgtctcctacagccagcgagccaatcctgccaggccttactccgtgtcacattttttaactcccattttatgttgttggccgatcggctccacataaccctcacgttaacactatatatacccggatctaaagaaaatgtgctagttaaccagtaccaaacttcgggcatggtaagtgtgtcaggatttggatggtatagtgtgcattgcctaaagttgctcagatcgacaccactttcattttccataatttcaccttcaccgaaatacactctaaataccgacattcctgccattgtagaaaacacagactactccgtatggaagtcttacagaacaaacgtgtcctattcacgaccaaaattactttacacgcatactgtttttttgaataaatattctttatcaataactacttacttatatttccactgtatttaaccaaaaatcatgtacttgtaataaaaaattataaataaataattacgtaaacataaattatttacttacgaatacatgacaatgcaattcattatttataattgtactacaactttgacataaaaaataaacacatgacaataatattaatacaaattaattaattaaaacacgtaattaaacataactatggcaattaatttaaataaaagagtatgtaatacttaaaacaacacaaccataccatatcgtacataaatatgaagtctttaatatttacctacgtttatcagatcccgcctactcctttataaccagcttgctcgtataacaattgctgcctcaaagtttagttcactgcataatccatatgtttaactaacaaattaattatacaatcaattaagtttaatacagcaaatgactacttgcaccgaagaaacattgacgaaagctaagttaaaaatcattttggttagctctttctattctttatctaggacaacgacactcatttagccgcatcatgttctttgctacagactgtttgtacatacttagatatgacctctgaaacaatactaatattgcaaatttggatgagtacatttaatatattagaactttaactataaattatataaattatctaacggaccgtaactttacttaaatacaaaatatttgtaactatcagttagtacaaaattatctataaattaatcataacatgataaattaatagaactaagttcaacttcacttcattaattacataatcaaattaatcataactaccaatttattatagtttaaaactagttgccatgacataaatttatttaactgcactttagttacaataccaaataaattacaaactgtctattaattacaaattgtcttccattatagtaccataccttgtcttgccttcttcttttcaaccaatttgctcatataaaagtcccaatttcaaagttcttcgtactactgcatttctttgttcattcataactacctacaatgttaagcatgtgtttaagcacaccatatatttcccgctacttaacgaatatttataccttttccatttcttactaaataaataactacatgaactactaattaattgtaacttaaaattactacaaattaattacaactttaatttaatttttctaccacatttaataattatcaatactattaatatcaatatcaataactacaaatataactattgatatttcagtttttttcatttgttacatataatattggccgtatatataaaattaaacatcacatgaactactaattaattttgtcacataattactactacgtaccaattaattgtaacttatattatacttttgtaccttataaattaattatgtctacctattttttaacccgaatcgactctattaactttctacatttgtatttttacatacgacctaacaaaatataatgtagtactaactaatacataactaaatttttcactaacataattaaaaacaaatattaactacgtgaactaaaattttctaaatcctcatcgtatgaatttgtcctaatagaaaactaatcaacttacgtgtctttttttccttctctccactgcctgcactgcctcctctcttctcttctcttgctctgcctctcctcctcagttcattcccttctgtcttcctctgtgaggaccatctcctctcctctcaatttaacccgtgagcgcattggattcgatcgatacaacgcttacaaatggccggcatgatgtgactaaaatagtaaactgataagagtgcactgagctcctccacctctccctaaaaagctacgcgcatgtggtgtcggaaaagcacaaaaaaaaacccgtgcaaaaagcacaaaaagcaaaaaagaaacagggatgggaaataaaggtatcggtggacgctctcgcgcatgtggagcgcgatagcgagggaggtctcgcgcgcacatactgcgagaccgagcccactgccgctccctctctacagtcgctctcgcgcacgcctaaagcgaaaccgcgaccggtctcgcgctcccaaagcgcgacgccgcgggcccaccaggctttctctctctcgcgcatgccgcgtcatcggtctcgcgcgcgcaaagcgtgatgccgcgtgcccacgtctcccccgtcgcgtcataaccggtctcgcgatttcatattacgataccgacgtcggtctcatgcaacaaaagtgcgagagcgctggctccgcccgaggtagtcgcattgatttctccacgtggtgctctcgcgcgtgggaaaagcgataccgctgcggtcttgcgtctcgtttgcgcgagagcgccagctcaacttcggtatcgctctttcggatagcgatttcaccacgctatcgcactttccaggagcgaacatcggtatcgctcttccagatggtttatttctgcaaatcgtttgctatccggcatatttttgcacaatcaatcaaaaaacagtttaatttcaaatttttttctcaactttgtagatgataaaagcgtgcttttgagaaaggttgagatattaaatacataccggtggaggggggttgaaagcattgtacggcaccactggcagcaagtgcgagtagctgactacgattgcatttgagaagattttatacattctctccttcataactttgaattcaagagattcaggatcttcacggttagggtcatgcttgccgtcgaattcaaaggccgtgcgagatctttccttgattggggccagccggctcttgataaaatgctgggtgatctgttccccttgcagaccctgctccttcagcttcagtatacgatccatcagggcaagcgcttgagcagcttcatctcccattggaagtgagttccaagtatcttgatacactggaggaaggcaggagtactcgggaagagctggttcgggattttgtactggggtttgaggaagaagatgcgacagaacagggcaaaatgcggtcttatacccaggaaagcctcgcaagcatgaataaaattggcaatgtggactatggagttgaggtttaggtgatgcaaactgatcccgtaaaaatccaaaatttcccggaagaatcttgaggttggaagagaaaatccgccatagaagaaatgagaaaataccacgacttcacgtgtgtcaggggttggaaatgcttcgccgcacgccggacgacgcccgatgatttccttcgccggaagaacaccgtgtgctaccatttccttcaagctctcctccgtgacgtcggagggcgcccattgactctcgaagctttctctctcctccaccatggatgcgaattggatgatgcgatttgctttcgaaatggctgggaatggatgggggatcaatgcggtggatgcgcggaagatttctgtggagttttggaggacggatttgagcgaatcggtgaaccctagtttcgccggtgcggttttgcactgtagcggggaatggggaaagtggcgagagtctcggtggggaagacgaagcggtgtttggtttttggtattattagggtatcgggagtactaatgggcctaggcccggaacagtacttcagcccatttctttctatcagcgtggctaagttgtgatccttagggacttaggctttttgcttcggtaatacttgctcgcaacattgtagcccaatgctgctaaaatcctttttgacgcagttagataattccttggaattatcatgatgcaaataaaaaggtgcccgacagaaaggtgttatacttcttttgtaagcctttttaggctgcaaaggctgtttgggttttgttgagatgattggtttttgaatagtcattctctcggcatgttatatgcttattttgattatggcgtgagtcatagcctaggctatttcgactcatcaattgtcatgatatcatatttataccacatatgatggatctttgagagtttttactcggatttttgtcatatgtgttgatttatggacctttggagtattttttactcgggcctctttatatctccatttttggtatattaaagctaaagcagtcgggtggatgttttattaaatgtcacatgtgctcggctgtgttattctttggaacatttggttgtaaaaccactcggttggatgttattcgaaccttgactatatgtttagtttttaactaatcacatagtcggggctacacctaattaggtgcatctagtcgatgcacccgatttttttctattttcagaccttcacagtatttgattttgatactcggagatcagggcagaagaagtcggagtactcagattttcgttttggattataagagaagactatttcgtcgactggaaaggtctcaggggctactgtggagattatggataccccatacctacacggcatgtatagtccgactgggtatggggtgtcatgtatagatagaatatctttaaaaggactcgggttcaattctaaacttgtatgtcaaggaaatacccgagatcgtagtcggttacgattgtattttatctgtaactacctatttcgttaggaatatgggctgtgctttgtaatacggaccccttcccctatataaggagaggtccgggtgcctttaggggcacgattttcacccagatcatacaatcaataatatactcggcggatcaatccctggacaggagtagggtattacttcttgattaagaaggcctgaacctgtataaaattccttgtctcttaacccatccacttttccagcttgatagccacccccttttagtattgccaaaatcttgtttcgacattcaccttgatgtaattgcagtatattcgtcatagtatttggttatatcactaatatattttttctaataatatgctcccatctggtctataatttttttgtgcactcatttttatttctggtctttttctttgtgaattatgagacccactgtacattcgattgctttttaagttgtgttatactcctctgtaaaaaaaaacagttctggggatgtatttggtcaatgtgtatgtacagatacatcccttggattggacctttttttcgaaggtgggagtataactttagttgattcgtccttcattttgtagatttattaatattttgttttgattatccatcttcgttgacaaggtaattaagatgaaactagccatacacttttcatctccaattgattcattcattacttggtactatgatgtctatatttctccctaaaacattttttctaatttgaaagcaatactagaattgggataagttatatcgatgacattattatctttcgactgttctgactaattatgcatcaacattactttatcatagtttatcacttggttcacttcacacatatatcttataaatccgtcatatttctttaccttttttatcacctcaaatttcatccaaaagttgcttcttcaaattcctgcagcaacgcacggggtatcatctagtttatactagctagttacctgtgcattacaacgggttatcctatcttactataaagttatcctccactaactccttaagcttgacatgcaaaaatgccacatcatcatccactaacaagatgccacatcatcatccactaatccataaattaacaagataccacatcatcatccactaatccacaaattaacaagatgccacatcatcatccactaacaatcatcacatttaaacatcatgcaaacatgctatatctttatagttattataatttaaaagcttttcaaatacaaacatgttaaattatcatccaacataattcacataatgtttcaatgtatatctttattatattttatgatatcctatatacttatatagttcatcctcacttagttagtgcttaaatgattaatctatggtccaaattatttttctcattttttcctctaattaagtcatatcacatcaattgtttttagcctttagatgattaatctacagtctaaactatctccctacttttcttcttccataaagtcataccagcttactttttacgtttgaatcaccattctacatactatttaaatttaaattatcataaaccatattaatttacttaatctgatgttatctagctatcttatacattatttttttttgttatcatactaaattcccgcagcaatgcgcggggtttcacctagtttaaattataattgagtattattctcatacttatatataagagtggtaactcaaaattaattatatgtaatagttcttatgagaatgttggggctgcccaaaatcaaacaccacatctctagaaattaactgtagctttttgcaatttatccaagcatcactaaaatattatcggtgttggtgccggcgaccggctggtcagacatgccttgctaaaaggataccaaattaccaatctagatgatctttgcgggtaagcccacctccccgttcgtctattgtttggtgatgacgcccaagagtgagaggtccgaccattgggccatgggttcctctgtaccgtcaccatggacatagcccgcttgacacaagtaaacaatgtaaatagaaggtaaatggtagcatgataagcactgcactagagcttcatcaagtatagaagacgatgtgaatttgaggtgttaacaacaacaaaccaagtttgaagttgcccatcaaaacatcactttgactaaattttgcataacatgctttactaatgttgcgtaagatccaattccttacggacaagaatatttccaacaatccaatgagaagacccattcaactatagtgcattctaaaactacatgttttttgttttgtacatagtggctttcacaatttgaattcacaaactacagtgagcaatgcattcttattcatttaatatggagaccctctttttgtacaccttagttagatgcatgggtaagtgattggtgacacttatgtactcgatataacatttaaattctacaattcttcttcactagctgtctttgattatcttgtggttcaatcatgacattttgagaaaaatctcatcggctcagaaacacacttgttgtccgtcagattgatgtcagtgcatcatatcaaaatagaggaatgcaaaccacaagatttgactcacactacaaaaagctaaaaatacatatagatggggttatattctctttaggagcatgactataaaaattgaaaaactaacaacaagataaactatcaaaaaaataagcgtgatccaagaagtttcctctcactgtacacttgttagctgaaacaaattcaacttaatagtttgtaggaaagtatattgagaaagaaataaactatgtgttaacaaccaaatttggcgtcgacactataccattctccgaagcaacaaaacatattttgcatatggatcagcatttgtctgcaactcttgatccattattccattagtccccccccccttctctcaggagcatcagcaccaccatcataatcaacactcttttgtgctaatctccctaacacattcccattctccttgtagtaaggtctttgaccatagacaggggcggagctacaatgtgatccctgtggtccatggaccactatagaaatatggcccaaggccgattacccctatgcatttctttagaaaaaatatcggtgggccatcgtttttttgctgaagacatcgcgtcgcttcgtttttttcgccgcaacccgcatgacgctgcatcgacgcacctcttcgcctcctgccttcggtgtgatcgccagcgatattgaggggcggagcggcgggcggcaaccagcaaggcaggtaagtaggcaactacggcgtcagtgtcaggccatccatcggcacagcaagcagcaggccagccgccagtaggttctcatctcccccattatccctcgtttctcttctctcctttatcctctattttgatttaggtcagcagccagcaaccattaggcctaaccttaggtattttgatttaggttcaattttattttgattttaggattttgaatagtattggtatgtaaattgatataatcaacacttttatggccaaaagaagtagacctgacaaaaagaagtagtactattttcttcttcaattatcatggatgtgtaagttacatttaagtaatttttagacttgtttatcttaaaatgttataaggcctttattgtttgacctgaatgcgtttgataaattttatctagagtattaaaaaaattattttgtgttggaccaccctaccttaaaatcctagctacgccactgaccatagatctcacctccttaggagaatgcaagctacaatagctagaagaaagcaaatccacttaatagcagttgttaatagtagtatagattcgatgtttgcttaacttttttgtttagtacctcagtttcaggtaataagagtttctagcattacacacattcatatagatattaatgaatctaggtacacatatatgtctagatttattaacatatatatgaatatggacaatactagaaagtcttataatatgtaacggaggaaatactaattatcatctttttgctttttgtttatgtaactttttgcttaagtgagaattattatcttgttgctagggtgacctgatttagcaattaatttatttgatgatcatcatgcatgttatagataaattcagacattaattgaagaaaataaaaccaatacaacttttgtgcaaggatgcttatgagctaaaatccaaacttatttctatttaagagagtagtttagctgtgcagaaacgttttgtagaaacattggttatgatcttccaaacgtttgaacaacacataacacaatgtaacagacaggtgtgggagttcgagggtagcttattgcaggctttgttttgctagcgatggtgtggtcgtcggatagatatgaaccgattcagctcaagcatgtccatggttcagctaatgcatcacttattaacaagaggttagctcatgcctatctgtttcaaaacaatctaaagtctaaagcatgcaactcaagtgcatgaacaaacaataattaacacacatcctacatttctaatgacccaacaaatcatataaataacatcctaccatctcaaaagcaacaaaaaaaactgcattacttagtagccattcacatttgctacctcaagcctcacacctttttccagcaacacatcaaccacaacaatggctccatgcaccaccccgaagtgtagggccatttgctgcccattgtcccccgtgtttatgccgtctccatgctgcccatacaaaacccattagctaaaaaagggacatagcaacaccctaatccgaggctagcagtgagcaaacattatagcgaagactgcgacatcggccggaaccgaccttgatgatggagaatgcgacataggggtagtggttgggagcggcgtcaattacaattacaggttatggctaggtaggcgattaggaggccacactggccaccagcacccccatggcgtgctgtagaattagcaccattggcgttcgctcctctggcgttgtcttcaccaaagcgcaagatgagttagagtcgatgtttgcctcatcaccgtagaccacgagaccaagcgacaacttcaggcatgacgacggtggaacattgtcccaggaataagctagctacaaagctcaagatagatagaatacaacatcctatcttttgcgtgagtgcggcgtcggttggtatgcgcatagaaaaacatgagatggtcaggcatgcacaaacatagtgtctctggtgcacagtcacacatattttggtggctttgttggatgaactagttggccacctcttgaaagttggttgtgatgttacagaagattctcttgcatgcgtcgcatcacatgaactaagtcgagacttcgatggtggtaatgccatggtgatggattggtgttcacctgcttggttggtgtcgcaaggatatggtagattcagaagaaagttatcatcgtcgttgttgtttgttgttgttattgccactgccgtttgtggtgtttgtagtgttggcaggtggtgtggcgccatcatcactggtgttggtgctagagcttgttgtagatgcattgttgcactattgatgatgatattggaggtgccacggatttgctggtgacattgaagttccaaagaggttgaagcatgggtctactaggaacctgggactacaccactagggatagagccactcgtgtttgacgagcaaaccggtccccgagagcacaaaagatggactcacaaccgcatgctcaatattagggataggtataggctatggctgggcaatcgatctggagaccacaccatccgctaacaccaccacgacatgctgcaacattgctatcgctagcgtccgctccttcagcaacattttcactcgagcacgtgagttagaactcagaatcgatgttcgtctaatcgccgtagaccatggaccgagtgacaacttcagccacgatagcagtggcacattgtaccaggaacaagctggctacaaagctctagataggtagaatacaacaatgtatcctttgcaccagtgcgacgtcgattggtatacacatagaaaaagatgaactgatcaagcatgcacaaacccaacgcctccccaagcagtaggaacaaccagttgatatgctccttctcggccgcgatcacccgatgcattcattactattcaccgcaagcacactgagatggctgggttgccgatccagagaccacagtagctacaagaaccccagggcgtgttgtagcatcgacactgttggtatctgctcattcagcgacatcttcactggagcgcgggaggagtcggagtcgatgtccaactcgtcgctgtagaccacgggactgagtaaaaactttagccccgatggcgaggtcagatataatatcctatcctttgtgcgagtgcaacgttagttggtgtgcgcacagaaaaatatgagtttatcaagcgtgcacaaaacggtgtcccccatgcaataggaacaacatattgatatgctcattctcggtcgcgatcaccgaacgcatttaattctggtggtcacagttgtcgtagtctggtatgttgggtttcatccacctgtccggtgcatgatcacacatgttttaatggttttggataaagtggttggccacctcttgaaacttggcaatgacgtgatcactggagtgaaggaggagtcgaagtcgacgttcgctgcatcaccatagaccatgggacagagcgacaacttcagccacgatgatagcagcacgttgtcccatgaataagctggctacaatgctctagataggtagaattcaataccctatcctttgcgtcggtgcgataccggttggtgtgcccatagaaaaaattgagatgatcaagcttgcaaaaaccctatgtttacccaagcaatagaaataactagtttatatgctctttcttggccataatgactagatgcattcagttttgttgcctatagttgtcatagtctggtaagttcggtttcatccacctctctggtgcattgtcacgaatgctttggtggttttgtttgaagtagtttaccacctcttaaaacttagcttctatgttgtagacaatctccttgtgtgcattacaatgccttcatcgagccaagcctttgatggtgatgatgccacgttgagacggctcaaagatggagtagtgtttggccttttggtttggtggctcaaggatacgatggattgcaaagaatgttaccattgttgttgttgtcatcgttgctgccaccgtttgtggcgttcccaatgttggcatgtggtgcagagacatcgtcgccgctactgcttgctatgaatgtgttggtgcgatgttgatgataatatgggaggtgtgatgagcctactggtgacgttgaaggtccaaggaagttgaagcatggagctaccgaaactatttcactagggatcgaaccactcataccatcggtgaataacaccctggcggccatgaaagcagctcagtcattgccatggtgatatacaagcaaaccggtcatcaaggtcacaaaaaaccgagccactaccgcatccttggtattggggacatgtacaggcgatggctaggtagccgatctggagactacattgactaccaacaccctctcggcatgaagcagcacatgcgtggttggcgtctgctccttcgacgatgtcttcactggagcacatgagtattcggagtcgacgtacgccgcgtctttgtagaccatgggacagagccacaacttcaa

SEQ ID NO: 50541 - DNA, 7842 bp, Oryza sativa
caaacctaacgtctccccaagcagtaggagctaccagctgtttgtctccttctcggtcgtaataaccagatgggttctactcttctggtcatagtcgtcacaatctggtatggccgggttcatccatctcgctggtgcatgtcatgcatgggcatgtggtttaggaggaaatagttggccacctctcgaaacttggccataatattgtagatgaacacttgttcatgtcgtgtgcctgtgctgaacctcaccttcgagtgtggtgatgccacaatgagaaagctcgatgagagagtgatgtatggctgcttttttggtagcccaaggataacgttgattcatgagggctctatcatttatagagccaacaccatttgtcattgtcgttgttgccaccattttcaccgttgccaatattgccaggtgtatcagctgcactaccactagagtttgtggtggacgcgttgctgcaacgtcattggttggaacatggtgggtgacacacatgcactgtggaggattggtgatgatgttggagttgcaacgacgagcctggtaacattgaatgtgcaagaaagttgaagcgtgaggctacttggatggcaccattgacattccaagacactaggattggaatggggatcgaacctcttgcatcacgtgtgaaaagatgttggtatttctgttaacagtgaaatttggaaagtccctaagagaattatcgcatcgccaatagtcggattcctgctatattcggttaaggaaattaatctattaaaggaagcttatccagaagtgaccgagtttaaggaggatgtggcatggcaagttatttattaatttggaatagtttgttagtttccttttatctttaggaaagtgtgtttagtgtcctataaggacattatgttttccttttatctttaggaaagttgctttcttgtcctagaaggactagtatcttcccatgggtataaatatgtacacctggggtcgctgtaaactatctctccacgatcaatgcaattcggcgcatcgccaccttttaccttttttactttattttatcgtccggcgggacttggcaccctgacgtggggctgcattggttttcgatctccgtcgaaggggtaagcccaatgttccgccggccaaggcaattgtatcatctacgtcggtgtcgttcaaggctgcattagtacattcgacctcctggattgctctggtttggttgatatatttgcctggctatttatcatatgtcctagttaatctagtcttagtatatcaatttagctatattggttgtctctcactttagggtttctaccagtatcagctaaattgttttactagattagattagctaaggcatctaccacccctaaaaatcagtcaacgggttgattgtctagatattgcgtttcttttcatacctagtgttgcatcaattaagttttatctactaagacatgtttagaactataatcccgagcctgcttcttgactgccaataagggtttcattggggtctcagccgatgaggtatctggatgttacatcagcttataaggattgcatataagttggatttagccgatgataacaaagatttcaccgtttaatctaatatgtggattttatgacatcagatctccagccgatgtatgctttaaccttcggatcaatacttgttctattatatcattgtttaccgattggtttctattggattatattgttgctttcttgcattatcatcagtcgtttacctttatattgttatttacacatcaagcgtcaaaatctacatcagaattatagccgatagctcaaaaccctattactatcggctggtatcggcatcggctggaattaatctatcggcttgtcagccgatcggctcattgatctgctatttgtatatcttgtcggttgcagagtcaaactgactggcacgcccgcatctcatcaacctttggtcctgcactgaagctaagcagatctccagggcgttgctgttgtcgacctagcccgcgccaacatagacctagcaccataggccaagcgcagatttctcgtcgacactacctaccgcctacctcactttccgtggagcacataacaaactaaagtaatttctaacctagataccataactaagttattaattactactctagctttgcgcaggaacttccctctttatccatagtcctagtactagagcactcaattggacactaagcaacgaacccgcactaatgagaatatatctcacttaaataactaattaatgaacataaagaaactcgaacacttgcttgaataaaggaagcatccgccgaagtacaagtgagagaaaaaggccgacaatcctggctttctctggaactccattgaaagaatgctgacactccgcactcctccataaaattctcgtaggaactccgatatttcgaggcactccttctggagcttcccctcactctctaccaaactaatatattaaatatgaaactacaagtgagttgtactctacttgagctcaaagttgtatttattgaagtgtgtgaggcatcctccttatatagccttcatatgacggttgagataatcccttatatgcgactccaaattaacaggttctcttatatgccaattcaaattggctcctcccttctatgccactggttcaagtttaccctcacttatatggcattgccttcactccatcgctaggtgaccattaactttatagtaaaaagactcatttccattgagagttggtatacaaccaatgataggtatttttcgtttgatagagaacttggttgatatgtatatgcatatagcattttactaatatagctactacatatgaaaattgatttttttggatcacgtgcaattttagccatcaccactagaaatgaactttcaacaaagagagaatctactccatgccactgacattgtctcttactataatataccggtgactttatccattccttacaatatgcctttgggttggacttttattaaaaatacctaaaataccttatagacatacaatgttaacaattaatttatctcattagaagtttaaaaaatttgaaaatttttatgtggcctccttacataacatggggacttgtatataagtttcaagttttttctaatatatttatttttagaagaaatatttttgtgtggtatatgagagacagtttggttacacaaaagataatacacaaatattttatgtagtgtatgaaagatgatttatattaagtattttatatagcatataatagataatttatattttataaaaaagtagaaatgcaaaaaaacttgaaacttgaatacaaacgtccatgttgtgtaaggaggctacatgaaaattttcatatttttttgaaacttctaatgagataaatcaattgctaatcttgtatgaccatgtattttgggtatttttgaaaagaaggttcgatccagtggcatattgtagaacaattgatgaagtcgttgacatattatagatattatagatagagacaatgttagtgtaaaattgttaaactcggacaaactcaatggtatagaatagattcaaacatgcatctcttcaataattttttagtacaaagagcatttttcactggttctaaaaaaattgttcactcaaataaggattcaaaatgaatcagttatgaatttttgaagtttaaacttacttcagttatagaataaaccattttatcatattctcatcttttactattccaacctggtcgggcccacctgtcagctgcccagaccagatgaggcatgggctggcttggtcaccagtgcttctcgccggcgccggcggcgaacggcggcgcgactcggtttggtcccaaaagagaaaacacagaggagtaaaaggcgaactctccggtggtggttttgtcgtcggatttggctggaggctcgctagcgactttgatttgcggtggccgtagtcgggttgaacatgcttgcatggctacgtctgtggagtgagcaaggcaatgcatgcaggagcaaacacggaccccaaggaagcttaccgagctccgagacaggtccggcgaggtcagggtagctcgagcgccggtggactagtctcgcagcaacagggcaatggcgaacggcaccatcggttagatgtatggacatccatcatatgcacgacgtcaagggtggtccaggttgctccaggtggaaggaaacatatcgaaactcactgggtcgacaggatcgtgcggggcggagctcagtcatagccgggaaagatgacgctgatctcccacctcgctgcatggatcttggggctatttagggcgttttggacctggaggggagttaaatgtgttggcgaggcaggtcgactcgagatggtccatggcggcaggaacacgagctcgatgccaaggccgcgcgctgggcgtgcccttgagctcccacggggcgtcggcgttcccaacgctacaaatgacgaagcaaagtgaggtcacagggagaaatgcttagcatgcatatttgggtacaaatcaattgaaagaaggagcttttgaagaggaatcgagaaatggcagcggcttgctctccatggctaacggcaagcaagtgaagacgagaatgacagagcgctctctttgatcggatttggatcctctaccttcacggcttgaaggcacgagcgtgcagtcggcacctcatccaccgttcaaataatccaatggctcacgtcgcctgtgcacgtctgaatggatatctgtctgtcaaagcccacgaagtactactgctatatttcagtccgaataccaatgatgtttgcattataaatttcgtaatttttcttatcaatcctatgctctaatcataatttttcttttgctttttatgatgtgacttgacattgcgtcatactccctccattagttcccaaaataaaaacttttcatctagaaaaaaaactaattacacagtgtgcgtgtaaattgcgagatgaatcttttaagcctaattgcaccatgatttaacaatgtggtgttacagtaaacgtttactaatgatgaattaattaggcttaataaatttgtctcgcagtttcctagcgaaatctgtaatttgttttgttattagactacatttagtatttcaaatgtgtgtccgtatatccgatgtgacaaccaaacccaaaaattttctccaactaaacaaggcctaagtcgcttgacttttttttagtccaacttcttttttttaatttttaacacaaaacaaatatattataaaaatatattcaacgttagatttaataaagctaatttgatattttatatattactattttttatataaattagtcaaacttaacgatttttgactagaaaaaaagtcaaatgacttataatatgaaaaaagatggagaactactttgtaatgaattagtgttgttatttgaaactttcggttttcttgtatttttaatttggtgatatcatccatttttttcatgtgtattagcactaatatagtttgtaagtttcttcagctcgcgtacacttcccagaccaaaacaaccatcgtgggattttttttttttttttttgcgatagaaccatcgtggtctttcacagacaaattcattcgtctgtttaagcgcacatgtgacgtgagccgttggattacttcaatgatggataaggggctgactgcatgctcgtgccttcactctacaaaggcagacgatccaaatccctctttgaactggggcagtgagggatgatgggtgagcttgctaggggaggtagaaaagacgagctggagccttgaggcttgggacatgcgggcgtcgacaagtgacattggactaaatactattaacagtcaacaagtagtggtataagagggtaatcaaacttaaaccaatgccatttttagtggcataaaaggtaactaactaatttggagtggcatataagaaattctctcatgatggttatgacggttgaaaatgtcgttaacacccccccctccccaccaccttcatttagagacaatctaggatgtacacgtggaagaccaggatcagaggcgctagtgacggttcggccgaaccctgggccctaggtcctagtctctcctttggccaagagactgactggtgggcccttatggcggttagatggtttggccccattttaagttggttttgactaatttgtgggccctccaatccttgtactcacacataattggccagaggttcattttcgtcttatgtcgggtgtattttctccttaattaacctgcatacatataattaccaaaactagcggaagtggttagtagtaaactcctaccactaagttttgatatcttttatacatgagttgatggttaaagtttacacttaacgaccgtcaacaacagaacattgattgccatgagagcagctctgttgccatggtcgatcacccacactggttaccgagaccacaaaagttggagccaacacatcatcggcattggcggcaggtgtagatggcggctcaagcaccgcacccaacactcccacagttgtatgttgcaccaccgatgccagtggttagttctctggcaccgttgttgtcaccgaagagttgtcgatatgtttatcgcgtcgccgtagaccacaagactgagcaatagcttcagcaacttatcctcatcgccgtactgatccatggggaacatcttccttttctgccccaatgaggagccaacgtcgcgcacaagcgatgtcacctctaggggcgtgcctaggttatactacccggtgtcacaggacatcgggtagattattcaaatcctatataaattacactatattaattaatatattagtcaataattagataattagtatgtattaaacccccggtaacttttattctgggttcgccactggtcacctctgtcctcatgacgagggagagcacagaggtgcccttgcccacttcaacaattaactcatctgtggatatgcaatcactagtgtagatcttgtgatattggagattgaggacacgaggctatgccatggtagtaaaacaagtagagattaaagcggctcatcaaaatctttcacgcagcgtggtatcgcgtcccctcgtttcaatcgtgtttcaccgaccggactgattcgatcgagtgtagtacactactggagaaatgatctttactgggtcggccgatttccacaatagtcccggttgctcgaaaaactgggactaaagatcatctttagtcccggtttatttgtgcaaggggactatgtgatctttatcaaccgggactatatttagtcccggttcaactcgtgtcaaaggctgtcaggtcctcagagatatttagtcccggttggtaacatgaaccgggactaaagatcctaaattcagtcccggttgttattcccaaccgggactaaaatttatatagatttttaccaaccaggactaaaaatcaatataccgtatataatacctttgcacttatcctcaaaaatttccatctcctattcctcctcctctctcacgcactcttatcctctcattatcttcctattcctactcctcctctctcacacagtcttatcctctcctttttctcacaacgccggcgaggagcgggtgggccgcggcggcggcctgcgcacgatagcggggccagcgggcggcggcggggcgcggaggcccacgcgcggaggaggaggctaggagggcggtgggcggcgggccagcgaattttttttttagaatt

SEQ ID NO: 50542 - DNA, 7519 bp, Oryza sativa
agcgcggggatcgggaggccgatgaagaacgagtcgccggcgcagacgaggtggccggggagctccgccatgacgtcgccgcccgtcgtcgccgcggacgccaccagctggctcgccgccccgccccagaacaccagcctcgccgccgccgcctccgccgccgcctcctcgccgtgcacgggcggggagcacaggcacggagacatgccgttgcccatggatgcactaaccacgatctagaatattctagaagcttctggactagaagcgaggtcgcggaagaggcgctctctcttcgatttcttttccacaagatttgaggatttgttggtgcgaagatgtatatatagggggagcgttgaataaaaaaatggaatcgtgggggttgacatttaaaaagtcaaaaattggggtttgaattttttttttggttagttttacgtggggttgaccagatgggtgttcaaaaatctaaccaggtgtgtcattaattaattagtggtgagtcttgtcatgtcaacgaccgattggagcttggaatggaagcttctagcgttaatcgtgcttagtgagtggttcttctcgtggaaagtagcttaattaggtgggggtgctgataattgggtcaaatccccgggtccatcattagcaagcagggttatatatactcttgggctgcgcttgattgtgctataattgtaacctaaagctaatttaaattttttaaattttgtttttttattaattttaggtgctcttttactttccttgaatagcacaattacatgatttctagggaaaaaaatgctgaaaaatatagatatgttgttaaaaatcaatgtttaaagtttaaaattgcttttgatccaaagcacaatcagcgctcagcttttttttatatgtcaaagtcaataagctatatggagtagtagtatatgccacacataaatgggaagagctccttttgtaattgcgatgtccggcagaaataaaattagcttaaattaaaagttatttactctatattgggcttaaaagacgatggtacctgcagatcaaatatagagatgtgttacctagccactattttgttgcttttcaatgtgtgagtaaagtgctccctccgctttaaatttgtatgaaaacgctattaacttttggtatgaaatttgtccattcattttataaaactatgtattatgagaaaaatctactccccggtatcccgtggtgtcgggatagctcttcaaccttattcatccgaccacccgcatcctcatccacccgacgcaatccccatctcactctcatctcactcccctcctctctctctctctcaagaaggccgagtggagacgaagccggccgggaggaacgggtcgtcgtcgtcgtctccggcggccgaggaggacgacgacagcactgcgtcggcgaggtcggccaaccctcagcggggtcgccctcaagctcgcctccccttgctgcgccgctctggctcgccgccctcgtcggtcgggtctgcgccggggactcgtcaccccggggagggcagaagtgggagctcccctcgtcctcgccctcggcctcggcgtcaccgtcgttcccgctgcagcctgccgctttgcgcctccgggatggacgccagcagcctgcgtcaacttacaacaggtatggctgtcaacctcctcctcggcttttcctcgagacttctcacgctctctggctcgggcctcgaccctcaactcgccggtcctcctcgatgccatccttcgccggtgcggccctccctcccccacatctcctcctctttttgacggtaccctctgataccccacaagtatcaggctgatacctaggtaccacccaataccttggcaccgggtatcagatatcagtcgatacctagtcggtaccaaaggtatcaggtaccaaccggtacctaaggtaccaggtatcaggtatcaggtatcggtcgatacctagtcggtaccaaaggtaccaggtaccaggtaggtaaggtaccagatatcaggtaccagggagcacacgtggacataccaggtatcaggtaccagggagcacatgtggatatactaggtatcaggtaccagggagcacatgtggacagaggaaaggaaaagagagagtcacttaaaatatcccgttgcaacggtatcccgttgtgtagctgccctcatgttttatatagtgattgttgtggctacattgcagctatagccgcaacgccacaataatagcagcaatacaagcaatgttgcaacggctggaaccatcgcaattgctttcgaatagggcattaaaaaaatagtgcaaatataaaaaatatacttaaagtgtatttaataataaaacaagtcataaaaaataaatattacttatattttttataatacaaatggttaaacattatgttcaaagtgatttatcatatttaaaaacggatgcatattttatacgaattacactaatatcaatagtgagaaagtcttcccaaaaagccagaaacagagtacttcctgcagatataatctaatacttaaaattagactccacacatttaaataaagtttatgcatgacaaactgaaccatctaattaatacagcaaattgaaagagagaaaacaatactcgtagttgtttttcaaaacagagaaatgacttttctttcagttctagactactacgtacgactgcgttgcattacaattagctggtgccttgtgtagacaacggttcagtagaggaaattttccatccattgttttgatatctgtcagctaggtcattagtcaatcgtcaatcagcttccttcttcaagcggtgtatcaaccaatacaagctagctatcagctggccgacatgcttgagaaaaaaatggaattgcatatcgcatgaatgatgaatggtcctgcgtcaccatcagctgcatcaaaatgagcagagatttcctcatttcgtgcatgtgtacgttttcttgtgccatagaaacaacgataatacctttttgtttgaacaataatactttctgcataagctaaacccgtgtcggtgttgactgtcgcattcaagaaaggtaggcatttttttaaggatctaaggtaaccaatttaccaaagaaattaaaccacttggcccaaccatggtgtggattattattttaactgatgcaacatctttgttcttgtttcctaagttgatttatctatactactttaaatgttgatggtagttctgccagccatccaacatcactgtcgggttctcatcctttatcgtaatgccattaccattatagatacttacgtgtggggcaacagggtgggatccatatgcagtgactgtaatagtcaactatcactgtcatatgagcccaaggccccaaacaatggggttggtgggatgtatctcaaactaacaactggaaaatatgatggcatcttcgattagacaatgaaaaataattttatgtaatgtatgtcagcctaatttctaacattcaactaatgcaagtattatcttatagttagataatagaaaatggtttaagattgaaattttgttgcaacgcacaaacatttagctagtactagtagaatcacacagaatcacaggtcacactaaccaaactttgaagaatgtcataagtaatggaattactaatgtttatcaattgaaatgaagtctttatgggcggagatagtacttatggtcatttattttaacgggctataaacaagactttaaagcctaaaaaaatattatcattataaaatcttcacatcatattatttctcatcaattttgcttcacttaaaaaaattcttattttatggcttgaggttgggggatccatatggccgtggtggtggatggtgacaattcccccctcaccacaactattgggaccttttaaatgagtatagatatggcagttataggaatattaggatacgattgatgatttgtttagaatcattcatcatatctaatctttttctcttatctctattgttatacgtcatctcttgaggctcaatacaattactcaagttacgcaatatatgtctcttgtataacagtgaacactaaaaaaatgggtacttgtgcctctgtggagagcctatttttccgtgttccaaccaaatttaatttgttccatttgattaacttcatgattcgtactccaacattcttcaggcatcgaccccttcttcattccaatgatatatctgttctctctgtaataggaatattgttaggctaattggtttttactcctaggcttcgtaccatggcccaggtgcccaggaggagtaggaattggatttgtcccatttgtgctcacatatgtcggccgcccatttgtgtctgacgcaagatctcagtacagttgtaaggaaaaggaatttcaaataggctgtgtttagttctataccaaaattatatgtttgactaaaattggaagtttgaagaaaaaagttgaaagtttatgtgtgtagaaaagttttgatgcgatggaaattaaagttggaagtttgaagaaaaagttaggaaataaacaagcgcataggttacttttacataccaacctttctttaaaacatatactctattttttttataatagatgacacgattaacctattatgtttgaccattcaccctattaaaaaattctatataatattatttattttgttgtgatatgttttatcatttaaaaaactttaagtatatatgatatatattttagcatatttatagtatttttagtaagataaatagttaaatgttatttaaaaggttatcgacgtttgatgtcgcgattccggtatttgcatagtatggggatcgttggtactagaatatatgcgagattatagtaaaaaagatggagacgatgatttatatacaggttcaggcccttgaattgtcaggtaataaccctactcctgttggccgtagccggtcgttgctcttatttaccataatcacaccggtacaatatttggggtagcctatctatctattgtcaacatggctgtctgaagtgctgacacgtagtcgacaacagagtagtcttcctcctcaaatccgtgtccggcgagatcagagatagcgttagatccctcttgacggtagtcgtaggtaccgtatggagactactaggcttatctccaatgttgatatctggcggcttgtcttggcgtatgttggcttgtatattgatctattgtttcgtctcccctctcctcctaggaggccttgtatttatatttataggtgtcccctttacaaatagaactagggaaatcaatatggatacaatccgagtagtccttgtcatttccatgtagaactctagttgtctttccttatccagaactcctcctatatccgaaggttgtttccgtataagacatggtacgtggtgggtcctgccgagatttagtcaactactattaggtacgtggtatccataaccctgacaaaagtgttgttcattataaaaaaagagaattactaatatttagagcaagtataatagtaggctataagccggctaaatgctgaggtggaggagagaagagaggagagagaggagaaaatggctgtaaacttacagccgacttggacataagaaccaagaaactctgtgagagagataagtgggccatgtattaattataaagagctaactattatatgggtaagctaagagaagactacacagaaccttatagctaataggtcggctgtattactggccttgctcttaggagaaccatgcactcgtagtcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatgtaaactattaaataatctcacaaataagtatcatctattttactttgaaaaatatgagaaatcacaaactaattttgtagatcatgtttcttgctaatattttttagacttgctaactaattaaattgataatactttcaagctacacaaaataaactagataaatacttatcttagctaacttaatatagagtaaaatacatgagggtgtagtggtggtagtgtttggataggggggtgttggcaccctttggcacccccttaccttcgccactgctcgtagtgatccatatgaaccgataaatctctccacgccacatcaagtcatcaacctttgggcatacacagtaattggaacaggtcaaggttcattaagacaatacccaaaccgtcctaaacaccccaaccgaattattccgttcaaaacaagggaaaataagtacatatgcccttgatgagctagctaagcacaaaatgtacggattacatgtcaacctcgatgaccatttcgatgaactaggacgacgtccttgcagagtttcaaaatataaacatgtttagatactgatacggtcttcgagatgttactttgacgaacaatatctataaaaataaaaatattttaaataaaaagagttatatattatgatagtttgtttaatgataaatctagtaacatcaattttatatgattgattttttaattttttttctaataatggtcaaagttaaaaacatttaacttgtcactaggcttaaaaatgtttatattttgggacggagagagtacttgtcactatgcttaaaaatgtttatattttgggatggaaagagtaataatagcactaacaatttaaataataatcacggttgaaacttgaaactaatgctaagtctgtgtttggctcccactttttctcctttgttttcgacgtgcatatttcccgaatggctaaacaatagtatttttttaaaaaaaattctatacaaaaattatttaaaaaacatagtgatccattctttaaaagaatttagctaatacttaattaattatatactaataattattccgttttacgtgcgcgagggattaaactgaacacaacatataattcatcttgaatctcgtcagctatttcctccgtccgaaaatgttactcccttcgtccacaatagttgttgttataggttgtttaataccacctccgttttttaatagatgacaccatgcaatcaaacaaataattaaattgatcagcagcagcaaggaattaattaaagataaatgcacaaatatcacgtgaggtgtgattggttgctggcttgatgggcatgcatgttgccgatgcatggtcctgtgcatgctggtgacgtgtcatcatatcatttgttggccatgttgccattcacagccttgttgaatttggttgttgatgatgtcgccggtggcgaagacgaggagcttgaggatggcgagagcgatgtcgcggtcgtag

SEQ ID NO: 50543 - DNA, 9161 bp, Oryza sativa
tttatcactcatagtactttaagtgtgatttatatcttatacatttgtataaaatttttgaataagacgaatggtcaaacatgtgagaaaaaattaacggcgtcatctattaaaactcaagagcaaaaatgactacagcaccccctattaaatgttatgggaatgtaaataagaagatactccctccattccaaaatatagggcacaactactttttaaagttgcttcataatataaggcgtgcatatatgcataacaattaattagcatctcttctctcctaaattagtactccctccatactcataaagaaagtcgtttagaacagcgacacggtctttaaaacacaactttgacttcttgtttctataaaaatatttctgaaaagtgatatatatatatatatatacttttatgaaagtatttttcaagacaaatctattcatataatttttatattttcaaactcaacaacttgagagttattcatgatttatattcccaacgtttgacttaaacattatcctaaacgacttcctttatgagtacggagggagtattttttaaatcatacactcacaagatgtttaattctattgggtgcatgtattgtattaattggattgattcaaacaaagaggtgataataattgtttcttggtgtttgggtcagggtggttatgccttatattttggaatggagggagtaattgggagtagaatgaaaaaaaaattgaattgaaggtgattgatgcgacaaaagttactctaagcatgtgtttgatttcgggactaagtgggatgggatggaaccatccctgattttttggttgggatgattccactcacatgtttggtttgtaggatgggatgatcccaattttttgtttgattaaagggacaagagagagatgggatggacgctgtttgcaaccaccgtcaacgatcgggcgggcgtgcgggcgagcatgccggcggcgagcaagagaaagagatggtctccgagcgggcgtgtggacgagaaagccagcggcgagtaagagcaagaggaagagaaccatggcttgctcacctcccacatgaccatggcatgccgctgcccctcaaccttcgcgagttcctccccgcacgccaccgccgctcctcctccgtaacagtcccctgcctccggatccgccgccgcagtcctccccatcgccggatctgccgccgccgccctccccaccactggatctgccgctgccgccctccccaccactggatccgccgtcgccgagccccctaccgccaccgtcgcccaagccgtatgccactgctcccgagggcgagcagggcgagcgcgcgagcaaggcgtcgtcacgccgttcgctcgtcccaggtgggatgagttcgcccgcgagattttcttatatcggttggtcccgggtctgaaaagaatattcctctccaggaaccaacccatcccactcgtccctcaaccaaacacccctgaaagtgggttcgtcccatcgtgtcacatcccatccttgtaaccaaacactatctaaagtgataaactttttgcaacaaattttaaatcctaaaacaacaattattttagaacgaaggtaaaatatttttagatgaaggtagtactcattcgtcgtcagtcagtcggtcaaaagtaccaaagagcggcgctgagaagggcgttggctaacttaatttgacatgcaaaacctgatggacagaaagcaatgtacgtaccactcccctttttggtctttctaattagcacgtgcattaggcaggtagaggtagtaggtagagctagcgtgctaattaggtcacgtgttccgtgtgcccacgaggaccaaaacgttaacgtggttgaagggcagagaagaccagtgcatgcgatgcgagtagtaggagtatatgcttggaaaaaattggaatgctgctttggatatatattaagaggacaacggagccggtcgatcggtcgtactccgtacttgtacaaggtttggttaatgttccactggaaagaatatgtgtgctgcagtgtactagtgtggtgataaacaaggggatatcacgttgggaacaacatagcagagtttcgtcatgttttgtccatgcctgtccagaagggagtaatttgaacgtgtgtgtagagtatcagagttccaagtttattgaattgttaatcacttgattcatggccatcgcataaaaaagaagattcataagaaggaataaaacatcaaggtagctagcttattcatcgatcctaagtgtacatgaatacctgatagtcgtaaaatcaattgaagaaccaagtttgaaaggtaaagttcaacggatttaactgcaggctggtttcagtagatttatggtacattcacaaagattcagctaaaaacaataacttaaaacgaattcgaaaaatggattgcaaatcaggcttagagccagtggcgtagttaggatttagagtaaaagtgatccatctatatgtaaggtcaattaaatggatggtccactatataatttttattatattaacttgcatatataatatagttttaatctcgattaaatttttaggtagttcatggaccacagtaccacctagcatgccactgcttagatccttatatcatacacaccatccgtaactagtaaatagccggtggctatctatcactctgtaacacaccatagtctaggaccctggagctttggcccattagagtcgaagcagctgggccttctctctccctcactccgtactaattgggctttctgttgggctgcattctaatggaagtatatgcagctttgggcatactaatgaggcaatggcaattggaagcaaagtggcaaatagttgcagattagacatgtcctctaatttttggcctttggccattatgtctaaaagaattcagttagctaggagtatgttttttattccattttgtccttttgatctgtatctatttgtgcatatccgctaatccacagagggtcccttccctggattcattcggtttgtatataaatccaagcatgacaaattggcgagtgaatagacaaaacatttttttgcacgaaagtatatgaaactgaagttgatgcgtcacactgtcgggaggaaggctccgaattaaacatggcaaagcctgacaagtgacaagtgcgtaagtgcctctcgctatcgaaactaaattttctgcggtgaactcattcaagtatgcacgacgctgttgtctcttccgggctgcaatcagcacggcatgattgcagggctcatgaatctcgcaaagatttgtcttcccttgtttcatggctcatacaatagtacagtctctccacattttcagagcagctcaactgctcaactgtctttttaaaaaatgttgagctaattccatctttcaggaaggacaagttaggccttattcggtttgaagaattcctaaaggatttctcaattccttaggaataaacactattcatgcattcagttagtaggattcaaaggaaagttttcataggaacaccatgccaattctccaaaaatcaacatccactccaaaatgacagtttttttttacatgaaaaatatgctgtcagtctcatatttcatatctcaatttttttcatatatcaggtttaatattttaaggtttttttctgaggtttaactatatgcattctagatcgtcatttatttcgtagcttgttcataacaaaggctatgaaacccgaaaccaattaacaaagtcaggggatgtacgtacatgcgtctttggaacataggaatttgaaaacacaaaaaacaagaaaaatgtagtaatagaatgtcgtaccacaataaatcctacttgaaagaaacccacatgatttcgaaaaaaattgtatggtaatagtataggaagagtataggaattgtgagttagtaaaaagaagagaaaacatgaggcctagccttatgttaatgtttctccaaaactcatatgaaatgagccattccatgagattttcaaaggattttgtcagagctttttctttgctccaaaggatcatgtagaaatattttctaatcaataatttctacagtttccctttgttccaaggaagtcctacatgtttttgactagacatcaaagacaaaaataaaagttataatgatgtttacttacaacacatgtagattatcggaggagtacgagatactctctccgtccttaaaaaaagtcaaactttggatttccgtgtccaattttaactgtccgtcttatatgaaatttttttataatttgcattttcattgttgttagatgataagacatgattaatattttatacgtgacttgtctttttaatttttcatattttttttaaataagacggacggtcaaacgttagacatgaaaatcaaggtttgtctttttctgggacggagggagtaagcctttgcacatgtaggccctttagtatgggttggcaggaagccggccggcctaccggcgttggccgctagctacacaaactccaccgaagcacaacatccttttacttacagcggggccatccaaacaaacgccctggccagagctactgacacatgggcccctgcagtaggctagccctcactcccgtagaaaagcgcttcaatggagccttcatgtagcagatagatcctgtacttccgacgtgttccaggaaagccgtgcgtcaagggcgtttggtcctaaacacgtgatgtgttggatgagatccaattttaaaagtttcgttatcggtgactgttcaaatatactttcctccgttaaaatataaggtaatactccctctcccataaaaaaccaacctagtaccgaatgtgacacatcctagtactacgaatctgaacatatatgtccagattcatcatactagaatatgtcacattcagtcctagattcttttttttttgggcggagggagtatttgattaggaggaattgaactatttcatgcaaagatcctgtaaagtttatatgttccaaaggattattaaagttatgtatttaggaaattcgatcatcttgggtaaaaattttcttttagaaacacatgataaacgttgaggttcacaacgcgcgctctttcagctctatataaacatacacaccatacccttataaacatatcggaaagaatggaccaccgtgtattaagattgacgaagtcatatgtatcttgaagagtatatcgtctaccactgaaattttagttaactataaatacgagcacccatgtcaagtctatgacttgaaccgggtaggttggttctatcataaggaatctaatcagttgaactacactcactttgtaacttgggtacttttgttaacagttaagttaagatcgtatatatttggtgtgtggtgtcatatgcatatgttatcgatatgttcatgattaaaagtattttatattatgctagtttataattattaatgataaatcatcaatggattcgtaattgttgatgaaagtttatcgaagatttatagttgtttatcaagattcacgtatagaaattgatttgttcgtctaggacgcagtgtagtccgattaattagttcaggcataatgaaaacaagagtgattctaccatatttttggaaaggtaccaacagatatcatattttctaatataaaacttattttcagataccaagtaacgcaagataaaagaaaattagtgcaaaattttagtatatacagttaccctcttaagtaccgtacaatttgtttacaagcaagtcttttaatttcttctttttgcgcatcatcgttactgcagaagttaattaatgactcttactagaagcatttacccaatgacttgcatatatattggtactaatacttagagaatttgacaacatcacatttagcctatcctactaaaacttagtaatattgccaatttatcaaaacgattgattttgaaatcgtttcaccgcaatgcagtcgtcgactcgtcgtacacgttcattggacgctgacaagcactagcgccactgcgtccagtagagcataacagcgcatatctgccatcagcatcgacgtccacaaaacatcaatactaacagccacaaacgtacgcatgcatcagtggacaaaaggccagatcagacgacgcacgccctgcgctgcgctcacgcggcagctcgcgggttacacggccgcccgagccaccaaaccaccaccaccccccgatcggcatcgctttccaggcttaccgcttagtacctgttacgacaggggagttcggtatctgtatctgccggattgtcgcgtgtaccgacaaaaactgattaaggactcatcatgaatcatagtactaccgaattacggagtacgagtatcaaagtcgtagcctaccgtgattaattagcatgctaattacagcttccctgttctgttcatatgtggtactcccttcgaccacaaaataaccgtcgttccggaaatggaaaaaaaaagttactatctaactttacataaaagtccacctaattaaaaccagatatgcaccccctaaattttttaacactgttttatgcaaccctttttacataaaacaccttacgatggttttacaaaatagttgctataaatttgcatatatgttaaatgagtttgactatttcacatacacctcgaacgcatatgttaaatctacacctttttatcccattttctctcttacttatataaatgagtactaacataatacaacacaatactagtatgatataattactgtagagtataaattaaggactgatgatttgtgtatgtaggtatgttatatcaacatccgaaaccactttaggagataatttaaatggcattgcaaagtttaggggttagatgtctatttttaaagtttagagtgttatatggagttttatccaaacttcaggggttcctttagaaattggtgggtcaccaagacacacttgtctcattattaattacaaataaaatacctataaaaagataatttttgaaagttatagtattttaaaaatagttttaaaacaaatctaaccatataatttttaaaagttggatcggaatttttttttgcgggaggatcggaattatttaaggacaaaagtataaacttgttgatagtacatatttcaaaggaaaaagtacaaaatactccttgaactatcgcggtcaaccgaattaccccttacccaaaaaccacacattactcactctgaactttcaataccgaccgacttactcccccttgacccaatccagagcggttttatcctacgtggcatacgtatgtcaatccagccagtattttcttttaaaatattggtgagacccacctatcataccttctattcccctcttcccctctctcttcactctctaactctctcttgcacgcatggcacgcacggtggcacggggacgggcgatggcgcggggacgggcgggcaggcgccgcgcatggtggcacgcacggcacgacggtgcgcatggcgacacacacaggatgggaaagggtggaggggaaggggtgaggaggggagggagagtgtgttaacgaccaaatttggtaataccagtatcggagacgatgattagatcaaagcggaatcaaagatgaagattgttgcggaaatagagtaagaatcagctggagtccaaatcggctacgatcgggatcggctaagtccgagtcaggctgggttagacgatacagccgattccgacaatacgacttggtgtacgtcatcaggttgagttgatatgcttcaagatgattgccacgcatggatagagtcctgagaaagcaattgtatctattaattagatattttatgtatttccttagaaatatgtttgggcaaaagtctgccgcaaagacttatggtattttagagtttgttagagataagagtcgtgtccgatatggacatgttgtgtaattctcgggtataaatagaccccgagccctatgtaatcaaataaacacacgttcaatataatctcggcgcatcgccaccctttttgctttcgttttatttcgacgagttcttgctttcaggttgagctgcatcggtttcgatcttcaacaaaaggtaaaacttgttatggcggcttgcgttctcgggattagtgctttcatctttatgatactctaatcttgtctatgtaattcgtcgagttatcatatatcttatataatctctggcaatatcgctatctaatctacaatcggctgacatctatcaatagagggcagctgattaggttaaatatcgacgttggcttagattatatatgatatccaccactctatgaaacttccaatggcttgattgtctagatattgtcctttcttttcatacttatagctgcatcagttgattgatcttatgagtcgtgattagaatctcaatctctagcctgcttcttggttgccgattagggtagtatcggggtttcagccgatcttacctgatttaactatatttgctttatatgctttactgacatgttaaatctaccctttatattaagatcttgttgcacctaggtatattaggctttcgtttagtatattctgcttgctttaatatcttaatttagagtggtatcggagtattagccgatacatgctagatctatttgatcggctatgctatgaacatatatagtcttgttgttagtatatatttcgatctaagtgatttatactgtctcgccatggcgaccaatctatcccaatcactcgatttaagcatatattgacatgaggattatatattgttaatatctacagccgatcgagtagatttagctcttccttacctattcatgactgccgatcgatctatatatgacatcggcttaaagataaatgatacgtcatcggcacttagccgatcggctatcgtttatggatttaaccacggtttttttgtctttgtttttgttgattgcaggatcaaatcaactggcacgctagcatacccgaaggtgaattttggacctgcactggagttaagcagatctcccaagcctcgtgttttcacatcaacagagtggaggtggatggaaaaagggaggaggtggaggtg

SEQ ID NO: 50544 - DNA, 1350 bp, Oryza sativa
ttggtcattaacacacccccacctgtggccgccgcccgcttttcagccacggccccttttcgccgccgcctcctggcaccttccgccatggccctgcctctggccaccgtctgcctcgccctccacgagcgctaccgtgtgcaccgacctttccttccacctccatctccatctccatgccacttccgacctgtcctgttgctcccgctgccgctcgccgccagctgaagccacccagccacacccccatgctcgccacctagctccattctccgcctccgcgtctcgcgcgccgccctgtgagagagagagagagagtgaagagagagaggaagaagggaagaggagatatgataggtgagtcccaccattttcttaaaaagaaatgttgactggattgggcgagagggtaattcatctggtttaaaagcttagggtgagcaatatctcctcttctggagtaattcggtcgacctcgatagtgaggggataattcgtactttttcctaaatcattccttatttgtgactggttggattttttcttacttacatgacattgtaagcggttccacgttaacaactcttttattaatgtcttaattaatattttaatatttactataatcaaagtataacgcacgataaatataaccttagaacttacggcaaactctgtcaaataacatgaacaatgtagtactattctacttacacttgagtagatgttttcttaacaagttggggaaaactatatacatatacatacgtcatcaaataaacctccgtaccaacattttataaagaaaatttagcgttccattccatgtggtttggattaggagtcaaagtggcaatcagggatactggctggtacctaattaagctggcataatgctaattgggattagctagctcaccggcacactccggagatctggcagtaggcggcagcaaccagcagcttctgcacgccctgatattctacgcgacgcccgtgcgtgtcctggaaaggcgacagggcagttgcaaccgtttgcctggctatagccaggacgcattggtcttttctgtttgtacaatcccaaatttgtataatgaactgaattactttacatgaagcaccaatttaacttgaaaataataaaaaaatgtctacattcatttcaactagtgccggatagtttgtacacacgcgtgaccgttaccgaggatgctatagggaaaagatcagatcgccgcagaagcaagaacacactcgagagaagaaaaaaagataacatatggagtgagacaagagtattagtattaggctcgcaccaacacaaatgagacgtcgagaagatataga

SEQ ID NO: 50545 - DNA, 2626 bp, Oryza sativa
actacatatttttcccactagtccaaccccaacctttccacctttccaggaggaccatgcccaatagtttttagcttggcaaagcagatgctgatacatatctacacacatagatatatcagttggttgggttgccgccgaaatggtcccatgcaaaactctgatcagaagagtgaaagtgggataatataagctgcactgcacactgcactgtgtgtgcaaactgtagtaagttagttgggtaggataccctgtcgactctcccctaatggcaggccacaaacctttatttgttctgtgatcattgtaactttcttgctgttctttcatgtgacaacctctgttatgatgatggagaattttaaccatcccaatcagacatcctgatttgcatgcagagaacagaaaatgtccatgttgctctacaatgtgtttggcgtgagcttgaagggatgcatttggagctgaatgataggtgatggtaattaactggtaggggcgtcccccctacctaagcgaagccggaagcaggggctttttctcattggggagatgtggaaagtgttgatgtcttcttgccaacctgcaacatcggcgcagctaagcgatggtcctctcgctctcctatgggtaggacactccacaaattattgggcaacctgccggtgcactgaaaggaagggtttttggatgtagactttttgtccatgtaacttttacatgtgctgtggtcaggacaactatcgattgtgtcgtggtcacaagacaaaatttgttgacgggtgctgttaaaagatggtataaaaaagcatgaggacatgcaactaatgtaaaaacatataatcaattttcatctccgtcacatatggatgcgacactctttgcgccaaacacacatgcaagtgttctttaaggaattgggatgcatctaaaagttgtatatttttcactcaacccaaatggtcccaaagttgtgaccatttctatttgcttttgtaaactcaaatgttatctctaattagttagaaaaagaactcttgtttataattaataatgagtaaatttcacaaaactatacatgctttggctaaattatcacaaaactatggatttaacaccaaatttacctcaaaactacatatttaaggtaaagtattgcaaaactatagatttagtaacaaatttatcacaaaacgatatgtttagcgtcaatttaataacataacttgaacgtttataacttaaaaataatgttagcgctaaggatttaaactcataatatgtagttttatgataatcttattattaaatatattgttttgcgatacttagtcttataagtgtagttttgtgataaatttattgttaaatatatagctttatgatacattactttaaatatgtagttttttgaaatttactcattaataattaaaaattaaggtgtaccaaccatccctatcaattgtcctttatgcatacaaataatattaaattctctcttttgtgattattcatttctctagtaaccctaccctatatagttaataattcactactccattcaccatcctaaagctaaatggctaaacctaaccggtgtaccggtgtttctctactgcttaaaaagaagtcgtctattcctgctcccctcctcccagtgtgcatagcatgagagggaaaaccgctcccatgtcacgcttcaactaccactacgaataaccgagttaacactcctagttaacctattgacggacgtatacataccgactctgtcacgaaataagcctatcctgtactacaatgtgacatatcttaatacaatgaattttgacatattctgtatttagattagtagtgtatgtcattgtcattgacataggaagctgacaaattttttctctctctctctttttcatttaattatcttggaaaataataattttgctagaggcaagttagttggaagcttaaggtgctagcccgcttttaattggagcatcttacaagagaactacccacgtgactacattcattggagaaacaaaatcaacatgctattaaagcaacacaaatactgaaaatgatagacctattcctctcgggagcaaattgtgaatactcatgaatttgcccacggaagggtaaaatgtgatcgaatatatagaaaaagttatttgaaattaacgatgccatattttttcataaaaaaataagagtaaattccatcaccggtacctaaacttgtaccgttgtgtcattccggtccctaaactcgcaaatcgactgtttaggttcttaaacttgttcgactgtatcatcccgatccctaaacttgcagatcactcgtttaggtcctccaacttgttcagttgtgtcaccccggtccctaaacaggacggtttaaagactttaaaatttaaaaataattcataactttttcatgtgaactttaaagaagacaaactttatatcaaaattgtagccctcgacgcgacctacaactttgtagttgaaaagtttttgaattaaaactgtttagggtctaaaaatattgttacatgtttatagattttgaaattttaatgttaaaattacattttgggataaaaaatgacttaaaata

SEQ ID NO: 50546 - DNA, 6490 bp, Oryza sativa
tcgaacaagtttgaggacctgaacggtcaatttgcgagtttagggaccgggatgacacaacgatacaagtttaaggaccggtgatgaactttactaaaaaaaatgacatatatatagaaacagcgggcggtcataatatgcgtatactcatccctataaacgcacacgcacggatacactactcctataagcacctccaaaaaactggacctatatcttgagatcaatgaaattatcacgggacgcctcgctgaagactaggccaacatatcttgatatcaacaaagtcatcacagggtgtctcattgtcaacaatacgtcgtctaccattaaaaaaataattagccataaatacaagcttagaatataggacttgaattaggatgggctaattttatcacaagtaaactaactagtttagctaacctcacttcgcaaacttaacatattttaatgtaaattccatatctaaatataacaacttttaacccttacgatttgtccctaaatataacaacttctccaccaacattctctttccaaccaatcacagccctccaccattcacttttcccacatacctccattagtcatccaatcacaaccctctaccattcactctacttacttttttaataactgtgtccaactctaaaacttattatattttgggatggagggagtacaaacgatagttaaacaatcacatggtgaaaaacaaattaactgaaacagaaagaatataatgctgtacttttagcaaaacttttgtttctctcacatgtactccaacttaggagtaaataagtgagtttggtatagggtttgaagcactaccaaatatcggtagtgtcaaaaatttagataagtttttggcactattagtttgtggttaggataaagaatttcgggttgaagcatttttgaaatattggtggtgtcaaaatttagataagttttttttacactattaatttgtgggttgctatggtagatttgactgcactctataagtttagccgaacatgactccgttaatccagctggctattataaactactagcattccatacatcttgtcgacgggtgatacccgtagaccggatatagagggtattggggtacgttggtacaacgatctacgtagtacgacatcgagcaatcaaaagacaagaattatactggttcaggccccttgacaggtaatagccctaatccagttgatatgggattatacggtggaaaacacagcttacaaaggaaaagatggaacttgccatatccggcgaggttgtaatcgagttgattcgactagctctcgacgacttggctcttcgcaggctccggcttcgtaggctatgtgggttgtattggctctgagattcgatcccttatgccctccccgaggggtcccttttataccataggtctgatgctctccgagtaggactcgaacacaccagacctagcacgacacgtaggtaacccagttcttgtccgagaaggactcttcccatttgttgatttcgtgaaaagtttccttagattatgaaggaaatgtccgcgtacgcgtgggtatgccatgtcgatacataacgtatatcgaagggtagagggtatgccagacccgtaaccctgacagtagcccctgacttctactcaaaatgaactcgtgcgaccatttgcgacttcgggtgtcgagaacgttatcattccaggtgcgaggaccacggagatgacttgtagtcaagcatgccgtttgaagcccaacggtcacgagtgaattttgaactaaagtcaaaaactgccgcgcgtaacggacctagaaatttccttcggggatttctctcagttccttggaattcgcaccgtcgggggtgcgcctatttaaagggattttaagtgcgcattttgaagtccgcccactccgtcaagcacacaccgcccgttagcactcctcgccttctccgccgtcataaagaaccctagcttcgtcagctttaggtccatctccggcgatcttgcagctgcgatggatctcggcaagtcgacttccactagcgcgaccctaaagaagctccaggaggatggcgcccttcctggccgtggaaacgcggagagggaagcagaggtactgatcctcagcccatcttaggttgcatggttgcgatcgaagattatgttgtctgcgggtttctccctccaccctcgaattccttctgctggtcttgaatttctatgggctttctcttctgcacttgaaccccaattccatcgctgcacttgaaccccaattccatggctttccttagcgtccttgtgcatctttgcgaggcctacattggggtagagccctttcttgatctgttccgcttttattacgagttgcgctggatggaatccaatagggtgtccggttccgttgggttccgacttcgtgacgggatgaagtcgcgctatgtccccttccagtgcccctcttctcgcagtaaatggcggaacaggtggttttaccttgaaatcaaggactcaaatccggtcctcgttgttcccgaggaacaactggacaagattccagtctggaccgccaagccccccttggccccctctctccaatcgtttatcgacatcatcgataatctccgagaacggggtttatcgggatatgaagtcgttgcagacttcgtcggtaggtgaatccagccgctccaggctcgggcccacccggcctataactattccgggccagatgacgcgacccgggtttctcctcggggtatctttctcgcattcacttcgatatgcttgtactcgcgatcccctctgacctatcaaaaactaatttcttcttgacaggtctgagcagcgaaatcgtggagcggcgtgttggtcaggtgatgatcagcggcccgaccacggcgagcgacatccccgtgcccctttgtgaaaagggagcggcggagcgtgacgaaccaatcaatgtgagttcattcgataagcgtccgccttcttttgctcaaaatcagcttatgacatgatttagcgtaagcccttcctttgactgatgtcgtcggtccgctcgcggatcatcaggtggcggcatctctgaaagagaaggtcgtcaaggaggcgtctgacgctgccactactagtggtggcaaagctccgactaaggcgaggaaattctcgtctgtgctcggacaccgccgcaaggcggagactccctcggaattttcaccttatcatccatttatgtagcgaggaagatttgttctcaccctatgtcggttgtcttgtaggcttccgacacatctcctccgcctgcgcgacgtcagcgcattgtgacgatcggcgagaagtaagtgaagaaacttttagattctcgtgtcttctgctcgagtggagttttgattcatggcgatttatagggaggcgcgggcgaaagcagctcgggccaaggccgggggaacatccagtgcatcccctgccacggcatcaacagatgtcgttcccgtggtcgggagtcgggaggtgacgccgagcggccccgtcagcgaccctgctggaggtcgtggtctgccagagaccgtcctctcctgggaggagctccaagccaagatgaggcgccttctcgaagccggtgctcgcggcatcggccgcgagatctcagaggcgagggcggagacggcagcggcaaacgcgtgtgctgagcggttggtgcgggaactggctgaggcccgcgaggacctcacgaagatgagggagctggtggccgggaacgagcgtcaacgcaaagggctcgaggtctgcatgtcggaacttggagacaatctctccgagatccgtggttcgctgcgggtcacctacaccggcctccaccagctcgccagggagtgcggcgtcgagtccacgatcccggtgaaccccgatgagttctcgttgacttcttctcttgcggagctggcgacggcgataggggaaatcccctccaagcatacggccaggatcgcggaggagacgtccaacggtatcttcaccggggcgtgtcacgtccttgcgtgtgtaaggttgtcgcgccctgaacttgatctgcgtgagatcttggatcagggggcggcaagcgacacgcgtagagaggtgatggaagaagtcagtgacctgggggagtctgtcctccctctttttgaagaataggacttcttgtatttttgtcatttgtaaatcttgaactctggttgccttcgtgcatgtgattaccatccttgttcaatgttgatctcggaagtttttcttgtcgattgtagagatgctgatgacgaggatgtccagcagcgcgggcagcccgagtcactgggcagcccgagtcactggcgataattccggtactcgagtttgaaccacacatcccacatgacgtcgaggaccaaactcttgatgtgaaggtcgacatggcgacaaccacctcaagtgagtagcctttttaactccgtgttgggttagtggtttccagcttgtcttagtggtcgttatgtttagcaggtctcgaggatgcccttgcaacccaagatcatcgcatctagtattggaagacgaaatttgaagtggcggaactcgacagaaccatgctagccatgaagaaagagcaagccgtggaaacgctccgaggccgcgaggtgtggtttgcgtcatatttaaagaattgctatacctcaatggcccgggtatgcagggagcttcgagtagtccgcggcgatcctgaggaatcggcggccgggtatatctcgtggctcaacggggcctgtccccaactcgatggcatcggcaagcgtattgacgaagccttgaagcaaaagtgtcatcgagcgagccgatatgccggaggacatgtactagcttgcctgcgagatcaccgcccgcgcctggatcttgaattcctccatgaagggttgcttgttctcggaggactccgacggagatagaccaccttgcgaggtcgatgtcgccattagccgagaaggtattccagtctatgaactggcattggccctcttggtagtactcgtggcctgttacagatgtcttaggaaaaagtgtaatgtagtgggagatttatgtaaaaaaacagtaagaattattatgtgaataaagaaatctatctttaacaaatgttttcttactctggatgttgtgtgtgtaagagtgtgttctcagttaacgactttagttagccgtttgagtcgtacactctccctagcccccagccttgtcgtaggagggatttcctcgggtgacaaggctcctggacccttggcccgtcttggttgaataagctctgatcctagcccccagccgtgaagttggaaagcttggtttccgattacacggcttggttaatacgcacggcgagaactcttacacgaccagatcttacatggtctttcgtctctaaaggatctgacaaggccttatcggctctgggcgtccctagccgaagatcccttaggttcctcggaggccttgtcgagacggcgtaaagggacataaggacaggtttcaacgctaggcgtcgtcagagtaaggggtcattgggtgaaaacactttggtcgtgatatgagacctaggaataggctttattgatactgtaagggtgcttacaggtatagcggtattgactcatacatagaatttacgtagttggtcaatgttccacgaatttgctagttcgcgaacgtcgccgtcagcgattttgaatgcgcctggccgcaagacttgtgtgatcgtgtagggtccttcccattttagtgagagtttgtttcgccccgcttgggtttgaactcgtctaaggacgtagtcgccgatcgaaagtatgcgtgctcggatgcgcttctcatgataacggcggagggcctgttgatagctagctgctcggatggcaactcgctcacgatgctcctcgagaaggtttagatcgatctctcgctgattctcctggttctcgtcggaatgcttctgtactcgtgtgctttgatgccgtaactcgtcggggagcatggcttcagaattgtacacgaggaagaagggtgtttccttattggatgttgtcggtgtagtgcgcacggcccatagtactgatgggagttcttcaacccattttttgtcgtgtgacatgagtctgtcgtagacgtgggtttttatcccttgtagtactatgtcgttcgccctttcgacttgtccattgctttgagggtgagagaccgaggcgaaacatatttggactcccaagccgatgcagtaatcctggaaatcggcgctgatgaattgagagccgttgtgggttatgatgcggtgcggtagtccgtatctgcaaaatatccctctgatgaacttgatagcattatcggccttgatttccccgggggtactgcttcgatccacttggtgaacttgccgatcgccacaaataggaatctgtagccgccctgtcctca

SEQ ID NO: 50547 - DNA, 5819 bp, Oryza sativa
tctgtatcgtcctcgggtaactcctcactgctgatgaatttgattaatgggctgcgccagtcgtctgtagtttcgatgtcagcaacggcgtgttctgcctcggttacctccgagctgatgtcgggggtgttcgggccaacttcgccgcttacttctttcaccgatggcttcgtcaggacgtcgagaaaggtgccgggctcgagcagctctcgtctggatgcgcgtcgtgctaggtcgtctggctcgacgttgtccttgctatagacgtgccgacctcgatcccattgaacctcctctctagcttcctgacttctgagagatacttggataactcggggttggagcatttgtagtctttgtgcacctggtttgcgattagcttagagtcccctttgacgattagtcgcttggccccaagtgcggctgcagctcgtatcccggcgagtagtccttcgtattctgtagtgttattggttgccctgaagttgaggtgaattgcgtgcttgaattgatctccggagggagatgttaagataaatcctgcccctgctccttggctgttgagtgcgccatcgaacgccattgtccatgtctcattgtcgccttggttatctgacttattatttggcatggtccaatcggccatgaagtcggcgagtacctgagatttgatggctgttcgcggcacaaagtggatatcaaactggcttagctcgactacccatttagcgatgcggccgacaacttctttgtttctcacaacttcgccaagtgggaaggaggagacaactgtgactctgtgggcttgaaagtagtggcgtagcttccttgatgtcatgatgactgcgtagagcagtttttgaatctgtggatatcttgtctttgcgtcatggagagcttcgctgaagtaataaactagtcgctgtactttctctctctcgacgacaatgacggtgctaacggaatatggcgtggcggcaatataaaggaataattcttcattaggttggggagcaacgaatacaggggggtttgataggtagcgcttgagtgcaataaatgcctcttcggcttcctgtgtccatacaaatttgtcttgtttcttcaacaaggcgaagaaaggcctgtccttgttctcccatcctagcgacgaatctgcttaatgctgccatgcatccggttagcttctgcacctccttgagtcttgtgggcttggcatcgggtcgcaccattagtttgtgctcaatcacctccctggggacccccggcatgtcggacggctgccaagcgaacacgtcggcattatcgcggaggaaggtgatgagcgcgagttcctatttctcatctagtgtagccccgattttgacagtcttgtcgaggttagcactagagagtggaacgatcttgatggcgccatctggcttcggcgtcttgtttagcttgctcactttcttgggtggctcaaacgtggtgggtggggtgggcgtttgctcgaccatgtcgaggctccgcttgtcgcactgcaccgccagctttgcgttcccctgaatagtgattgttcccttcggtcctggcatcttgagcacttgatatgcgtagtgtgatgcggccattaacttcgcaagtgcagttctcccgatgatggcgttataagctgtatcgaattcagtgacatcgaaggtgatatgctctgttcggaagttgttggcttggccgaaggtcacgggcaatgtgatcttgcccaaaggtctggatgatgattggggagtaattccatggaagggttgatcagttggtgttaactcactttgcggaattcccattgcatccagagtgctggcgaagaggagattgatcgagctgccaccgttgatgagaactcgtgctaccttgacgtttagaatagtgggctcgaccacgatcggatatcatcctgggataacagaggttttggggtggtcctcctccgagaactctattctctgctcagaccacttcatcttgggtgcagccccctgccacgtcgaacagacttcacgttccactttcttgtattctcgcttggaggagtacgttgtggagccgccgaagatgtgtgagacgtggaggtcggagtccgggtacgcagagtctgattcgtgaggaggtgtctcctcattcttctcgacaacgcatactcgcttgcccttttcaaacgccatgtgcttctcgagcgactttttgaaaacaaggcaatcctccagagaatgtctgtccgttttgtgtatggggcaccatgatttctttgtatcgctgccctgtgggtctgggcgcttgggagggttcgcgtactcagctgcgaggacttccgcttgagctttccttttcccgtttttgcgatttttcttcttgcttgactcagatgcgtctacggctggtttcttctctcccccggtcttcggcttgttgttcttgcgtcttagcgcgtcatccacgtgggcgcaccgctcaacgatctcgaataatcttcgagtagttgtgatgcgtcttgttgccaactcctgggtagtgtagcgatctctgacaccggacttgaaggcacgaattacaaaagcgtcggtaatctcaggaatagtgtttctgcactcattaaagcgccgaacgtattccctcaatgattcccccgagttctgtgttaacgtgtgtaagtcgtcttcgatcgcgtggcgcttgtatgttccttggaaattggcgacgaactgttgccacaggtctatccacgaggagattgagtagggaggaagatgcatcagccatgaacgtgcagaacccttcaacgcagttggtaaatagttcgccaacgcgttgtcatctgctccggcagcataaagcactgtcgagtagacttgaaggaattcttccgggtcggtgctcccatcatacttttcaatggccccgggtcgcaatctctcaggccatcggacatcacgtagggaacgaccgaaagccctacacccagcactgggggcggtgggttgccggcggtcgcgtgaccttcgtggatgtctgtctgatgatgaagaggacacggatgatgacgatgacgatgggtcggttggctccggcgtacgattacgaggatgacgacctggatcccgggaatcttgtcgttgtctctcgctgttatctcggcgccgatctccttcgtcgtcgtcgttgcggcgatggccatgaccagtattgtctggcccccgccgttcgcgatcgttgcattctcggtcctcgttttggcggtctcctcgatcatggtgccgtgaagaaacatgacgccgagagcgatttgcgtcgtcccgtgtgcgccgtgcttctcggcgaccgttaatttgatctcgaagatcgccagtgccacgaggtggaggggtagcctgtcgaggcgattccctccgctccggatcttcaccattggggttgccgattggtggctgatcttggtgtgctgcggtagcgacctcttcgaacgcattgctgaggttggtcaccgactcccgtaattgttctgtccaacgctcgaggtcgtcattcagaacgggatcgtaaggagtttccctcagtatagcttgaatagccctgatgtgctaggctggagtagtcgattgattcgccgcttctgcgttggcttgcgctgacgtgccaacgtcatcgataactagtacctcccgcggcgcacttgttgtcgatgacccgtagtcttcgaggagatgtaagaccgatggttcgtgaggatcgagatcgattaccccaacgaatcgatctgaggctggagtcgctccctgttccttgccgttatccctggcggggacgtatgacttaggagacggggctttcatggcgccgaggagaactttacagctcgagagatcgtgattctttgtcttgtggataggacaatagacatcccgagttggagaaatacgttgaattccacgttctttgcaggcgcgaatttcagcacggacgttgatgaatacccagcaatcttgaagggtatgtttcttggttttgtggataggacaccaagacctgatagcttcagaagtcatctttgtcggcccgtgatttacgtcggagggacaagacttggccgcatcagaatccttcccaagtttggatgtagtcggtaatccgttctccgtttcaacgggtggatttttcgacatggagccgtcttggtttgtagccactgcgttctagttttcagtcattggaggaccggttgagatcggcatcgtggtgtaaaccgggaagacgatttcgcccacttgagtccataccagcatcgttgaagtcgagagtgcttggctggagctggtgttgacgttgttgtcgacgaagcttgatggcatagtagtagaaccttgagtaccaagtgcccctacctggcgcgccactgtcgacgggtgatacccgtagaccggatatagagggtattggggtacgctggtacaaggatctacgtagtacgacatcgagcaatcaaaagacaagaattatactggttcaggccccttgacaggtaatagccctaatccagttgatatggtattatacggtggaaaacacagcttacaaaggaaaagatggaacttgtcagatccggcgaggttgtaatcgagttgattcgactagctctcgacgacttgtctcttcgcaggctccggcttcgtaggttatgttggttgtgttggctctgagattcgatcccttatgccctccccggggggtcccttttataccatatgtctgatgctctccaagtaggactcgaacacaccagacctagcacgatacgtaggtaacccagttcttgtccgagaaggattcttcccatctgttaatttcgtgaaaagtttccttagattatgaaggaaatgttcgcgtacgcgtgggtatgccatgtcgatacgtaacgtatatcgaagggtagagagtttgccagacccataaccctgacttttatattataagtcgttttgattttttttctattcaaaaatttttacattttacttaatatatataaaaaatagcaacatctataataccaaattagtttaattaaatataacattaaatatattttcatatttattttgtgttttaaaaacctaggtcaaacttaaaaagtttcactagaaaaaaaaattcaaacgatttatataatacgaaaccgagaaaaattcaaacgacttatataatacgaaaccgggagaatatattattcaaagctaccggaaaattgaaaggacaaaaaaaaataacgtcaaaccaaaaccaaaaatagccccaaaatcttccacgcctgggcagaaacaggcgaaaaaacttctgacgcggcgggtcagaagtccagaaaccagcagtccacagcaccaccgcagcagcagcacgtactcctacaacaaagtactagcagtggtgcgtcgtacctccacgcgtcgctctctatcccccactcccgccgagattcccctcgccggccgcctcactctctcttctctcactgccacgtgggccccaccccatccgcaccaccgctcgcggcgcatccacccgcaaatcggcggcggcgacgaaggcgagcgactgactccagtagtaataaaggcgaacggctacagcgcccatccagctccctcccactgcacggcgcgcggcagggagccgcacgcgtaaacaaaccaaccataccagcccaactgatttttctgtaaaaaaaaaaggggagaggagaaaaaaaaaagggaaagcgaaaaaaagcgaggtcccccttcccctctcct

SEQ ID NO: 50548 - DNA, 3450 bp, Oryza sativa
gggcggcgatgtcggacgcgtcgtcggatctcggcggcgcgcggcccggggccgtggagcgcgacatcgagcaggtgagccgtttcccgatcctccgcttagctcggcttgggaatgccgaggaaatcccggctgtcggtgtgttcctcgtttcggggccgcgcgtggcggggaaggcgtttctggatggtagatgcatttgctttgcgtttgtgcgttttcgtgcggttgctgaattctgctaccgcagcagtagctttgcgtgtcccccgctgtgaaaccaaaattttggggagtctggagcctcggttttgctgctgcctgcaagtagggttctgtggtggaagccgatttaattactgttatttgccctcttgggttggataattccagagacattgatttggctacagtgattgtgtttgctaactttttttttggggaaggccaatcgaattgggctgtttgctggttgttactactttgctctcgtgcaggttgtatgattgagttgggagtggtatgctataacggtttcccaaccttcttttgctgttggttaatgctgcgtgcggtaattgattgagttgagctatactgctatattagttatgtcctattgctttgaggggaagtgccagtgtgttaattggatcaatacacgtcttctctgcagtaatttctgacagatactttctccttgaatgaacttgtaaaattctttgcccatttttttgagtttccattttgttctctctgtgctcacatggcacaatgaataattttaatgaagttctgagttatggtttacctcaaagagaatagcctatatgtgctacccttctaggagaatcccttatttcgaaagatgataattgtttcagagattattgatgagacctttgcatttgctgtaacatgtagcatttcatctcttgtgcattagggagtttgctttagtaattcacttctccatgtaatagctggaacgctattttcatcatctccagtattaaccgattagtttatagtgctatacataatataatgttcatttccagctctgaagtagtttcaaattgtctgaaagaacatgtcgatggccaattagaatgcatgtgattgttccattgtatttaatgcctctcctttgtggcatctaaaatcagagttatttcttgacctagttttattattttactaggatagtagtgtgatactaactactgatgctcgatacaacattccactgtttctcaggccatcactgctctcaagaaaggagcatacttgctgaagtacgggcgcagagggaagccaaaattttgcccatttaggctttccaatgtgagttttgtttgcattttctctcactgagttgtaaagccctctttgtttacccttcagatttatggacattcatggtgtttttgttcattcaggatgaatctatattgatatggttttccgggaaagaggaaaaacagctgaggttgagtcatgtgtccagaataattcctggacaacgaacggtgagttaccatttctggaaaacttcaaatttcaggaatatagatttctctaagtctaattggccattgtgatcaaatctcatatcatatctggtaaaacaacagtgtatttcttttgcttgtttgttttggcgttaactccttatgaatacatctgtgggtgtctcttcagcttttaccctaacataattctccctccttaagaggagtttcgttgcattcttactgacaactgacaagaacttttacagttcaaatttctgatatctactactgatacaacttatgccattaggagatagctgtaatcattagtcttgcccccataacaacaaattacataccacttcaaactgatgcaacttctgatggttcatttatgattctcttttgccactgcctccagaaaaggagctacatatggcagttacaaattgatctgtcccatcatgttgtttttttttttttacattcgctttctgatggaaaacgattcacaagggagtattcaactatatttaaggtctgtaactctcccctaacaatgtctgtttctcttttgccaatgcaggcaatttttcagaggtatccacgaccagaaaaggaatgccagtcattttctctcatatctcatgatagatcattggacattgtaagttatatactgttcattttatatgtgctgtttatcttcttggttcgatttccatttttgatgcacactaaacccctttcctcggtagcaaattgattttgtttggtgatgtggttttatcatgatatcagatatgcaaggataaagatgaagccgaagtgtggtttgctgggctaaaaaccctcataacacgtagtcatcaaaggaaatggagaacagaatcgagaagtgatatgctttcctctggtacaactagtcccagaacttacacaagacgaagctccccattgagttctcctttcagcagcaatgacagtgtccacaaggtatttcccactacccacccagctcatcccactatgccactatattgtgtgttcgtcacctatacagaactacccaatctcttcctgttttgtatgttccatcttttttcttttccattttttggttttggcctgctgctttaagatctgaacaacatggcaaaagtcttatgtcgtacctaggctgttctctttgttctgtatggtctgtacaatctcattacatagatatttatcgctttgcagcaccacaataagaattgtatcttactgaccatgttttattttattcttctgtctacttcaattaatataacaaacatcttgataattgtcctgcaacaggatggtgttgaaaattaccgacttcgtagtccatttgggagcccaccaaaggtcggtctggagaaggcattttctgacattgtgtcatatgcagccccacccaagcccttcttcccatcggattctaatgccggttctgtccattccgtgtcttctgggcagtcagataacacaaatttacactcaaggggcatcccaatggatgctttccgtgttagtttatccagtgctgttagttcatcaagtcatggttctggtcatgatgatggtgatgccctaggtgatgttttcatatggggagaggggactggggaggggattcttggtggtggcaattcgagagttgggaactcctcaggtgtaaacatggattgtcttataccaaagccattggaatttgctgtaaaacttgatgtacagaacatttcttgtgggggaaggcatgccacacttgttaccaagcagggagagatctactcttggggtgaggaatcaggcggacgtcttggtcatggtgtagattgtgatgtgccccagccaaagcttattgatgctcttgctaatatgaacattgagctagtagcatgtggtg

SEQ ID NO: 50549 - DNA, 4560 bp, Oryza sativa
tgtcccaacatgtgtagctgctttggtcgagcctaacttgtgtcaaatagcttgtggtcactgtatgacggtggcgctgactacctctgggcatgtatatacaatgggaagtcctgtctatggccagcttggaaatccacaagcagatggcatgcttcctgtgcgtgttgaagggaagctacataaaaactttgtggaggagatctcatgtggtgcttatcatgtcgctgtcttgacttcaaggactgaggtgtacacatggggtaaaggtgcgaatggtcggttaggacatggagatacggacgataggagttctcctactttggttgaagctctgaaagataagcaagtcagaactgttgtttgcgggattaacttcactgcagcaatatgcattcacaagtgggtttctggagttgatcagtccatgtgttctgggtgtcggttgccatttaatctaaggagaaaacgtcataattgctacaattgtgcacttgtattttgtcatgcctgcagcagtaagaaatctctgaaagcttcattagcaccaaacccaaacaagccttatcgcgtatgtgatagctgctacagcaagctgaataagggtcctgagacagatagatattcttcagcaaagcggggatctgttatacaggggttcaatgattctgttgacgaggagttggagacaaaatcaaatgcccagttgtcgagattgtcatcattggaatccttcaagcacatggatagcagaacttcgaagaaaaacaagaagtttgagttcaatagcagtcgtgtttcccctattccaaatggcagttctcattggagtgggctcaacatctcaaaatcctttggttcatcaaagaaatttttttcagcatcagttcctggatctagaattgtttcaagggcaacatcacctgtttcaagaagagcaagccctcctcgatccacaactccaacacctactttgggtggtctaacctctcctagagtggtggatggtgtgaagccaaatgatagcataagccaagaggttctaagtttgaggtctcaggtacatatcttactatattctttatccagttacctttctaatttgtattctccttcagtaaattgtaggcatgtaacttaattgaatattgagcatcatttgttaatctttggacacctgaatggaaatcaaaatatcttgtgcgaacatggcaaatttgctggtttttgtatgcagtcctgtttttcttctgattttattaatcttattaccttgtgagttgtgactattcatggacgcgaaccatctatctttttgggacccactagttgtttttcacctacttaatattttgactgccttattcaagcattggaaagatagatcattaaactccccatttgtttaaggtgagatcatgctcaacaatgcattctctaacaatcttaatatctcaggtggaaaatcttactcgcaagtctcagctactggaagctgatttggagagaacaactaaacagttgaaggaagctatttcaattgcaggggaggaaactgcgaagtgcaaagctgcaaaggaagttatcaaatcattaactgcacaggtaagattgctatacttcaagtaggatgtctactgtacagacattagtaaactaacaaagtaaaaaactgcaagtatgtgtaaacggatccccttgattaaaactgaatggctcaaaagtcaaaaccaagggaactgtggattggtcaaaggcagcatggtgccttctaactggccctgatgagtacaacttttctaggtttcgagtctatgactactaaatgtgcatgcattacttttgatagaagacagtctgctgctttagtggagttggaaagtggaaaactaaaaatgacattatttggatcttaactttgtatttaagaaactaagaatgcatgatcatcttcaaattcaaataatgattttgtacaatatgttgaatattttcactaacaattctttgttcgtgtaatagttgaagggcatggcagagaagctacctgaaggagcaggactggtgaagaacagcagactgccaccgctgccaggaatttctattccaactgatatatcagttgcatctgagagtttgggtagcccaagaagttctggagaaccctgttcaaacggttctaatggtttgcttgtttccaatggaccaacttcagttagaaataagttgagtcaccctgaaattcccaagaatggaacaaggctacccgattcagattctaagcatgaatctgaatgggtagagcaagatgaaccaggggtgtatatcactcttactgccctacctggagggactcgagatctcaagagggtccggttcaggtacacaccaaccacacagaggcaaaatatatagtcattagtcagcaaaaatcttgtctatcaatcttgaacatagtacattattcgtttggcgagtagtctatgagactagatctaacaagcaatgacagcaattgagtgattgacacttttgggcattccatttatttggcttactatatagtataatcaacttattttttgcttgtcctatatagatatttggggttttaagtgtttactctttttttatggagagaacaacatgaagtgggcagtagcctctagttgagaggatcttgatacacaaaaccactattaacttactctatatatgtgcagatcaagaatgcaatgaatattacaataatttgataataactattgacaacagacctgtctaaatagaaccttcaacttgcaaaaccagatcatgtgaccgcctcaaatcaatcctgtcctgtttgagttgatgtagcaccctgtccacgacacagagccatccaactcgatttgacttgatttagcatctagcattgagtagatataggtaacagcattcagtgaggtttaggtaaataaaatgccttgcctgatttttctgccctccttggcattattgtgttctcccacttccacaagccatgtcatggatgcagtagagacctcgtcccatctgctccttgatgatagtccaggatgtagagttgtggggacgattttgggggtgaagatgttggaatgggatgctagtgggtgccttgcagggatgtgagaagggcacaccagcatttcagatccttcgggggcaagtaggtgattgttggagatggtggaggagattgttggtggtgatggtgcaggaatttgagattatgcccaccatttctggagacaggtaaaaggtaggctggagtggctgtccagatcatgctgggcttgggtatgtaagcgagagagttggaaaaggagaggacacatgggctcactgaggtatacttaaaattggtgccacaccaagtgataaccaggttggatattcctgggggtcaaaaatgttctggctatatgagttgaagatttctactttagactgttatggagctgtgttcgacttttcacactcactaattctgttatggcgcatactcactaattctatgttctgaatgcagccggaagcgtttcagcgagacacaagcagaacaatggtggcaagagaatcgggcacgggtatacgagcagtataatgttcgagtagtcgacaaatcggttggcagtattgataatgatgtacatcattgacataagaaatttgacttggtcagtcactacaaagctctcaaagctctcaccgttgagcatgggtgctgacgcggctatgatattttggttaggcccagaagaggaggggcctgctgtttgaaaaatgtgggcttgcattctttttacacgattctttcctcttccatttcccttgtgtggaatgtagagtgttcaagcagaagttatgtaaatggttagtggcagctggctaatctgtcctgtaaatgcataagcaagtgcatcaattttagactatgatcttcctgattttcctttaattggcaaatataggtgcaaaatctaagtgatgatgatgaagaatatttggtgctaattgtagattgagatgcaaagtagctttgaaagatttaagctttgttctggctgacttgagtgcctgttttggcgaaaatttcatgccaattactctgctcccccagattgaacgtcatttgtcgaacttacatggtctggatgaggtatgttttctccgtttatgcaaaattctgtactaatcattattaccccgggattcttaatagtgcgtattttatttagcaaaagttttcagatcacgctttgaacatttatctcgtaaactatacaaccaatatttttgagtacattaaaatatgaatatattagtgtaaattttatatattaattgtaacttatactagttcaaagttgaaaaaggtgaattcaagatacacctaatgaaaatgtataggggaagttatccttctgaggctaaattgcatgaatggtaaacaaacttacatagtaggtgcaaataggcacaataacttgtaacttactttttttttttgctggaatgattgaaggaggtcct

SEQ ID NO: 50550 - DNA, 6480 bp, Oryza sativa
aaaaacgacaccctcatgagggtcgccacgccaaatgacgccgtcgtcatccatccaaagactgaacaaggttttcacccagagctccttgctaagggaggaggggtacctcaacagtaccctcaggagagttatcatgctcaaaatagtagtcactgttggcccaaagaaaccttgggctaagatttcgctcggaacccctacaaccctaccgtcgtggtccgtcgcccaatccgaaaccaccatccaaacatcggtggcacatggcctccaacacacccgaccgacgcccctccgccagccggcttccagtcctgccaacgacaagactgccacaacaccagtcaccttggccagcgcgctgacccaggccgctttcaccacgctgcctgccggcttccccgttgaatccgacctatgggagcccgcacaaggaacaacattgcctcggcaatctgagttttccttgttgaccgaccaccgcctccagcctgccaagaagctctccacaaagaaggggaggagttccctagcagggttagcctggccaaccacaaggaagacgacctgccaccactccctagcgcgctgacccaggccgcctttgccacgctgctcgccggcctccacgttgaatccgatctatgggaccggatcgggaacctagccttggcaacctgagtcttccctgtaggccggccatcgcctccatcgtgcctaaaagctccccacaaagaaggggaggagcttcccaaacacagtggtagcctggccaaccacaaggaagacgaccccgtcgccaagctcaccggcggcctcgctgatgcctccgcaccgctgccacctcgaagctcaccaacagccacccgggccacccagcatcaccggtcgggccaccgctgctctggctttcgcgccaccagcccgagcagtgccggcctccgcgccacccgccgcgcctccaccacgccagccgctcctgcgtcggcctctacaccgccggccgcgcctccacaccacactagcagctgtcaccgccgcccacggcgccctattgcgccggccgccggatctggtggctccgctcgaggccgttgcggccgaagccgcccactccacgccgacgcaacctcagccccgccgccggtcggccgcttcgtccagccccgccgccaatgccaccacctacacgcagtcgtcgtcgccaatctccacgcagccgtcgccgaccctgctctccgccgcccagagcaacagatccgagcatggggagactagatccgtgcatgccagcgccggatttggacaccgccggtggcttttccacagtgagcgtcggcgccttgccctgagctccgtctcgccggcgccctgaccaccttgacgtgagcgagagagagaaagccctgtaaattacttatttcgaaaacaacttgtttattatgtgcaaactaggctaaatagtccaatcaaaatgatgtgccctgtaaattactcatttcgaaccaacttgtttattatgtgcaaacttggctaaatggtccatacaatcaaatgatatgacgttgacatggatgccatggaaagccagtatagtttggccacaattttcttcatttttcaaaacagaaaaaccatttggcattgagagctaactcgatgctgaactcatcatcattatcaggacttaaatgttatgtaggttacatggtagatattttagcataaatattttttttaccacaaataagaccaagaaactactgagatcacaccatgagaaccaaattacatttttttaaagagaaaaacctaaacttaagagtgatggaacatcgaattctcaatatataaatcacaacaccaatataattcgtggcatgaagcaatcactaaattagagtctacgagctttagaggtctcaaactcaagccattcgactggcagcaagatttaccacgataaacgtagcactgcagtactgctccaatcattttgatgctgattcgtacgagcaagcacacagtagatgtatacactcatatatacacgactagctaggtgaaactcccacgtggccatgtgttgctacgggcactttaggtaacaatcaggatgaaatgttttttttatagaaactagcatggtgggcccgcgcagattgcgtgtctacatcattatctttttttcctcacatactaaaatatatattttcacattttattattaaaatatattaaaagtgacaataaattttgtactaacttgaccaaactgatcaatattcatattgtagtgtatatatatgtgatagttatttaataatttttaaatttttaaatttcgttatttctaaattgtattcttatatgtactctagacttcttttttcagtattctttatttttgtcgagctaactagttgggtggcccgcgcaattgcacggctagcacctaaacaaaatcatatatttttttaagtatggttttacttaaaatttattaaatagctatctcaatgtcttaaaactttgaaagaacaaaacttatcatccccgtgtttctaattatataattttttaaaagtcgcaccagttgctaccccttgtgtcatctctttcattatttgcttgctcgatctaccactatttctatttattctccttgtaacctttaaaaattggaccttatagtttttagagtttattgtcacgttgggtttcgtttttataatttctaggcgtcccgtcaaacgttgccattatactcctctatggcccgtccactgtctcttctctttattgtcattgagattttaaaaatcgaacataattatcgtttggattcatttttactttttagaagtcccgccaaaccgtcagcggttttgccattgtacttctctatggctcgcccgctgtctcccttctttattgtcattgagattttaaaatcgaacatgattatcattgttttatttttactttttagaagttccgaacctttaaaaattggaccttctagtttttagagtttattatctcgtcaaatgatgccactatgctcctctacggctcgtccgccgcctactctttattgtcattgtgattctaaaaatcaaacataactatcgttggaattatttttttattttctaaaagtctcgtcaaccgtcggcggctctgcaactacactcctatacaccacgcccactgcttctcctttttattgttattgagattttaaaaatcgaatatgattatcaatgggatttatttttttttgctcatttgcttcatggcctgcctgccgtccctcttttaatcgtcattacgattctattatgtgttttattaacagtttttatatgtcgtatcaactatcatcgggcatgttacttaatttatctcgtcatgtgttttagatggtcttttctttcaatatttttttatcacaaattttagctatttataaattgtattcctaattgaaatcttatttttctttttctaatttcagaatttagttttttttaaaaaaaattaattcatatcttattgtgttctttaaatatttttattttttattttcaatttcagttgtttcaaaactgtattcctacttgaactctcttttagtttttctaattttggacattattttattttttattctgagttttaattaatctcgtattgggttcttatatggattattctttcaatattgcttatttttaattccgaatttcagctaattttaaattgtatttctagttgaactcttatttcagttgtttcaaaattttatttctacttgaactctcttttatttttttctaattttggatattattttatttttattctgaattttaattaatctcatattgggttgttatatggattcttctttcaatattgcttatttttaattccgaattttagctaattttaaattgtattcctagttgaacttttttttttgctaattttggattttatttttatttttattcccaattttaattaatctcgtattgggttcttatatagacccttcttttagtattccttatttttaattccgaattttagctattttaaaattgtattcctacttggactatccttttcttttctaattttggattttattttatttttattttgaattttgattcatctcgtattgggttcttatatggaaacttctttcaatattgcttatttttaattccgaatttcagctatttttagattgtatttctatttggactctccttttctttttctccgattaatgtgggaatttctaacccccacagcgaatgtgatgccttctttcaaagctgttttaataatataactagctgggtggcccacgcaattgcgcggctagcacccatataaaattatatatttttaatatgattttacttcaaatttattaaatagttatctcgttgtcttaagatttttaaatactaaaccttattatcctcatgtttctaatttctttagtttctaaagttacaacagttgctaccccttacttctgtcatattattatttatttgcttgctcgatctaccactgttttctattcattctccttggaatctttaaaaattggatctaaaaactataagttttagagtttattatcctgttggacatcttttttataatttctagaagtcccgtcaaacactgtcattatactcatccatgaccgtccactgcatcttctcttttttgtcattgctattttaaaaatcgaacataattgtcatttaggtttatttttttttactttctagaagttccgccaaaacgtcagcgactttgtcactgtactcctctacggctcacctgctgtcgcccttctttattgtcattgagattttaaaatcaaacaggattatcattgcggtttattttttttactttttagaagcccaaacctttaaaaattggagtttattgtcttgttgggttttattttcttttataatttttagaaatcccgtcaaacgctgccactatactcctctatgacccgtccgccgcatactttttgttgtcattaggatttgtaaagtcaaacataactatcattggaattcatttttttttttactttctagaagacccaccaaccatcggcgactttgccattgtacccctatacgacccacctgctgcctctcatttttattattattaagattttaaaaatcaaatatgattatcattgggtttatttttttttactttctagaagtcctgctaaccgcctaaccgattgcttcacgacttgcccgtttgtaattctttttagtcgtcattaggattctattttgtgttttattaatagtttttagatgtctttattaatagtttttagatgtcccatcaaccaccaccaatatactcctttataggcatgttacttaattaatctcgtcatgtgtttcagatggtcttttttttagtaatcattattttttatctttgacaaaatatctggtgttggatgaccttgggaggttgacggtgataggatatgcaaaataacatctctatacacatgggtttatcttggaggggggggggggggagggggatatcaaaccatggtcatattaatgtagcgtggaagcctataagatatatatgctggtgctaagtcactcgatatggattagacgtaaatgaaaccctagtttgtattaatagtatatatgaacattttttgtaagttgttacaactatttgcacctatcatatataacatatatgcaatttactctacctttgaccttgatattttgcactgaatttaacagagttgcgtgatgtcaaattgttcactaatttacgcgcatccaacataataaaaaacaaaaaataataataataaacgaattaactgcccaccagatgtttttgaacacatcacgagatagtcacccttccaaaatacacacggcagcagacgaacaagaccccaacaacacgccacgaaacgcaagcaatagatttgtccgatggttaggtccaaccgccgcgacacacacaacgttcagttaggttccagtagctcacaggtcgcaacgcccctcacccaaacaacgattttgcccttactcttagcttaactcttacacccaatactgatgactagctacttgctccaatcttattagcagctaatggttttttctccggcccccaatttcatcatcaccaattcaccaagtaattaatcttcacactaaaccgagtcttctttttctctctctctctctcacaatctcagtagtaagagccagcctctgttctagaaaccgtgcgtgcatcacagacaaagctgtgcatggtgtgtcgtgacgagcatgcgtgagtgcgttacacgctcaagaaaagtgtgttagcttagcttagctagccaaccatgcatatattcgtcacgtt

SEQ ID NO: 50551 - DNA, 930 bp, Oryza sativa
ttcctactttaactctctttttaatttatttaattttttatttccaattatagttaatctactattgggttcttatatggactctaattttaatattgcttatatttaattccgagttttagttaattttaaattatattcctacttgaactcttcttttcttttcttttttctaatttcgattttttttgtttttttatttcgaattttaattaatctcgtattggattcttatatggactcttctttcaatattttttatttttaattccgaatttctgctatttttaaattgtaatcctacttggactcttttttttgggtaatttcagattttattttatttttattccgaattttgattaatctcgtattgggttcctatatggactcttctttcaatatttcttatttttaattccgagtttcagctatttttagattatatttctacttagactcttttttttgctaatttcggattttattttatttttattccgaattttgattaatctcgtattgcgttcctatatgatctcttctttcaatattgcttacttttaattcggaatttcagctattcttatattgtatttctacttagactcttctttttttttctccaattaatgaggggaatttttagcccccacagcgaacgtaaaaatcaaatatgattatcgctgggttttttttttttactttctagaagtcctgctaaacgccttgaccgattgcttcacgacttgcccgtttgtaattctttttagtcgtcattaggattctattttgtgttttattaatagtttttagatgtcctttattaatagtttttagatgtcccatcacccaccaccaatatactcctttataggcatgtaacttaattaatctcgtcatgtgttgcagatggtcttttttttagta

SEQ ID NO: 50552 - DNA, 1766 bp, Oryza sativa
cgcatcgccacccttttaccttttcaacttttgttttttacgttccggcggaacttggcacccgacgcggggatgcatcgtcttcgatctccggcgaagggataagtccaatgttcaaggctgcatcagtacattcgacctcttggattgctctggtttggatgatatatttgcctacctatttatcatatgtctctattaatctagtcttagcatatcaatttagctctatcggctgcttctcgttttagggtttctaccggtatcggctaaatcgcgttgctagattagattagcttaggcatctaccaccctgaaaatcagtcatcggcttgattgtctagatattatgtttcttttcatacttagtgctgcatcagttaagttttatctactaagtcgtgcttagaaccataatctctagcctgcttattgattgccaataagggtttcatcggggtttcagtcggtgagttatctggacgttgcatcggctcatgaggattgcatatacatataagttggatttagccgatgacaacaaaggtttcattgtttaatctaatcttgtggatttcatgacatcggacctccagccgatgtgtgctttaaccttcggatcgatgcttatttatcatatcattgctagccgattggtttatattggattatattgttattttattacatcatcatcagccgattgcctttatatcattatctacattggacatatagccgatcgcttaaaccctatcgctatcggctggtatcggcatcggctgttatcggctatcggctggaactactccatcggcttgtcagccaatcggctgttttgatctactatttgcatatcttgtcagttgcagaatcaaactgactggcacgcccgcatctcatcatattcggacctgcactggagctaagcagatctcccaggccggtgtgtttgattttttttcgtcaacacagattggcacgcctagtgggaccatgaattttatatccacatgtctgaagaagaagtcaatgccaagatcattcaatctcggctcggggggcaagcacatcagtatcagctcatgaaagccgattacaagatcagacagaagagaattttggagcatgagtcctcatactccaaaactggggggcatgtgttaacagtgaaatttcgtaatcggcaaagatgtcatctgcttagaatcattatcggctgcagcatcttggaatcagccgatgggagttatcaagtcgccaataatcggattcctgctatattcggttaaggaaatcaatctactaaaggaagcttatctctaagtgaccgagtttaaagaggatgcggcatggcaatttatctattaattaggaatagtttgttagtttccttttatctttaggaaagtgtgtttagtgtccgataaggactttatattttccttttatctttaggttagtttctttcttgtccgacaagcacttgtatcaacccatgggtataaatatgtacacctggagtctatgtaatctatcgctacgatcaatacaattcggcgcatcgcccccttttaccttttctactttttgttttttacgttctggcggaacttggcacccgacgcggggctgcatcgtctttcatcttcggcgaaaggataagttcaatgtttcgtcgggcccggccattgttttatctacgttggcgtcgtaaaaggttgattaatacattccacctttggaatgctctggtttggataata

SEQ ID NO: 50553 - DNA, 14541 bp, Oryza sativa
ggaaaaaaaaagcatcgatcgaagacatcgcatgcagttcatctggcgaccgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgtggaatagtggaagcattgaaggagggccgggggatggcgaccctgtctggcagatcaggtagagagcggtgcctgctcggcaagcaagcaatcaacgagagacaatagtctgcataggagtaacgaggcagagttcgaccattgtgtgattggatccaaagtccaatcttagtccggtgaattggacggctctttggggtcttcaactgcagcattatggacgcccttgtaagaagcgtccccatctggacattgtctacaacagcgtccacacctggacgccctatgcaatagcgtccttcctattttcgtaaaaattgactttgctttattatatatttaatttctgcattattaattattatgaataaaaaattcggagcaatatttaatcccaggaaaattcatttccttctttttctttttctttttcccctttttctttttcgaatgggccgccgccgtgcatcccgcaaccgccgccgccaaatcgcgcctgcgcctcccgggccacgttgcccacgtcgccgcccgcgcctgctttccccgcgaccccgtgcccactccctctctctctcccgcccgcgcccgcgccgaaacggccgatattcaattttgaatcccgccggccacgccctctctcccccttcccactactccggtgaaatcgggccgctcctggccacgtccgagccctctttcccctatttaagcatccccgctctcccctctctctttttctccatttcgccgagctctcccgtgacctctatcgccctagcgtcgtcgccctcctctccgccgccaccgccgccgctccggtagccgctagccgccgcgccgagccgcgccgagctgctgtcgggttcgcaagcccgagggccacgccgtccgcctctccgccgccgctttccgccacgggaaccccgttcgcaccgcgcgccggtgagctccgccatggccgccgccttcagctggcgtcctcgccctcttccatcttcctctctctctaacccctttcttcgtgttcgctaggtggttccgaagctcgtcccgccgtcgccatcgccctccgtcgctcaccgtcgtcaatcatcgttggtgaggcccctcctcctcttcctctctctctctctctctctctctctctctctcgccgcttagccgccacgctgccgcctagccgcttagccaccgctgtcgccgtccgcgtcgccgcgacgccgccaccctccgccgccggccggtcgccgccttgcgccaccgctacgtcgagccgcgctgccgtgcgccatggccgccaggccggtttgagccgcccgtgcgcgccggccacgcgcttccgccgccattcgatctaccctcgggtagatcggggccgtccaaccccgccgcccgcgtggctgccacgtggccgccatgtgtgcgccgcatcggcgccacgtgtgcaccacgtggtgcgccgctcctccccggtccgtggacccggtccaccgtggattttaattattgcggaataaatcaattaaggatttttctggttatagtaaaaacacagcgaatcttctaaaattcatatctaattcatccgagcttcatttaagcccattcaagtctcagtaaatcaagaaaaatgcatagaatccattaaaaatggttttgttctctgtttcagtagtcttatagcttgtttgtattgtttgctttgtatgtcgcttagattccggctctcccgacgctccggtgtactttgaaatagttgccgaggttcccccagcagcagagcaaggcaagtcatgcttgtcacttgaacatgttgatcctatattgcaaatgctctaccattttcctttaaatactgcattgttttataataatactatgagatgtttacctgctgttacagccatactacttttgtaccatgctcctttgttagcttgggatataacatgactagagattggactagggattgcttagccatgcttagtttaactagcacaccgtgggggaaatcacattaattcatagacttcaggttctagtgttggtgttggattaaagccaccgtcctggtgttagtcaattaaaatataccttatggtgggctgtgggtgcatggttttgatggtcgcgcccatggcacttaaggaccggttcgcgggaaaccctggaaaaattcctcgtacttaccacaagccagcgtgggcaacggctgggcttgtagtgtagctttcctctagttgacgcattcaggcaagggtgggcatgatggagcggggcgggcactacgacggcctctgtcgcttccgaatttacctaggcacgagaggggactgctcattgcccgctggggacgggagtgaaacctgaggtgtggtgtgcttggctagagggggttatgcgaagggtcctgtcacggcctctttttggtatgtcgtggtggtatgtcggtgcacggaaacgtgtcatggggctgtgtcttgtgggtacaattgtacacctctgatcagagtgaagctattcgaatagccgtgcccgcggttatgggcagtcaaccagattcaccgtgattagtctcaccctagtctagtctaatggaattgattaattcaggtggatggttgggcctgtcgcaatgtggtgtagcgttggacagttgatggttaatattgagtaattattacaactgttttactgctttcaactaccgtctttaaatgctcgctttatgcaaatgaaccgctcaagctgtccttcgattatatcctgcatcataccctctattccgatatgactcgctgagtacgggggttgtactcagtcttgctctattttccccaaaaccccagagttttagtacgcgtcagatggcggcttctccgaggaataggcttcgtccgtgccgtcgaggatgcctgtggagtggtgttccaactgcggtccaagtcaaggcttagctccagttatcttttaattttccgctgcatttatgtaagacttttataatgtttgtaagacgtggatctgtatgtcaactttgttgtttgtgtaccccggccggtcctggacgggggttttaatgcacattctgcttggaattctattcgggaatttctgggcgtgacactgagaaggcaagatttcacacggtcattaccactgggaacgtcagacgaaggtgggaagtcacatgtcgcactaaggggggttttggatcttctaatggggtcatcacgcatgaagttactctagggcacgaatctgataacacatgttcgtgcttttgcaataagccgaagcttcttcataagccatgtagccatgtcctggccgcgtgcgctaaaattaagcttgattcaacatcatacgtgtcgacgttctacctaaaggatagagttctgaatgcatggagtgctgagatcctcgggtggaggtccctccaacacttagtcgaaactgggggtgataaaaggatctatgtgccagacttggttttgttgaaggctggtaagggtagaagactgttaacagtgaaatttggtaatcggcaaagacgtcatcagcttagaatcattatcggctgcagcatctcggaatcagccgatgggagttatcaagtcgccaatagtcggattcctgctatattcggttaaggaaatcaatctactaaaggaagcttatctctaagtgaccgagtttaaagaggatgcggcatggcagtttatctattaattaggaatagtttgttagtttccttttatctttaggaaagtgtgtttagtgtccgataaggactttatattttccttttatctttaggttagtttctttcttgtctgacaaggacttgtatcaacccatgggtataaatatgtatacccggagtctatgtaatctatcgctacgatcaatacaattcggcgcatcgccacccttttaccttttctacttttgttttttacgttctggcggaacttggcacccgacgcggggctgcatcgtcttcgatctccggcgaagggataagtccaatgttccgtcggcccgggcaattgtctcatctacgtcggcgtcgttcaaggctgcatcagtacattcgacctcttggattgctctggtttggataatatatttgcctacctatttatcatatgtctctgttaatctagtcttagcatatcaatttagctctatcggctgcttctcgttttagggtttctgccggtatcggctaaatcgcgttgctagattagattagcttagacatctacctccctgaaaactcagtcaacagcttgattgtctagatattatgtttcctttcatacttagtgctgcatcagttaagtttgatctactaagtcgtgcttagaaccataatctctaccctgctttttgattgccaataagggtttcatcggggtttcagccgatgagttatctggacgttgcatcggctcataaggattgcatatacatataagttggatttagccgatgacaacaaaggtttcactgtttaatctaatcttgtggatttcatgacatcgggcctccagccgatgtatgctttaacctttagatcaatgcttactctatcatatcaatgctagccgattggttcatactagactatattattggtatattttattatcagtagccgattgcctatatatcattatttactaaagtgttagaatctacattggacgtatagccgattgcttaaaccctatcgctatcggctggtatcggcattggctattatcggctattggctggaactactctatcgccttgtcagccgatcggctgttttgatctactatttgcatatcttgtcagttgcaggatcaaactgactggcacgcccgcatctcaccaatctttggacctgcacaggagttaagcagatctcccaggccggcgtgttgatttttttcatcaacaaagacaaacacggcttaagaaatgatatggatgcatccaaagcgggagggcttgtgaggcgatgtgaggattgtcttcagtacgggcaccgcactagagattcctttggcaacaacgtgcgagaaggaatagaaggggctctcggggtgctcatgatagggaggaaggaaacctgcagtagttataacctacactgttcagttatttatgttcggtcatgatatgtttgctgcatgacattgtatttcaataagtttgtaatatgttagtcaataagtatgtgtaatatttatttcaataagtttgtaatatgttagtcaataagtatgtttaatatttatttgattatggtaatgttgtaagattttatcgtaaggtgttaccaagtttgtaacatttgtaaacctactgttgtactatttatttcaatgatacgtgtcgagtttgtacttgtactatgagaaaaatttattccttaatttaatgcattatatactttttcgtatgtgcacttgatgaaatttctaatttacccttcatgatgcacatgcagatatggaagaggaatggccttacccgttgcttagcaaagagatcgatgcacgacatcatgcaaagaagatatctgatggaaattcatgctctagtctagttgtcctgattccacgtacagccggatggtgggggattgatccacgatggaagccgaggtgcataaatggttaaagtttgcaacatcatgatatcgtactatagcattgcctaatgtgactaataaatttcctcataggttgtcagctgcaggtcttcttacctgcgtttagatgacgcgggcaaggatgcattacgatgctagagaacctaaacaaaaacaaatgggggcacatagcaaacgacgacaaaatatcgacaagtccctacttatggcactggttgataggtggaggccagagacacatacattccatctaccgtgcggagaaatgaccataactttgcaggatgtgtccatgctcacggggctgccactagccggccaggcaattgtacgtccggaccctccggaagattggagagatgatattgtatcatgatatgcctgtattttgccacggtacgctaccggtgatacagacgacgatgaggacaaaatatttttctctgaaaaagaaactcatggccccacattgaagtggttgtcacagtttgaggtaatttaatatttgtaattaaggcatattccgttcacattcacatatctgacaacacattgtttttttgttaggtgcgatatatgccccgacgatgtccaggagtaccaactgacgttataccttgaggcttatctactttggctatttggttgggtcatgttcaccggctcgcacgggaacactgtggacgccaggctaatcccccttgctcgccaaattgctgaaggtaatatagcgccttctgcatagtttagctggggatcagccgtccttgcagccacataccatggattctgcgacgcatgtattaagaccggacaaagggaggcgattttcacggggtgtccacttttggtcatgttgtggtcgtacgagcgcttctcgttcagacgtccatacatgagcgtggccgtggcccacaaggacgattacactgacgcagttgatgatcgtcctaccttcggtactcgctggtgctacggaccagtacgtatgcttgcattaaaggaatatttatgtcatttgaatgatattgcataactaaatctacaatctcttatcgtgcagccacagtgggcgagaatccaggtgcacaatgtgtacgagtacttcaccgaggcgttcgaaagccttagggaaaacgaagttcggtggactccgtacacgaacgaagaggctattttgcgtgcaccacatggagtaagcatcttatgttaccacgatgaagcgtactggatgacacgaaaaatgctggtgtacgacatattcgtcgaggggtataatgttcaaagggtaatgcgtcatatgggactgtaccaacaagtcccagttcctattggacttcaccttccaccagatgtaaacacgtatgttgttatttcaatcctgtctaatttctgtgcagtaaaaattttcagatataactaacagctaattgttgtatttttgttgcaggcaaaagaggcaagctgacaacaggtttcatcgatctatgcactcaaggatgaccccatggatagaggcgtggtcacaggccttgaatgatgccgtccaggagaccagggcatacgaccacaacacttacgaacaatacatggcctggtactcatcgcagactcgcatccggctacttgcacccgaggaccccgacgagcgaggtccaccaacaattgatcaaatatatgatatgcagctagcaccccccgctcacttgacggtactactagcatttaaatatttcgttgcatcggtgtgtccttatacatggggttcaactttctaacattgttgctacgctccatgcagaccgacattgcaagggagttagtaagggatgcgaagacattgtgggagaagctcagagatggaatggcgggtaccaaccaggaagttatggccccggtcgactccctgcgtagaaaaggaaagcgaatcatgcggctcgcatcgtgctgacattcctcggacgtctatactccggtaacatcaagaaggacgatcgagccaatgccggagcgtccctctacctcttcccggccgtccacctctgcccgcccttcagcctccgcgcgacgatccagtgatggttgtgcaggagtaaggtcaacttcgtttcgtgagccacccactattccgactatcccagaaatcactgacatttcggaacgtctaggaggatttggttcaactcaaggtaaaatacgttattgcagaatgctaaaataaatgccatttatattaaagactaatttattcgttcgcagcacaaccggaacgggtacccccgcatagttctacgcccatcacctctcaatggcagggtgggtttgcgtcgtttgctggtacgggatagctcatcaatatgctaattttttcccaattgtttatgtgaaatgactaaatgatgttttccaattgatgacagagggaacgcgaatggtctgtcccgtgcctcatatgcctcatgcaatgccacaaatgatttctcaaatggctcccgatgtgccaacctcacactggcaaggaggatttgcaccatttgcaggtccgtgtacattcagtaccatattggcatgcatatgtccactcgtaattttactttttgcttatattaattgcatatacagggactagccaaggtatccctaccataccccaaatgcctgctgattttatcagacaaagagggtttacgtcgttaggcggtcagtctccccttacatctaatttcatattttttttattatttcaatttattaatttttcatgtatatgaatcttattgactatttacttcctgatattaacagggcctactcagtcagttccactgcatgcacctacatatgtcaccaacccatggcaaggacaatccatggattacggtggtacgcacagccatcattctccatacacatatatcgatggcacattcatgccatacatgactcccacttcaacttaagacaataactccgtgacactttatatggatgcaaggcacgtcgtttggtggtggagtacagggttatatggacttgttgcaacaaggtgattggctatttggtcaatattcctcgcatcctcatgaaattccatatatgcaagcaccgtcaacaggtttggattttttttttttgtgttattgttgtttcctccagctttgataatttcattgatatctacattgcttctgtagggtcatttcgccctgaactaatgtcagggtttaggccttacactgcatcgtacggcgacatgtccagcttcggtggagggtcgtcatcggtacccaatgagcttcggacttcacaaactgatgatgcgccccaagtgacacagcccacacaaccagaggttggggaaggaaacgacaatgacccgcgcagatctaaccgtgagcgccatgagccaaaccgtctgtccctctcaggccctcgacatgccgcaggacaaaggaaaaaaactacaaaaaagcaaggtggaccatctaggactacgactgaccatgacgatgatgacgaaaagaagtgaacattatgtctttcagttcactggcaaccctatctgaaccttgctatgattttggcttattcttcatgttatttgtactgcaatgaacattatttattcgtactgcttattcttcatgttatgtatgatgtttcgtagttcataaatatctcatatttatatgccctattttgtagccagttaacacatatgatttttggttaactattaattttttgtacgagagctaacaaaaataatagtcccacaaactaaattaatagtgcagtgtcgatgttactcgtgcggttaaaattgcatattactttaactttttactactatgacttaaattgcccactaatttcttttcacagagatgcaacgatacgcacctaaaatggcatcctctctttccaatcacgggacatgcgccagagcatcaaatcattcacaattaaactttcaagatttcgctgcgctgcgccgaaagtgacttcgtcgctttgtaattaataaagcaaatagttatgcagcatgtgccgctgaaagtgacggtgtcgctttgcaattattgtcatcacgagtgaaacagtctcacgctattgaattgattagtgaagcattcagacgcaccgtcgtctctttccaataattgaaactgcgcagcttcttgccatcccctataaacaacaacaaaacctagcacacaactacatctcctcttcataaacgttctgctggttctaacttcgtcttgcgtattcttaggcccgatcttgaggcaggaactgagtagttgttgaacttgctctatgttgttcgttcacccactattcggttcctgtcccaagatcgagtctatgaatatacaaatgtgatttttttttactacattcttacacccactatttttttcaagttccaacatccgtttgtgaatatgacctactcctgcaaattcataaactcggtgttgcatattcttaggcccagtcttgtggcaagaactgagtagttcgttaactcgctacgtggttcttgtcacaagatcgagcctgtgaatatgcaaagttggttttctctatgaatatggcatattctaaattcctattctttgtcaactttgtaaaaattgttcccaaatgatctctctacttgtttatatatttttaataaatatatattcaatttctatttttctataggtaatatattgtttctttctctgatatcattattttcaaattccatgatatttatttttcttctcgtatccgcgtacacaatctttgcctattttcaatataaacatgtttctcatgttcatttacgtatacatatgttgcacacataataaaaaaatatgaaaaaaaatcctttctactccctccgtcctgaaaaaacgaatctagtactatgttggctttttttgggatggaggtaaaaaattatactttttactctctcagtcccgaaaaaacaaatttagtactagtttggttttttatgggatggagggagtacgtaccaacggtgacatgaactattagcgatttgcaaaacgtaattagctaatcactctggcgcgcggggagagcgatatcgctcgcggtctccctctttcaaagagcgagaccgaagccgtcactgtcgctccaggattagtagatggattaggggccgtgggccacgcagcaacggtatcgtgctttggaagagcgataccgctggcgccctcgtgcgcgggtaccgcgagaccgatcgctctcgctgatcgcaaccgcgagaccgctcgaggaccccacatgcgtcagtcgctacggtctcgcgcaacccgaccgcgagaccgcacgcgctgtcgcgcactcgaagcgcaagaccgcttcgagttccgcgtgcgtcaggcggcatcagctggaccacgctatcgctttgcgaaagcgcgacatctcctcgctctcgcgctttaggaccgcgacaccgatgagcgccaccgctttcgtgcgcacattacgcgatatcgcactatcgctgtttcaaaccgcgacgccggtatatttccgctaatccgcccctaagcagcttattcttgcaatttcggtgaagaacacgattactatcaaaattttttccaaagttgattgaaaacttggatcatcatgcccaggaattcgccttgatgaagtcagatcctccaattgctcaacaccgctcaccccgtcggcaaactggtcaagctggcggaggaccaaaaatccggtctgacactcaacccaacacctcttagtgttccgcaagaggaaactggttctgagtgacgatgaaaacgacgatgctgaaaaggctggcagcaaaggggtgactggaaaaccaaggcaagctcaccttaagaagaaaacatccggtcgtcccatgccgaaaatcaggaagtcctccaggtacaaatcatttgaccattttccttgtattgctgctcactcactattgaaatagcactgatagtataactcaaatttgtaggaagccatctgacatagatccttctggaaaaggccctaagccgactgacatggagacgggtccttcaaaagaaactgggccgactgccgaaaatcgcacgagtgacaatcaaccagcaaccgacaatgtagagaccagcaacgagcccctgactggaaatcagtcggccgaagctggagttggtgctaatcaggagcccccgactggaaatcagtcgggtacagaacaaaataatgacatctcggaagtagagacccaggctgatagccctcccaagacgagtgttggcgccaactctagaactaattcccctgttagggtgcaaggacctgcttgtccccgaccggaaatcataacaggtaagcaaatcctccaaatctgttttgatccaacagactttcttcaattgtttcaccattattcatgaatgcctaaggcccgatgatcggcgacgaagaagaggtcctccggatacaatcggctgaagattctcgcccaaccatattagtcaagtggtgagatgacgaaatgcaaccacaggggatcgtaataaataaacaaaaagaggatgaggaagtatgtctgctgaaaaggacactcggccaagctactcgtcttgtaaatgtaagtatccctatacacggcttcaatcatcctgtcagccactttgcttagatacagataaatttgtggtacagagaatccatctcaggaatgaggcgaagaccgcaacccttgaaaagctagttccccaccttggaacccttgaagcaaccagaaaccagctgcgtgaagccaaagagcttgctaggaaaactgaacatgaccttagagatcggatcgtggagcttcaagactctaactttgagctgagcggttcatcaaaaggtaaacatcgtctctgtctgacctgtttcatgttgctatccatgtgcatctgaccaatgaaaagcaatacagtgcaagcttccaagatatccgagctagagaagcgaatccaagctctagagaaagacaaggccgaattggcaaaacagagggactcggctctgaaagatgtcgaaggtactggtagctaatacttcaaaaaccactctcatcttcatgcctaatcattgatgtaaacttattcatgtagaccgcaagatcaaatcccaggcccaattcgacgtcttagttaataaaatcaagaagcttgaaggagctagagatgaagtcgccaatgccgctacgccactcgtccaggccatgtttttcaataacaacggtccgagttcacttgatgctgtcgaaatcttcgacaagctgagagctgctccggatacatattttaagaacatcaaagaagctgggagtatgggggcagacctagcgttggcaatgaccaagtccttgtacccgaaaattgatattgatgctgttgacggctttgcagacgggacaagtgaagaggccgcccttgaccttatcagtgatgcgcaaaaggccgctgacaagataaccgctgatgtggttgagagattccaggacaacaatcttaagccgactgggtctgataattctgatgatgaaagaactgaatctaattgtttgtgtattctgatgataatgatgatgatggtggaggcacaatttgtacaatactgataaatttatgatgtgcttgatgatttaaacttagctctagatttcttaagtttttgtcaaaccttattgagcctagaacccgcaaaagtttttaaaaaaactctcagtcctcattggctaagccaaaaaatcaatcaaggcaatgataaatcaagtaaacaaattgaattgataaaaatcacactccattattattatagtagcccccgactgataactcaatggacaacttgatgttaacagtcaaagaggaagatacaaaagtaatgcctaagcataaaaacaacgaagatgttcaatattccaagagttgtcgatatgagtaccgtcttcacgcttgagtcggtaagaacctggccgagtgactttagaaattatgaacgttccttcccacaagggagataacttgtgtcgatcccgtgtagtttgaatttttctcagaactaggtcgccgactaaaaaagctcgagatcaacattgcgattgtgataacggcgcatcccttgtaagtaccgagccgacttcttccagtcggttgagatcatctactcggtcttctccgtagcgctcctcgctaaagttacgaagttacttggcaacatcgcttccgctccatagactaggaaaaatggcgactggcccgtagctcgactgggagtggtgcgcaaggaccatagtacggatggcaactgttctaaccacttgctggcatagggatgcagtcggtcgaaaactcgcgcttttattccttgaagtaccatgccattggcgcgttcgacttgtccattgttcatggggtgcgctacagaggcataacaaattttgatgccgaagtcctcatagaaatctttaaatactctgcccgtgaattgagtgccgttatcagtaatgatcctattagataccccaaaccggtgcacaatgttgatgaagaaatctctagccttgtctgccggattgtgataaccggtttggcttcaatccacttggaaaacttgt

SEQ ID NO: 50554 - DNA, 5182 bp, Oryza sativa
ccggttgggtttcaatcccctgggaaaacttgtcaccggctccaaagagatgagtataaccaccgactacctttttaaatgggccgaccatgtcgagcccccaaaccgcgaacgaccaagacaacgggatggtttgcaactcctgagccggtagatgagtttgtcgggcgaaaaattgcaaccctcacatattcgcacaattttgtcagcgtcggacacggctgtggaccagaaaaaaccttgccggtaagccttgccaacgatggttcgtgcggcagcgtgattgccacagatgcctgaatgtatatcctttagcaattgtcttccctcctccaaagacacacagcgttgcaggattcccgatggacttttcttgtacagctcggtctcatgtatgacataaagtctactgcgcctggagatctgctcggcttcatctttatcttgagggagttcttgttttgtcaaaaatcttataaggggctctctccagtcggcttcaatcatgcttacgtcttgagtatccgtggcctcgattgtttctttccttggtacgggtggctcatagagatgttcaaccaacacgtcggaaagagctgcttttcgttttgaaccaaaattagccagtctgtcggctgcctcattattgcgtcgaagaacatgggtgagctcaagtccatcaaatttgtcttccaacttgcataccccctgtcggtaagcggtcatgttatcatcaaggcaggaccacactttcataacttgattaacgaccaactgagaatctccacgaactatcagatgccgaattcccaaggagattgaaatctttaatccatgaagaagcgcctcatattctgccacgctgtgagatccagaaaaatgtatccacaatacgtagctcagcctctctccagtcagggaaattaggacaacccccactccagtgcctgaaagcctcttcgacacatcaaaatgcaagtccaatactccatcttttccacgggcatgtcttcttggcactcagtccactcggcgacgaagtcggctaaagtttaggacttgatcgaagttcgcggcttgaaggatatatccaaagacatcaattccaaggcccattttgcgatccgcccgtttgcttcgcgattgtgaagtatgtccccgagtgggaacgacgtaaccaccgtaaccgagtgaccttggaactagtgagataatttcctaatggtaattaaaacaccatataatagcttttgaacctgagggtatcttgtcttggagtcagccaaaacctcgctaaagaagtagattagtcgttggactttttgaacatggtcttcttcttcacgctcgacaaccaggactatgcttacaacctgggaagttgccgacacgtataacaatagcggctcttgcggatgtggtgaagctaagactgatggagtagtgagatgtttttttgaagtcttcaaaggctttttgtgcttcgggtccccactggaaattgtcggttttcttcagcaacttgaaaaaaagcatcccctgctcgccgagtcgtgagacgaaccggctgagcaccgccatgcagccagttaattttttaacatctttctgggagctcagcgatttcatgttgaggatggcgttgattttctccaggttggcttgtatgcctctatgggacaccataaatccaagcaacatccctgacggtactccgaagatgcacttttcagggtttaatttcatcctgaaagcacggatactcgcgaaggtctcttctagatccgtaatcaaatcatccttctgcttgatcttgacgaccacgtcatccacataagcttcaacgttgcggccaatttgggttgaaacatctctggatcatgcgttgataagttgttcctgcgttctttaatccaaaaggcatggtgatgtagcagtaggccccgaagggcgtgatgaatgaagtcttcaagcagtcggattcctttagtcggatctgatgatatcctgagtagcaatccaaaaaactgagtagctcgcagccggccgttgagtcaactacctggtcaatgcgaagtaacccaaagggatctttgggacaaaacttgttgagggcggtgaaatcgacacacatgcgccattgccccgtcttcttccaaacagaactgggttggccaaccagtcgggatgaaagacttccttgatgaaacctactgctaacaggttggtcaattcctccttgatcgcatccttcctatcctgtgcgaaataacggaagtccttgctttatgggtttaaggtcttccttaacatgtaaagagtgctccatcacctctctaggaataccaggcaaatcagattgtttccacgcaaagataaatttattattttaagaaaggtgatgagtgcgctttcctatttacaatctaacacagcgcctattacagcagtcttagtaggatcagagggatctagaggaatcttcttgggcttagcgtcaccttctccgctcttgggcatcttggtcacaggcacttctccttcgcttgctgtggacccagccagtcggatttcttctcgggcgagcgtgatctcgcgggtctgggccatcttgcagctttccttgtcacacgtgacggcttgcttgatgtcgctccgcagggatatgactcctcgaggactaggcatcttcatcatcatgtaggtatagtgcgggacagccatgaacttggctaacgctgggcgtccgagtatggcatgatacgttgtctcgaaatcagcaacttcgaagcaaacgttttctgtgcggaagttctcccgagtgccgaaagtaactggaagagtgatctggccgagtggtgtagcagatagccctgggatgattccgtgaaagggcgcaatactcagctttaattctggcgaggggatttacatgtcgtctagagtcttggcaaaaaggatgttgagtgcactgccaccatcgatgagggatctgcgaagcttgacgttgcgaaccactgggcctagtaccaggggataccgccccgggtggaccactctgtcaggatgatccgagcggtcaaacttaattatcgtctctgaccaccgaagatattggtgcgtgtcgggctgaacagcgttgatctccagttcggttagcttttgctttctcttggattcataagccaggggtccgccaaagatgtggttgagttccttgcgatggtcttgaaaaccagacggggcatcgtcttcatcatccttcttctttcatgtgctttgatctccatcagaggtcttgcgtgcgttcttggcgtattgttctatgaactgtttgtagacgaagcaatctttggccgcgtgattggagtttggatgatgcggacattgggagttcatgatcttgtcaaaagtgttgacgagtgaacgttgtcgggaggatggtgtagtagttgccataagttcctcgggcttacgcttgcgatccttgtgattggtacttccactcccccctgtagtcatatctttcttcggcttccaagtagtgcccgactgcttggacgcggtaatggcatcttcggctttggcgtactcattggctttttcgaacatctgcttgaccgtcctgggaggcttgcgcccgaacttgccgactaggtcatcgtggcgaatgcccttggtgaaggcggcgatgatgacgtcgtcggtgatgtcagagatcttgttgcgttgctcggaaaagcgtcggatgtaatctcgaagggattctccacacttctgaacaacgttgtaaagatcaaactgtgtaccagggcgttcaaaggtaccctagaagttggcgatgaagtggtcgcgaagttccacccaagatccgattgtgccacagggtaacccgtgaagccaggaccgggcagaatccgctaggaccacaggcaaatagtttgccatggctttgctatctcctcctgctgcgcaaattgcgagaccgtagatggtgagccaagactccgggttagtggtgccgtcatacttctcgattccagtcggcttgaagccggctggccaatccactcgacgcaggtcgcttgtgaaggcagcaactccatccacgtcatcgtcgtagcgatctggtgaatggtggggagcgtagcctcttgccgcgcggcgctggttgatagtatcgcgaagatcgacggggcgcctgcgatgtggggagcgagattgttcaactcgacgctccctatgtcgtttgggaggcgagtggatagatcgctcatcgtgacccttgctcctgcgactggatcccgcgccgacgacgctgaggcttggttggtgataatcttgagatcgaagagggggaactcggctgccagtcggcgtgcggacgcttgaggagttaaccgggaccgaggcggcgatcatggtcttggtctggttcaagatgttgacggcgatcatggtcttggtctgattcaagatgttgacgacgtgattggcttgattgagtgcgtcttccttgaggagggtgtcgaggagggtgatcgctgcaaccgcgttctgttgaggggtgcgaaaaaccaccgttccctcgacgtcttgctgcccgataagttctcgtgctcgtcgcccgacatccaagtcatgctgtcgccagtcctcagcctcttttgtagcccgttcgcgctcctgttgctcacgctgtagccgttctcgctcttgtgcttggtgctcctcttctagtcggcgtcgttcggcttcctgttgcacgcgttgttcttctgcttctcgggctttatgctgttcttccgtctcgttgtcagccatgaagatgccgaagtagagaggcatgtagttatattcaaagtctttgtcgaagtcgtcgaggtggcggtagtcgtagcggtagccaaagttgtcgtactcaatgatctccgttggccgtgagtcaacgccaggggagctgaggtagccatccagttgttccgtcgaaaccgtgctgagaggctggagtatgacgctgacttccctagagctaggctggatcggggcagaggccggatccagcctagacctacggggagaagatgcccttgtggtgaagacagcagccaaatcatcggggagtttcatcaggattggcggataggccccatcatcttgatcgggtcgtgttggagtagat

SEQ ID NO: 50555 - DNA, 2451 bp, Oryza sativa
caagtttaaaatggaacccgagtcctttaaaagatattttatttatacatgacaccccttacccagtgggactatacatgctgggtaggtatggggtatccataatctccacagtgaatactatgaaataactctgaataaccaaaacgtgattaatagaaaacaaagaaaacacctatcttacttttggccaaacaaatacatcaccaccatcacaataagaggtggcattgttgttgaaactgaagatggtgttgaaatccacctaccaccactgggacgtcgatatgagcagtgcatggagagattttgggtcgaaagcaaaaccatggataaaactacaatgtgtaagtgggagctacgaatgtggattttgtgatgaagttatttttgttgttacagaacattggaagagtaaggggaccaattgtcctagggtgaatgtttattagacagtttctttaagcattaaaaaggtgtccggccctatcgtttggcttattcggggaataagccaaatgacatatttacaaattaaaaataatttgtgaacaaaaattttatatacgtgttattagcaatctaaaagcaaaggctgaaaaataaacttcgatgaaaaaacccgaaaattagctccaaatttaaggttgaaaatttaaattttagctaataagtataagcataaaagaattttcgtttaaggctggtcattacttgataatatacataccaattaacaccattcatcgtgtttttattgcggcaatggttaatgtgaagaatgagcctaacattagtggccttccaattgtatgtgatggcagatatctaatacgcactacgattcaacagttgtgatatttttaggatatggcccatgtaatcacaggggctacttacataggaatagtagataatatactcccttcgtttcaaaatatttgacaccgttgactttttagtacgtgtttgaccattcgtcttattcaaaaaatttaagtaattatttattcttttcatatcatttgatttattgttaaatatactttcatgtacacatatagttttacatattttacaaatttttttaataagacgaacggtcaaacatgtgctaaaaagtcaacggtgtcaaacattttaaaacggagggagtacaaaacaattaacacagttcattttgtatttattgtggcaatggttaatgtgaggaatgggccttacatactagccttccaattgaatctgatggcagatatataataggcactatgatctaacggttgtgatatttttacgatgtggcttctgtaatcataactaatatataggaatattatcgataatatatagagtaattaacaccattcattttgtttttattgcggcaatagttaatgtgaggaatgggccccacattagtagccttccaattgtgggaatatatcttatgcaaataagcttttagtgcacactccgtacacaataactagcaaatatcacagaaaattctaaaataaattggacacatactttcaataatattacacttacatatgaaatcttattttcaaatccattatattttagccataacaaaaaaaaagataaaattatgacatatttttactcttaaaattgtcagatttttcacctttttttacagctaaaatatactgaatttaaatatgagactttgtagatatgtataatactattaggagtaaatgttcaattttttatagaatttttcgtgacatttgctaattattgtgcacagagtatgtaagcaagcagcaagcttgtgtgtataggaaatgttccttccaattgtatctaatagctaatactccatctgtcccaaaatataagcatttttagacactaacatggtccaataatatcaataaaagtaagatgttttaactaaaaaaagttgcatattatagtagtttgtttaacaataaatctaagtaacatcaattttatatgattattcttttgaattttttttgctattaataatagttaaagttaaaaatgtttaacttgttactataataaaaatgtttatattttagaatggagggagtatcttatatgcatatttttgatgacgtggctatatgaaatcgcagctaatggatagatattgttcacccacgcgtaaatcgtaattaacccatttttatatacactcttttttttttctcgcccggtcgcggcggccataccgcaacaagttctcctccgccgtcgcttccacggcctccccccatcccaaacgcggtcgatcgccggcgaatccccaccggacgccgaggcgactgccccgccgctcgccaccctccatccccggcgtccccgaagtaacccaccgcctccttcttcttgcctccatttttcctgcacccgagtgagggcgaccgcgatctttcagatcccccgaat

SEQ ID NO: 50556 - DNA, 1739 bp, Oryza sativa
gcggcggcggctcggacccgtcgaagaggttccacgtcgcgctcacggcgacggacgcgctctacagccagtggcagtcgcgggtgatgtactactggtacagggagatgagggatcggcctggctccgacatgggcggcttcacgcggatcctgcactccgggaagcccgacggattgatggatgagatacctaccttggtggttgatcccctccccgaaggcgcggatcgagtaagaaccccgagtttgttcatgttttgcaaacgccattagatggcaaaatcatttcgtgaagttaaaacgagctcttgctgatatgacgttcctacgcagggttacattgtcctaaacaggccttgggcatttgttcaatggctgaagaaatcaaacatcaaagaagagtaagtagatgtattttgtttcttgtaagtttgttatgctaaatgatcttgtaccggcggtttcctaatggaagcatttgcagctatgtacttatggctgagccagatcacatctttgtgaggccattgccaaacttagctcatggcgacgaacctgctgcgtttcccttcttctacatcaaaccaactgaaaatgaaataatactgaggaagttctttcctgaagaaaatggaccagtctcaaaaattgatcctattggtaattccccagtgattatcaagaaggtatctctcatctcgacgcatgattaataggatgcttaggtccggctataggagctgtcaagaactcaagatagcactgtctgcccaaactagttcttttcagttccgcataaaaaacatacatttaagaacattgtgcaatgccatagttcaatactgtttcaatgcattcgtgatgccttcaaaacatctccaggcccagcttgagaagattgctccaacttggatgaatatttcgttgaaaatgaaagaggatgtggagacagacaaagcttttggatgggtcttggaaatgtcggtactattatgtgtacagtatttcttcttgacttaaacatgcacaccccttattaatttgatctttcatattcatgtttataggtatgcatatgctgtcgctagtgcattgcatggtgtgcactacagccttcgtaaggattttatgattcaggtgcttagaaactgtcactagataaatcatctcacgcttcgtcacgatgtcttatatcatataagatgtgcttgatactaattgcagcctccttgggacgcgaaatcggacaacacattcatcatccattacacttatgggtgtgattatacattaaaggtgactactgtttgactttaagtatatgtcatcatatcagttatgtcaattactttgtaaaatctatttatgcattgtcatcaaaattaactttataagcttctcatgaaagagcttttttgtgtcttgtccaaactcagggtgagctaacttatgggaaaataggggaatggcggtttgacaaaagatcttatcttcgttcaccaccgccaagaaatcttacattacctcctccaggagttcccgaaagtgtggtatgtgcttaatatttagtattatttcagtatgactgatgccacttctcttaaacatgattgacctttacatttacaaaattctaaatcaccttgttgagagtacactattttgtcccactgaaatttgccatatattatattgcccacttttagcctgcctatttatcccctgcatttttagctt

SEQ ID NO: 50557 - DNA, 2428 bp, Oryza sativa
aagtaggtgggaaaagtgaatggtggagggttgtgattggttagaaagggaatgttggtagagaagtagttatatttttggacatatcctgagtgctaaaagttgttacattttgggacggagggagcatctttctaacataattaatgtttatttagtgtaaccctatgtctcatatgctatgtttcctgataatattattgtttctgtgactaacaatggatttcttatcaaatacaagagcatatcacctagtaagtatatagttactgaaaacaagcagatctgagactttaaaaacgtaaaatggtaactgtactaaggtttagatgtggatcaggcgtgcatgttgaatgaacatccatgttgcaccagttaggtacagtaggactgtgttgcaagttacattgttgagcatgattttgaaagcaaagaaagatgaataagaaaagcaaagtccaaccttgatctcccttccccttgatatggtggattcctaatataggctttctttgttcatatgattttccatatgatactataataagcctctcctgaaaatgggtggctactcgaaccgattgaagttgctctttggcataggtagacttcagtacctggataggtcaaccttgctaccatttatttgtcttgtccttcattcctgctattcctcatcatagaagtactccccttccattatattgtagtatggggaaatccaattgcaattgggcatgccaatggttgagtcattgtggtgtgtttctatttgtcaaataattgtaaatcattgtatttttaaactttggttatttgttctctttttgactgattgctagggtgttaagaaaaacaatcatggacttcattcaaaacaagacactatttgacttgaactataaaacaattcacttttcaaccttggtcctgatctttctgctcccaaggtgccactgtagtgtgatgggtctttcaaggatcgaattgggcatgatctggcctcatcctcggggagaccttcaaataaacacattcaatcaagtaatacctactgttttttggtaacctgttttggttctaacacttgatgcaaaccagaattgcttcccttgatcaatattgctgagaataacagccactggtgaaccaatagacacttgttctctcatcaaaaagtttgtttgggccattacataagaggattggtcaactggaaaatcaggacccactaatttaagactttccaaagactcttggccatttcagcttttacaccatacgttccctgcacatctgctccacagcaaactgaatttgttttaacttgcagtgttccctccatttcttgttatatgcagctatagagctttaggggtacagattcaaactttactgcataataatgtctgattattgattcagttcttctacttcttgctgcatcttcagcaagtattggagaaattcttggttccactataaagtattataataacctatggtctggtttcaaagttcaagttgtaaaatggacaattgtgccattattttgtcacctgctgctattttttaaggcaattgaaacagcaaatgacaattatgagagtttcagcagtatcgcaaatacaaagctgagatcagtccatctaattcctaatcttgtgtaccaatctgaattgccttttcaggccacccttgtgaaaatggtcaatgaagccactgcaaacattccagggtgggacgaagaaaggtgattaaatggttttgcctcgctgatactcaattcagctgatagtgtttacattagaagccatcgaaggatctccgtggtcaataaaacaagtgaatcaacgcatgttcttcttaggcggcagacacgattggctaattcctacaaattaacctagaattagtttttggcaagtaaaacacggtagttatttggtcaagtgaggtggtccatttttggtgttgtaaagctgaaacgtgagcttttggtaatactcctagatcattcgattgtattgtaaagcagaaatattagtcaagtttgttgcacgggaatgttactcgataattgaggcttgggatccttcgcgcttgtgccattacatgaaatctttcaaaaagtagtgtttgtcatgagaggattgagagagatggtttgagagggaagcatggaattcacatgacgatcaggtgttcctagttaagttgcatacttacagtccaagtccgaagtccattgatgagcatcttgtttgtgttcttatttccttttttacatgtaaatctctcttcgtttatctagttgtcgtgtcaactttcaagaatgtgtaagaggataagtatggtgcaagaacattatccatctcggtcttcctacaacagttacactagtttgctcagattgaagtctgctttg

SEQ ID NO: 50558 - DNA, 2853 bp, Oryza sativa
actcagtaattaagtatttattagcttgttttaaaagcaacattagtaaagaaccattttgtaaaaaacgcaccatttagcagtttgtaaagggtgcgcgcggaacacgagggcaaggagttaggaacacaagctgccaaacacagccttcgttaatggcggttgggggtgattgggaacccatctcctctgaacggaaaacggagcagttcattagcgcgtgattaattaagtattaactattttttaaaaaatggattaatttaattttttaagcaacttttctacagaaactttttaaaaaaacgcattgtttagaagtttgaaaaacgtgtgcacggaaaacgtggtagaggggttgggaaaaggttgaaacaaatgcagcctcaagtgttacaagttcattattttacttttgaatcctttaaggccctttttattcagagaaaattcattggagttttagaggattttactcatacatgaatgtttcctatataaccctttgaattaaagaaataaattctataaaatcctttaaaattcctacggaatatctcctcccatgcaagttttggagaaaatttaacataagatacaaccgcatagaaaaaatccattgagtctttatcttttctcagattcctgtgtttttcctgcggcctaattaaactgtcatttctacgtttttttctgtgttttgcaatcatctgttttacacttatatttctgtcagaatcttattttttttctattcgtatgttttttttcattcatgtgattaaatggagctctaaacaaagtcaagttcacattcccgagtatatttgaagttgatgacaaccctactagaaaaaggtttggcaattgattcgcatgtcatcccaccaattggcaattgccaaccttaaattgtggcgaaaggtatggtgtgaggaaaccagcgttgacctagttaatcattgaaagcgtgcctatcactctagttagtttctttagtccaaaaggttcaccttttgttttcttagctagagccaacttcaagccttcaagactaaaatcatcaatcatctttcaaccccacgtaaccttaaagcccatctggtagtactaccacgggactacagcttttagtaggtcctccctccgtttcacaatgtaaagtaattctatcattccccacattcatagtaatattaatgaatctagacttatatatttatctagatccattaatattaatatgaatatgaaaaatgctagaatgacttacattgtgaaacggaggaagtagtagcattacggtggtgtttgaaagatgagataaaaattaggtgtttcacgtaaaataaggtggtaataacatgtgattaattgagttttaattattacaaacttgaaaatcgattaatctgatatcttagaacaactttcatatagaaagttttcacacaaaacacatttgttttggatactcgtggcacgattttcaaactgctaaacggtgcgttttgtgtgaaaactttttatataaagatagaggtaatcttatcatcattaagaagatatatacatggttgtaccatatttttttctactgtaaaactttgcatctccagatagtaaggtttctcgaggtattaaaatttttagggtgaaatttcggtacctacatataaataatgcaagcataatatcgggttcattaggagcaccagagtattgagattaactacgtgaaagagttggtagtcgaatggtgaaggcatactcgtgtgcaacttgcttgatctttggtgtatcaaattatttttcctatactttatgctaccatcttttaacttgttattggtgttttcagctaaatcaaattgttgagatgaattctattgtcaaaagaagactgtaattagacgaaatttatcttattaaatcaccatgcaccacccggcctgaagtgtatggcttaatccttctctggtatctttatttgtcccttcatttcggtcattttctcatcagtccctaattctatcagcatcattgtcccctttcagctccaacatttttagtagaccatgcaagattttttgcttttgacctctaaaattttctgaaacaacgttgttggttatgcccactgtactcatcgggacaattgattgatgtcaatttggtctggaactgagctttcactagctttatacatggagtaatgcaatgacctaattacctaactaagagttgccatattctactcgatgcactcgatccatctctagctaagtaaccaataattatgatgaactggcgactgatgtgaaaattcaactttcaggtaggaaattcagatcaagagaacacaagaattttctctgttcccctactaatgaactactgataaaattcctacaaaaatcatgtgaaaattttcgttcggaacggggctaagtttcagatagaaatcaaattggaatcaacatgagctctccgatgccatttcctttcttgaggttaagggaactatgaaatttaagaaagtattgacggccttgaggaaaattggactataaaataattctaatgccacaatgcaaattttttcctcttttcgtgttgaaattgatcttgctgtgaaatttctccagaaatcatgtgaatgtcctcctctcggaaagggagattaggattttgaagtttccaatggtgccatttcgtttccaccgaccaactggagacaggagtcaaaacaaatgaacatgaactgcaagaagtatcatcggccttgcggcaaaattggacggtcaattaattcttcaatgtgccaatttttgcatcaaattttcatctaat

SEQ ID NO: 50559 - DNA, 5349 bp, Oryza sativa
ttatgttttatggtgtggctactgctgcaaccagattgcaagaggatctggtgtgctacatgcaaaaatagatggtgattactatcaggtacgtactacttacaaaatttaggtgtaaaagtagcacatttgctgtgaaaattacttatggctctcaataacaggggtttctagagtaaatccatctaagctttgttgaactttcaattttaagatgcctgtatccgagcgctaattgcttttagtttctttctgtgctgctctaactatgaaggaccaagctaagttcactgtacaatggcatattaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctataaaattcctacataaatcctttgattcaaaggggccctaaggctgtgttcttttggaggggttggagaccccttccctccgcacgaaaaacggaacgatagattaacacgtaattaattaagtattagctataaaaaacttgaaaaaatagattaatatgatttttaaagtaacttttctatataactttttttgcaaaacgcgtaccatttactagtttaaaaaacatgtatgcagaaaacgagggagatgggttgggaactcatagaaaagaggtttgagttgatcttgatcttactgttctgtaccgtgtaaagtggaatattttggaactttgttttgttcgtagcatatttgctggaacggtgtagcgccctactcttacattccagtatgtcaactaaaattgtggtcttgttactcttgtacttatttgtttaaattttccttccagggagtgatctaagaggatcgttgagctgcaacaaaaggcaataattatggtggatttttttagctttaaggttagttctccatcgtgtgcttgaccaatagagtggaattctatgacttgaaacatgattttttgctatattgtcagaaaactttttgaaccagcttagttgaatttagctatgagattgttgcttcatttatttaactttatgctgcattatgatacttttaacagcattcctgaaacttttgatcacatcagccaaaaggatctgcatgaactatggtattgctacctttgacaagtgattagacaaatgcagatggctgaaccattgtttaaagacaccggccgtatggtctaagctgatcattttggccatattcatggctttgttgttgtcatcaggccttcgacatggaagattggcatgtttgctgggacggctatggattcttgggcaagttggccagagactacgtgacgttcatgatcctcagccactggaacacaatgttccttaacgcggatgatgccggtgcacgcacttctgctgagaggcagagaccaataagctcctcttccggtgagccggctagacagcctgcttgatgttgcccgtatctttgtagcctttgattgtctttttgtgctgtaaatatacatgtatcctgtaacataatgtatgcaatatgaaaaaaaaagggggggggggggggcaaaaccctactttttgtgcagcagcaatcacaaatgatcagcccccgcaaaaaaaaaaaagatcaaccccctatttgtttctagaatgatcactcaagcatttgaatgagaccaacgcttcggccatttttgtttctcttgattttctataatttttttagatgaaatccaggatttatttgagaagatatgggtgccacgtggcccaatcaaaagtcgggattaccgctggcttgagattactatatatatgtgttctaagtggcttgtttaagcaaagctgttggtctacatagtatcttttgaagaataaactgatatgagcctaactgctaatcacagtatatgagaaaaggtatcaatcaaggacttgagtgaaacctattcacatgaaattctgaattcaaggtatagttcattgttcagatgtggatagatgtagctcttgttataggtggatgttcattaatcggtctccaccgaaacactggtatatcaaagttgcattggaataaagagcattttcgtaagctttgaaatttggtggagattgttaaatttacttggacaattgatccatttaaatcaatgatatcaaataaattccaaggctcatatgctagtatttatgtgtattcattctctcatgagttatcaatggtaaagatgaagagttctgagaattaatccattcattgattacatctaattgatagttggttgatagtagtgcagtggaggaaggttgatggtagttgatgacaatcagttactctatttttcttcctattccatgagtctcttacccttcatttttcttttctcctataaaacgagaatggatttgatctcctacgcatgagagagaacatacattttccatccacttccacttctgttgcttctatggtgattccatcctggcgagtgtgtgtgcatatgcactaggagaacaaggctccgaaacctcacatccttgatcttgcaccgagaggaggcgaatcaggctttttgcaagcacattgcacgactgcccgcttgtgcttgagtgcgactacatcgactacttccttttaatcatggctggtggcgagaacaagaacagtaaaggcaacagcaatggcaatggcaagaatggcaatgacaacggtgggaacggcaacggttctccttctgctaccattgcaaccactattgtatcactgtatgctattgtcctcttcttcccttctctgttggttcctttcatatgcgcaaatgagttagatatgcctattttcatggtttacactgatatcatgtttttttttcatattcctgttgttgagagtacatcgtttattgatttacgctatcataatttaaatttacatcgttatgatttactctcttattttctacatcaaatattaaggtgatttccttatattgtcaataattcaaaaaccttattatagccaaatatcatctacggttaagaggctcgtataaaaaattgattttcgcttatggttcttaaaccgttttcatagaaccatcttcttatagacaagagtagttatggtcctccactccacgtacaatttaaggggcgtcataaaaaaagatggattgatttgcatagtggaccaagtcaattacgtagtcaatgcaggtctgtgtaccatgctatagctgagaacgatcgatcaccttttgagccagtcctattaatcaattggcatccacagttgacaagatggcatgcaagaatctaaccatgcaagcggtactcgatcaacacgttaattcttattattaccgcgaatatggctgtgttcagttacacgttaaaattaaaagtttaaagaaattaaaacaatacgatgaaaaagttaaaagtttatatgtgtagaaaagttcgatgtgacgaaaaagttaaaaatttgaagaaaaagattggaatgtaaacatggcctatatctcccaaccccactaggacgaaagacataagtgacattattttcagtgtcggcctgctcaattatacacaccctcttgacttcactcttccaattgcaagtctttccatgactgtatttatgtcagatttcagtctcgcctctatcggcatccccaattgaaatggaaattcccaggggcaataaaaaatttagcacgagatatatatgatacgttctaatactataaatctaaatatattctttttctagatttatgtggtaggatacgttacatctctgtattagcggcatcatcttttgacttgtgcttatgctttatcatctaaaatttgaatttttaaattaaatttggagttgattttggagttttttcatcgaagtttatttttcagcatttgcttttgcttttagatcgctaagaacatgtataaaaagctttattcataaattatttttcttaacgggctgtagatttattttctataaaacaaagggagcagaccgaaaactaccggaggtcaatgcatcctctacttttagttcggctgggtttagttccaaattatttcttcaaactttcaacttttctatcacatcaaagttttcctacacatataaactttcaacttttccgtcacgtcgttccaattttaaccaaactttcaattttgacgtgaactaaacacacgttaagaaaaattcattttctaagacatattactatgttttgggtaaattttgcatttgcctgcagataattgtcaaaattccattttgaattagatccaagccagtgccttttttatagaaataaaaactaagccataggattgaaacacggtaaaccaagcctaaaaaaggataaacagtagcgggtgcaaaacagcaaatcttatagaataaatattcaccgccaaaagaaaagacagcattattttcaacatgttaaataaattaaaccagaaaactaaaacaatatgatagagagcgaaattgcaacactttacaccaaatgttttccatagtgcatccgaggcagtcctctatattaatctcacaaactaaactctatgaaaaagaaagaagtctaaaaaccataatggtctctcgataaaggtgtcttacacaatctctctcctattctagagatgaataaatatcaacaagtcattcttctgatagaatagtaaatcggtcactaaacaagtttttttaggaaggtcagtaacaagtcggtgacctgtaggggtggcaacggggcggggcggggccgggttggcttggaatgcccccacctccaccctcatgcaggtatccccgtccccggcctcgcaaaggaagtcgggtgaaaaacttcacccgtccctacccccataggggacctggtgggtgaccgggtccccgcatcagctggatggagttaatactccatccaaatattgcaatacactaaataatagtatgataaaatttcaataaccctcgacagtgtgggtggattgaaggaaggaaagggattacgattgaggggactagggtattgagcttttatatgtcaactttgaatgggat

SEQ ID NO: 50560 - DNA, 2321 bp, Oryza sativa
ggcgggtcccctaccctaacggggaaattgtcacccctagccatacggcatgcgtctagacagatgcagactctagggttaattgtcccttttgattcctatcatgttggggatgatgagattgagatgggctatgtcgcagtatgtaactcccacatcggggaagcaagaccccctttcgaagatttggacaaggggcgagtctaagcctgagtcaccctcaggatcaaatggacgtgatgaagtatacaggtttgagccatacggatgcgtaacatcttactcttgtgtgtatgtagactatcagtgatgaacttgtattacgatgagatataggacttatgtgagctctaattgctaaaagattcaaccttctattcattgggatagatcctccttttatatgccaagggaagtgcatagtgctaaaacttgcatctaagagcgggccctattccaaagagttgggtgtgtcttgtttcgtcgatgtcccctatagcaagatggcaggaagtgacatctttgctctccgattgacacacgatgcagaggcaaggtgatcttctcaccattgggcccaccagtcaactcttacaaggtgccaagattgaatatggtggagtgatatggaggggcatgtcccccccacctattccttcggcagacatgggttctcgggaggctacatgcggcgtcatgtccctaagatgtgggtggatgagctgttctccaaacggctccctcctacaacggaaataataatattgagttggagttaagcccgttggcccaccaagcgaggtgaaaaaaaccccatagtgagcccggggcaatgaggtgtgctcgggcccctgcctagggccccaagtccattggtattgcgcattgagggtgcctccactccatggggcttgtttccatgcctggcgcactgagtttcccaggtctccagggatatttcctcttgcttctttacaggtttcttgttactttggacgagcttctcgaagatgtcgttaatgaacgggttcaaagtggttaccttcgtcaaagaagcaccatacaccttggagatattcttgtaggtctccaccctcttctcggtaccttggatacgtagatcttgtaggtttctacacttttcttaagatctgaatgtagatcttatacgtctcttgaagatatagattttgtacgtctcttaaatatgtaaatcttatatgtctatctcttgttgtgatacacatcatttggagccctgactattccagggaaccggggaccccattcccgttctccaaacaggccatattatagatcgactttttaagtcctatactgctgtatgcatataataatcaatacattttatgaacttggtcaaactaaaaaaattttaactgagaaaaagtcaaacaacttataatataaaatgggtaagtacctcttaagttcggccccactcatatcaagatgcgccactggttgacctgttctttgtcgaacatgttgccgtctgttagacttcttagagaaggactcagcaacttgtttatagcaattaccaattaacgtgggggcattttagcaaagctgcggagcatttaattattatgaagtggagtagataagttttcatttgttcaggctataaattgagaacagactctgccctctggtcacgcattctacacagaatctctggttttcccaactgtcagagaagtagagaacattccagcttagttgaacttctcacaaaaaaaaaaggtactccaggctgcctccaatggcggaccgaatccctgctgttgccgctgccattgccattgcctccctaatcctcgtcgttacgccggaaatggtctcctccggcttcattccacggttcaagctaagcccaaaggcaaataagcagatccgggacatattcaaggaccatgccgcggacttggccggcctcgccgcggacgccatccccagcaagggcgagggcgaaggcagcagcagtgacccaagtcaggccccggccaccaccggcggaacctacctcatcaccgtcggtgtcggcacgcctccgcagtatgtctacggcgcgttcgacatctccagtcagttcgtgtgggtgccatgcgaggagtgcgtgagcccctactcctgccccagcgacaaaaccggcgtttacaagacgctgccccgggagctttactcatgcggagaacagcgctgccggacaatcgtcgggcagccggactgcggcgcaccgtataatggcccatgcaaatacacctgcaagtacggtggtgcgggcggaaccgaaa

SEQ ID NO: 50561 - DNA, 3897 bp, Oryza sativa
  unsure (1)..(3897): unsure at all n locations
cgaccttctaaggcgggagctggtcagcacggtggggtccgacaccgtggacggctctgcgctcggccttgacctgtgctacacgagccagtacctggccaaggccaagttccccgccatggcgctcgtgttctgggacggcgcggtcatggagctgcagccgcggaactacctctaccaggacacggctaccgggctggagtgcctgacgatactgccgacggcggtggccggcgggctgtcgctcctcggcagcctgatccagacgggcacgcacatgatgtactacgacatccagatccagggccgcgggtcgctgtggttcgagtcgttcgaccagccgtccaagtcgtccaaccgggcgtcctcggcttcggctgccgcgttgccgcggatcatctcgacggctgcggcgatcgcctgttccgtgtggtctgtcgtggcgtgcatgttcgtgtgaactgcttgtgttgtgctacggatggactgagatatgtgttattagaactatcttaaaaaaaacttcgcaatttttttttataaaactttcaaatgtaagtatagtgtaactatattataataacttatatataactagaaagtaactacattgtaactcgtatataatttatacgtaactaaaataaaaatatccaaaaaattatatggcacggtggtagcatagatcctcaatgagctcaacggtgtgagatcaaattttagcagctacacttgctaatttattttttctcctatttgctagcacgaatcttaaagcaaatctaatggtctaaaattgaaagttttccccctaatctagcaattccgataagggttctcgaatgttggtgtgttctcgtatgagtttagatcggggcggtagccgcggtacgtctcacaggttgtgcagctcttgggacggcgctactacgagcgatgtggcttatgagtttgtctcgatctaacattccaagtctcgagttgcatccaaccccaatacgctgcaatctatactcatcgatttaagtaatagtaagagagagtgacatatggagcgtattgtgttattgactggttaattttcctttgtgatcagaacaaatcagatttttgactttcttttgtgatcagaataactcacatttttgccatccaaaacaaagtagtggacatacgcatgaatgaaccgataacaacatcaaattcaaaccgatgttattgaacatcctaagggtaagagcaatgtgtcactatatatatttagcctggggtgccaaatagactaaagaacttcaaaagccactacaaaatgcaatgtggcctaaaaccgagtcatttatgtttgaagacacacatgtggcatggcctagcccacggagccaagatttgtcccagcacataaaattacctatgtaccctcgaaatcaactagtacactgccctttgacgaggccggtacaaccatgtctcatcgcctcctcctaacagcatctccttcctctcctcctcccgcgccaccgtacgccagtctgacctcgccgacgatgaagctccggagtggcttcgtggctccggagcggctatccccaaacgcggcacagtctccactccctccggttccagccatgcacaggcttctctgaaactatctgctgctgctgctgaaagcctgaaatgtgagtggggctttgtttctttctttgctactcccgtgcatgtcttggatcctttcggtatggtctcttgctgcgccgtgtgagattcttgcatctgctacacatgggttctttggtaaagttggtttttgcctctttcagttcttggtctgcttcatctgtcttgttatcttccatttgctaatcctttgcattttatttgttgataaatggagacttgtgacctttcatctcttgctcaagtttcacctctcttcctgcatctcactacctgatttggtgcttaatctaatccaattcctttttggttcttgtgattgcggtgggtgattaggtgcttaacataatcccaatcctagaaaaacaggagagccggccatggctgtgattgccatggctgctgtacggcgagccactggggcaggggaagccggtcatgtcgccggagggcgtcgtgccgagagcacagactcctctggatcctcctccgattccaaccatggaccacgcggaaaggggaaaaagaaagcggcccgtgcgcgggagaaagagggggacgcgggaaagagggcgatggcgagggcaaaaccgggatgcggcgcgcgcctgggcacgagcacgaagccactcgccccacagcgcgccggccacgctttctcccagccgcgcgcagcttcgttttcacccaagaccgagttgcttcgttttcacttgcgaacgtggcgccgatttctccggatttgtcgacgtgtacgcctcaagccgaacgacaccgtgttgcattgtaaaggcctaatagaacgggggatcccaatgggcgatcgatcgtgggttagcgatcgatcccctctccctccctccctccaccggaagaaaattctctgcggcggactaccccaaaatcgaattcatcgcatcaccggagaggcagagaccaatatcacttccttcaaggctccaaccgaggagaagatatcaggtttcttgaagcgatattgaatattgatcctggcttctctttacaatggggtgctcattgggattggaattagtgtgctcacaagccctccgccgtttgagaaggggaatgcggtggatgatgccgaggaggaagcgaccgtcaaggatatcacgaatgagaagctgaagttggcggcacagaacatgccacgggagatggcggcggcggcggatgggtggggctccttggcagggggaacccgacgccccgacgggtgaggcgtagtcgtagaagccgaggagcgtcggcgggtggagcgcacgcacacggcggaggaaagcaggatcgttgacgatgcagcggaaccgaggaaggaggcgcagaccgcgcatgcgcggccgacatcagtgacggacgggaggcatatcaggacctccacgatgaggtcgtaggtgagaaccagctcctgggcgttgagtcgactatagagattggacatcggctcggctcgaaagaactcgggctacagtaaaaacttagacatgcgtcgctagactacgcggtgttgtacatgaagtgtcatgcggcatcgccgcagagaattttcttccccctccatctggtttcctttcttgggtaccacattactttcctattttagtaaatttgtacactaaagtttatacacctcaagtttacacatttaaggtttagagaccaaaagtttataagtcaaaagtttatatatccgattcaaatttgaatttgaattcaaatattttttttatatatagtatttctatatatcaaaagtttatagacctaaagtttataagtcaaaagtttatatacccgtttcaaatttgaatttaaattatatctaattaaaaattgaatttgaattcaaatattttttatatatagtatttatatacatctaaaatttatacacctaaagtttatagatccaaagtttataagtcaaaagtttacatacccgattcaaatttgaatttgaattcaaatattttctatatatagtatttctatatatataaagtttatacacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50562 - DNA, 1132 bp, Oryza sativa
ttttttttattgttttcttatgaaactcccagacgtcaggtttttatacagaatctagcttttgggtcactaccatttcgcccctcagatacaccctctgttaaaaataatctaacttctgtttgtgtttcttaataagtaaagctttactaaattcagctcattacgttaaggtgatacaagtgtatcgagaacactctcagtctctgtacaacaaagatacacatagccaaatgaacattctcaaatttacataaattggagtacaagaagtattactggccattcattttaagagtacctccaacaagctctctatatgcccctccaagcataaaacttagcaactcggaaaaatcagtcctccaacagactggccaaccagattaccaagccatccggctagctaatattggatagtcggtatccctgacccagcctcgtcaagtgtgggtccacgccatctctctcctcaacccccttgccataacttgctagcaacacttgatatgcagctggctatcgtcgttgccgtctcaaggctattgctggaggtagcaagttggctgccatactgtaggcttggcagtgacgccctatagctcaacgccctggatttggtggccctcctttgcttccccttggcatcgacgagcaacaggccacccatctatgctatcgccgaccctagccatgctccagcaccgtcgcaccgtgggattggtggcagcgtcctgcagctcggcaccctagatttggtgggcctcctcctcctctcctcaggcctctatgttgacaagtagcatgttgtccctcctaagtcgttgcttgcgctagctgtgctcaagtgctatcgcactgcgggattggcggcctggatctagtggcccttctccgcctcccctcggtgtcgaagagcagcagaccgcccttcttgtaccgtcgattgcccgagcatcattgccttgctgctcggcggtgacgacgcggtttggatctggtggctgaggccattccctatgagattggcagtggatccctactcggtggagcaaagggacgagctcgccttcactatcatgagcgtcaacaatggtggatagagtgattgttgaagcatagaacaaatatg

SEQ ID NO: 50563 - DNA, 5161 bp, Oryza sativa
  unsure (1)..(5161): unsure at all n locations
gtgtgacattgatattnnnnnnnnnnnnnnnnnnnnnnnnnnnnnnnnnnnnnnnnnnnnnnnnnnnnnnnnnnnnnnnnnnnnnnnnttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaacattattttagcttcattgaattctgacatttgctgttttggcaaatagttatgaacctctcaacaccagtctgtgttttgtaggtaccctactttgaatatgctcacttgcttgtaatttgcagtataattgattaaagttcctcctgaagtaacttccatcaatctattcgcgcagttaatatgtgtacgcatgatcaagtttcagtattgctatttgtatcacagttattctttatgggttggttttatttactttgcttcacttacaagactgctcagagattataagcaaagctgtgtctttgtaatatgtgggggtagaccattccttctttaggaaattcctgatgctgattccctgtactggaatctgatagtagaaattttttaagaaatttttttatgctgattccctgtactgtaatctgatagtagaaattttagcactgagccactgactggcgttttaataatcgcagagctcacactgaagtctgccctcatgctctggtcttaatttgtcatattactgatgaaagtcttaggaaatggtatgagcaacaaatgaaccacatagttcttttctattgttgtatggcttgataggtataagtaaagtacctttgttgttgcttgattccttgcaatacatcaactgtaaactatgtgttgaaccaaagttgcaaagttttgctgctattcttgctacttaatcttcgtttctgtgtctgttcagaaggaagcccatgacttgaactgaaaaggtaacgttacaaaagaattagtacaaggccgaaagcaacaggaagggtctccaactgaagagaatagaaaaaaaaaatccagaggagaccatggcagataacagagaggttcaaagcctttgcattgctctatctcaaagaccccgaaccatcctcagttccatttaaaacgtgcttaatagaaaggtaatgtttcagtaaaaaataaaaactaacgttaaagcttgggttacagtacgattacgtcttgatgcaaacttgcaaagtgagagtctgcttccttgataaaaacaaattcctgaagacttggtggtttgttgtttttctacaatattgctttgagttcttgctaaactatagctgtgtaatgtaatgatgtagctaagtttcagattctgtggttcattagtatgcagagatataagcgtgatatttaccaattttctagctctcataatgggttccatgttcaagtttactagtgtttcagtaaagcctaagtggaatcttgataatctctgaatagagaattttgatttttttaaaaaaggatttaaaattctgctaagtacttaagtaccatgccgaactggtacatgctatttgtattttacttatgatctttgtcaatttctaagattctaatcatggatacgacttgtctaggccacgtgtgattcataatggtgactggtgggcgtcttctatggctgcagcactcttggaattcaacttggtaattggtgtgaatcatcaaatatattgttacatggttccgaagttctaggacggtgttgcataattgcagcatattgttattatattaatcattctaagatgatgttttcgcttcaatataccatgtaaggtattcaattttgtgacatagccgtgaaagtttctacctatccatcatttctcaatgaaacgtatgtaatgtatattttgaactcatcatatgggattctgaaatctgaaataagaacgtaactgtgttggctcgaggattcactgaattaacagagttaggctccacaagcttttaacttcaacttgtccatgctttaaactgctttgcacccactgaacttttcaagtgtagcacattttacatataacttattgagcaaagaatgaatgtaattcttggtaataacaaatatcagtttccatttcattgtctgcctagtgctgcctgtatatatctgtgatgaaatatttttacagcgaggagaaatgtggaaatatgtctttccccttcctgcagcattgcaaccatggagtgaaaagagcgctggctggttgaatggtggtgaggaagcatccggcattatttcatcctaagagcaatgtagtaaacatgggtcatccaagacatggggctagcctccacatctgttgccactgtacactttacaattagagcttctttatggtttcttccactgcgcgttcataatacctcattctctgtgtagctttcactgcacggtcgaaatccctcctttcaaatgcttcctggaaggaatgggaccaggtttccagctttctcttaatctgataaaggtgatatagtgcgagcctagaaatcagtcaagcgtatttatgcttcgaaataacaaccatgacataattgtgcttaacagaacctgagattgtatcttctccagggtttgagaatcattggcatcattaactgcttcacgtatctccatcatctgcaaattatgtagaaatatagctttgtttcttcaaattgatcttgaattgaaatatacatgtcatcgcaattactattacttctgtgtgaagttattgacacaagcgtcatggaaatatataaactagtgattaagtggctgcatcagaaccacagaaaaaaagattcaaacaggttacctccataagaagttcaggatcagtgatagtcttttcttcatcaatgggtatcccctctagttggagctgcagaatggttttatatggttgagaagcaatttaaaagatgatgtagatggatgcttacatagatgttccatgtaaaaaaggtcatatgtttacaggtcaagtatattttttatattattttgagtggagatggagatggtttagcctcatataatcataacctaatatgggttaaaatgagatgaaataggctgtattttttaagtattactggaagaacttaccaagtataatgcccttgacaaaggtttgctcagtgtgcggtatgcatcaattacaagtgctgattgctcagcagcaaaggctctctctttctacacaaaacagaagccaagtcacaaattgttttgaagacaaaggtacgaatactatagattggtaagaatgccagggcctagggagagacctcagatttagaatgaactaggtcaggatgtaacttcttctgccagtctttgtatttcccttctaaattgttatcctttatggtgtattccctttctctgccaaagtaatgaagtaaattattgatgtatgattaaggcatagaaaatattgacagaaacttatgcaattgtagaaaattttgaaaatattattttaagagtaaaattcataacgtgattaccatgatggtaccactgtatttatcatgaagcagatcattggaacaaattgtgaatttgccatatcattacaggagaggtcaaacacttagggtggacaaaatatacagtgtggatacaagactatccaactgaaacgctcacgagttttctgaaggggagatttggaaatttaataaattataagcattaagcaaataggtagaaaatcacgaaaccatcaccaaacaaactacttgcgttattacctaaacagccaacatggaaatgaatagaagggaacttatcacttatcagcataataaactatgcagacatattcccccaggtaggattggtggatagagcaagttggaatatgaacttcgaactatatccagctaatcccaattccacctcccaataattcttttttttaatattacagatcagtgcatcaacaatcaaacattatactaacataattgcattgccctagaaatttccctaaaatgacaacatgttttggccaacctaagagtcgcatcaaaatgcacatatcttgtaacaatcattgcaaattaccagtcctattatcgcaatcacatcaaaattgccagtaggataattttcgtcctaaccataaaagctaaagctggtgtccagtttccctttctgcataacccatcaagctacgaacacttatttgcgctgcagatgatacaaagaaggcccaagaacatagaaaccgtccttgtacaagtagcatttcagcattgcaatacataatgcctacgagctgagcagttatgacgatcactgcacaatccaattatacccaaaatacactagaattcgaaagagacgacacgattcattcacaaacaaaagacaataatgagccaattagcatctgattaagtggggatgctactcacaggccaaagatccggaaataatcgacggcggggtcgacgggctgcacgctgccgcaggacccgcatgagaggaacgcgccgctcgcgccgcagctccagcactcgcctccccctgcccggtccgagaggctccgggaggaggaggaggagccccgagcgaaggctgcgagatcgcgggtggtggtggtagaggcggaggaggaggaggaggaggagggcacggtggggacagggggaagcgggttcctcctcctggcgccgcggccagcggctccggccgccgccgcgaggtggaggcggagctgcccgggtcggcgccacatgtggggctttctgcggcgggggcgcctctgtgcggatgcgggtaagtccggcgagcggcggcggcggcggcggcgcggagagaagggggggatatgcggttgagttgagagccaagtattttgtgtgggtttcggtggttgacaggtggggcccctggtagctttctcccgtgaannnnnnnnnnnnnnnnnnnnnnnnnnnnnnnnnnnnnnnnnnnnnnnnnnnnnnnnnnnnnnnnnngggcaacattgcccgc

SEQ ID NO: 50564 - DNA, 3440 bp, Oryza sativa
  unsure (1)..(3440): unsure at all n locations
ctggcccattangaacccatgctnnnnnnnnnnnnnnnnnnnnnnnnnnnnnnnnnnnnnnnnnnnnnnnnnnnnnnnnnnnnnnnnnggcgcctctgtgcggatgcgggtaagtccggcgagcggcggcggcggcggcggcgcggagagaagggggggatatgcggttgagttgagagccaagtattttgtgtgggtttcggtggttgacaggtggggcccctggtagctttctcccgtgaaaaactagtgcggaggtgtgttggttttaatggctttggtttagatcccatcatggcttatgtggacgttaagagcaagtccaataatataaccaattgttggttctaaatcatttatatctaatctaatactctagtcatcctatctttctataaagttatcccccactaacttcttaagcttgacatgcaaagatgccacatcatcatctactaacaagataccatatcattatccactaattaacaagatgacacatcatcatccactaacaatcatcatatttaaacatcatgcaaacatactatatctttatagtttttataatttaagagttttttaaatacaaacatattaaattatcatccaatataattcacataatgtttcaatgtatatctttattatgttttatgatatcctatatacttatatagttcatccttagtttgtgcttaaataattaatctatggtccaaattatttttctccttttttttctctaattaagtcatatcacatcaattatttttagcctttagataattaatctacggtccaaactatctccctactactagcttactttttacatttgaatcaccattctacatactatataaatttaaattatcataaactacattaatttatttaatctgatgttatctagctattttacatgttattttttttattgttatcatactgaattcccgcagcaatgcgcgggtttcacctagttggatataatagttactccctcggtactcataaaggaagtcattttggacagcgacatggtctttaaaacacaactttgacctattgtttctataaaaatatttattgaaaagtgatatatgtatacttttatgaaagtatttttcaagacaaatctattcatataatttttacattttcaaactcaataacttgagagttatttatgatttatattcccaaggtttgacttaaacattatccataaaggaatagaaacaataggtcaaagttgtgttttgaagaccgtgttgctgtccaaaacgacttcctttatgattactactccattaatactctgtcctacctctaatatacacataacgtcttagagtctgtgttacagccggctacaaatctgtagctcgcttttttctcactcttctcttttcttctcgatatgtggttatagttggtttatagcttgctattgtacctgctctatgcaagtactactagtactatctgctcggaacttggtagattctctctttttcaagtttctttttgtaagtttacatgtaattttgacaagtttattacgatactcgaaatctatgtaagagcagagattaataaatgatgcgctaccatagatcatggttgagatgataacaacatttttcgtatgaccataacaggataatgtttacaacaaaaaataatactgatattattaagcttgatatggccatacagcgaagcttgaaattgaaattaattaagcacaaggtggtacaatgatattagtgtgctaacccaagataatgtctattgataaaaaggaaaatagccaaaacaatgtagcttgcagatcaaaagcggacaaattggataagtctagtgtttgatcatgccatacgctagttgaattctagtggacactactaaattaccgacaagttgaaacgacgctgctactgatacggataatcaatatttatcatggatataaaataaaacgagagaacatgaactgagcataactttttttatagtcaaatctacacatttagattcaaattcttaaacagtacgggtgttcgaattttttgctaaattataattcatgtgaaaggtcacaagaataaaatgtctagtgataaaataaccagtttctttagacataggagtgatttatgccagacattttgactagctcttaacataaacataattagaaatggaactttactacaatgccaaagcaccacgggttttgacgctgaggcccaacaccttaacaccgtggaatatactacgaaaacaataataggcacaaatgggggggggctcctagttagcgcagacgcgccagataattttgtagcgcgcacttccgtaacttcctcctgtttcgacgatctgtatatttttctgttccgcatcgcttcaggggaggttaagcgtgtgggtccactacagccacgcgtcattagcactaataacaacgctaaccatatggattaatctagttatagtttttattatcaaaataatacataaatagttaagttgaaagtttcgaaaatatgatgaaaattttcaaaatctgagttgaaagttttaaaaaaaaatcttgaaagtttcaatttcgagttgacagttttgaaatttgagttggaagctttcaaactcgagttggaagttatcaaatttaggttgaaagttttcaaatttgggttgaaagttttcaaatttgacttgaaagttttcaaattttgagttgaaagtcttcaaattcgggtcgaaagtcttcaaaactcgagatgaaagttttcgaaattgatttaaaagtttaaattttgagttaaaagtttttaaattttaaattgaaagtttaaattttgagttgttttaaattatggttgtgacttttaatttttcatctataaaaagttttaaatttcacgtatatattttaaatctttagttaaaaaatacaacctcatgaaaaaaaaggaaagattaattaaaaaacataattatcggaaactaattccgtcaactaatataatcttgattattttctccgaatctagcgcacttgagcacgcttcccggtgttccctcgcgcaaaaaacagaaatagaagtaggccgaagagaaatcacgtacgaggacatgggcctaaaacgcacgctagatggctagttagcgcgtctgcgctaattaggaaattcgcaaatgcaggttatagcatgcgtactgcagtgataaatggtgtctgtattatcttggagatcaatgtttgaatctttatcgctgcaatattgtttcctttttctttcgaagtgctgaagaaaaaaaaaaacaagacggaacagattcctaannnnnnnnnnnnnnnnnnnnnnnnnnnnnnnnnnnnnnnnnnnnnnnnnnnnnnnnnatnagagctgcattaatgccac

SEQ ID NO: 50565 - DNA, 1086 bp, Oryza sativa
  unsure (1)..(1086): unsure at all n locations
caaaatgcatatgtaacgccgtatcgcctaattaggaaatctcgcaaatccaggttaaagcaatgcgtactgcagtgataaatggtgtctgtattatcttggagatcaatgtttgaatctttatcgctgcaatattgtttcctttttctttcgaagtgctgaagaaaaaagaaaacaagacggaacagattcctaagtggcaaaaaaacaacgataacgcagattctgaagtggcgaaaaaaaacaagatagtggaagtgggtttggacctagcaccttcacaccttatttagaaacaatgatagtgggcctcaacaccatgacccatgacgctgagatagaaatctatttttggtttataattttttagtttgtgtattactcgatgccaaaatatatgatgctaaggattcgtttggagagtttaaagattttaagaagctgctggttgatacccaacttctgataatatgcaaaaaattgagttcaacttctgacttctagcttatatgaatgaaaaacttaattattttgggagttttcgattcagggaaaaaatagagttttccaaagctttttcaaacaggctctaagcttctaatttcaacatcaagggtaggggtggatactgacatgactcggctcggtctactcgttaggataacgagccgaatcctaactcggctcgactggcaactctagctagcttgtttagctcgcgagccaatacatccgtgactcaatagaaatctctcacttcgagattctggctgccaacaattttttttgcaattgcttaagaaatcaaacaaccgacaaatcacaaagacttggcacaaatttttttttacacattgcatccataaaaacagatctgaaagtctcgtcatattggaaccaaacaaaacaccaagcaaacaccctagtgaatcctagaccaaccaaaattaacatgggagattgacttgccggagtgccgaactgccgacggcgacgaggacggcaagattgaacttttgctccttgatttatactcgtagcgctgtcgatggagatgcatgctcttgcatnctgcagcaggggacc

SEQ ID NO: 50566 - DNA, 2062 bp, Oryza sativa
  unsure (1)..(2062): unsure at all n locations
ctgggncnnnnttggaacgtcngtnnnnnnnnnnnnnnnnnnnnnnnnnnnnnnnnnnnnnnnnnnnnnnnnnnnnnnnnnnnnnnnntgccactgtaaatgtggcaaattagaaaaataccactactatttgttttattggctaggtgccactacaaatttttaaaattgaaaccatgccactccgtcactatttctgtcgttctctctcacgtcgtcatcctctaatctcacgtaggcacggcgagggcaagaagacgaggcggccgccggcgaggacgtcgcgagcgcggggagcggctgcggccacggccggcgaggatggagacggacgccgagtggttgaacagcagcttgccgacgtcgcggacggcagagccaacaggtcgaggaggcggagtggcggagttgccggccggcgtcatggccgccatgccgccgtgctaaccgtgcagaggctgcatccacgccaccatgccgccatgacacgcaccgcgtgcttgacgcatacgaacatggacctggcattgacagccatgacgcggtcgtactcgtcgatgtcgagcacgccgagcgagtccggagcctgtgctcctatgatccggcgttgctgtaaaggacgtcgaggcggccgtggcgcgtaatggcgaggtcaacggtcgcggcaacatccgccttgacagtgacatcgctgtgcgtgtacaacgcgcgtcagcgccgagcttggcagcgacggcacggcgttcgcccgctgctgctctcgctccccatgccatcgccaccgccggagtgccgccgcggggttccgttgctgctgctcctgctcccgctcccggagcgcgccggagtgccgcccgcgacccgccgcgtcgccccgaatcgtcaactgccgcgccgtcgttgggggcgggctgcgccgcgacggccttgtgctgctgctgttgtgtgtaccgtcgctaccgtaagtggtggtcgccggggaaccgagncggcgagccaccagactagctcgtcgncggggctctccctgaccaagccactatgcacgcagtccatggagaacgagagctgctcgtggaggacatggagatgcacggcgaggataagctcctcttcctcaacggcgtccgacgagaaaggtggtaatgcatagcggccaaccgcgcgaggaacgaggcccgcagctgcggcaaccggcattgtgaaaatcaacgatgggaacggcgccgaaggtgaagaagatgaagtccgatctccccgttccccgtgtctccggctgaggttcttgaggcttcttgaagaggacgtcgaggcgacgacggtggcgccatggcttgctccggcgtgctccggtttgacggcgacaaagacgatgtcccggtgatggcgtctagtcccggcagcccccacggcggcacggaccatagagttaggaaattaacgggggaacgacggaaaaggcgacgggatggcatggattcaatttcccaaaattccagcggcacctagccaatatcgtaaatagtagtggtatttttctaatttgatacatttccaatagcatggatccaattaaccctagtttttatcataggtcatttatataacaagttttgtggaagattcaaaatatcatttttttggcaatttatgtcccaaatatactaccaagcataaaaaaaataaaataccaattctatttctgccgtgaattattatggaagtaaagagaaaccgttcaaatgataaggaaggcaaaccttgcagagaagggaattatcaatcggaacacatcgctgcgnnnnnnnnnnnnnnnnnnnnnnnnnnnnnnnnnnnnnnnnnnnnnnnnnnnnnnnnnnnnnnnnnnnnnnnnngtccagtcgaantttccaactctctttnttnntttnttntnnntnnntntacnnnnnacacacatgttatctttttatattagtgagtgacanaaanaaatanacaacntaatattaatcaagataaanaannnnaaagttacgntncancagagcgttaaatcaaaaatanacgcagtagatgtaca

SEQ ID NO: 50567 - DNA, 765 bp, Oryza sativa
  unsure (1)..(765): unsure at all n locations
ctggggnannatgaactcgaatacanattgcnnnnnnnnnnnnnnnnnnnnnnnnnnnnnnnnnnnnnnnnnnnnnnnnnnnnnaggaaattaacgggggaacgactgaaaaggcgacgggatggcatggattcaatttcccaaaattccagcggcacctagccaatatcgtaaatagtagtggtatttttctaatttgatacatttacaatagcatggatccaattaaccctagtttttatcataggtcatttatataacaagttttgtggaagattcaaaatatcatttttttggcaatttatgtcccaaatatactaccaagcataaaaaaaataaaataccaattctatttctgccgtgaattattatggaagtaaagagaaaccgttcaaatgataaggaaggcaaaccttgcagagaagggaattatcaatcggaacacatcgctgcgcgtgttcatcatactacctacgaaagtacgaagccgtcaggaaggaagagcccttaaaaaacgtttaccacttaacccccttgaaactccttgtaatcaccatcccaccccaccccccctccgtccccccacggggctcttcttcccccggttattcgttcgcctctcccaaaaccctagccctccgcgagcgcgcgatccccgataccctaaccccgccttcccctccacatcggcgccgtcccatggcctcccggggagcctacgacggcggctccggcgccggaggcaagatccggaggcgccccccc

SEQ ID NO: 50568 - DNA, 2332 bp, Oryza sativa
  unsure (1)..(2332): unsure at all n locations
nttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgctagcatttcagtaactggtaggcataggtaccgccgatatatcttttaattgcataataccccaaatacagcatacacctaaggaactgaacttgatctgcaatgatggggtacatccatgaagttcataacacagcatcacactattaccatgaaatgatttgtactaataataatttctatgtgaccaagaaaatataaaccatgaggctatagaaaacatgggtttccctaactggtttttctttttttaggagaaaaagaagtgtacttcagttctaaagctgggaactaagaaatggacagttgtatggcatttactttggtattagttagttgtagaaaataccattgacatttctggaaggttctgttaccttagataatttttcttacccgtgtcttctttttctcatacgtttgtttatgctaccacattctctcctgtaccttctcccttctttttttctcacttaccgagaccaattttctgtggtgaagttatacttcattgttaatgtcatgaaccgaggccatgatggcataaccaccactgggagggtagccgggcggcgccggctattggagaagggatgtatatttagactagggataagaagatattaaggaaagaaattatactaatctgattcattgcttaatgataatagacacaatcccatccttatatagattatataacttgatccttaagtaaggactcaatctaatctttgactgataatcttatctctatatgggctgcttatggccctcagccttttggctcaatgctcatcacaattaacttactttattgtagttccatttaggctggtatacattggagaacactaagaaaattgatacatcctgcatagaaaaagaagttcgcattttctttgtagcagttaatgcatcagcctgcagttgtatatgatttgcgtacatgatttgtatggagtagcaatgcagttgggggaacacatcttcttgatagttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaatatgaagaaaatgcattttcctgagaaggcaagtcgatctggagacttacctgttgatttctcctttagaacattcaacacttctgttaatacgcaagtcatgttgctcactaaatattcctgttcatatgatgaaattgatttcttttacaatcacccatactgtactgtacagaacataatttaaagtgttgaagcaacaatataatttcttatttttaagatactagaaaaaatgcccgtgcgttgcaatgggtaaatgctattttaattttattgttgttatatggtttagctagggtaaaattcactgtgggaattcgcttggatatttttttttgaaaatcataagctgcaagagtccgtatatcatctcaagttagcatgcgagtttttttaatgatatttcttatacgactccttctgtatttccaaaagcaaatgagcttaaaatccaactcaaacacggatctgtatttctaaaagtgaacgaacttaaaaaccgactcaaacccggatgacataccaaaataccggcaaaaacatcttcaatttttataatagtagagatatggcatattgttgagttaaaacccttgaccagcagaatagtttgttatttttttttcgaagttgaggaaagcatatcataggtcccccttattccctaaatttttgcaggtcacttgggtctctggatttgagtgggtacataaaattgtataagtgggtcaacaaagtcatcctacttttttttttggtatacttcgataggaggcctgtggttgctttttggcatggtttaacctgtacttatgccattcacattttaaggccctattttccattttccactttagaaaccaaa

SEQ ID NO: 50569 - DNA, 1590 bp, Oryza sativa
  unsure (1)..(1590): unsure at all n locations
tggggcggngnnaatggaacatcaatactccaactatacacgtgacactattcaaacttgcgcttgcatgcctgcacgttaactgtacaggatccccaccttggataatgcatcggtcaatctcactggataatactagatttgaaggagcatgacttctcaaaggcaatgttggaggtttctccttgtttattattccagaactcatatcattattctctgggattggtgattgctttctctcagttttatcatttccttggttgagtgacaactttgtacttcccctacagttatccatctccaaccaatcctacaataaagaaaatgtcagtatgttgataaaatattatgtaccctaggaggaaaaaggtgccatccaaacattaccttgggcatcaatttagctgatttgtcagatgtagcatcaacagtattgctgtcttttgcggcggaggtaaatttagcagcgcagttggagttattaggtaaagactccttaactcgtgacgaagatggtttcaaaagactgccctgtgctgatacttcagttttctgagaaataggatcctcaacatctaagatgtccacatgcttttgccttgttgctaatgtgccttccttctgtgaaggaattatcgtatcaagctgcttcaatatctttgcagccatttgaattgactgtgctggtgcctgaccaaaactgctatcatttgctctgtcatgtacaccacttcgagtaatatcaccaactttatccagacacctacgtttttgactttgtactgagtgttccaaaccttcatcaagtttgctagcatgactaccactatatccacggtggcctgaccgagtttgcaacagtggtgacactctgttgtacctctgatgcattttgcgtatgggaccaacagaggcactctcgttattgagagcagcactcttcctcttcagaacctgttgattcattattaacagtaaatgttacatacaaggtagcatcaaatctaagcaggtaggacagcagcaaagaacattaagtggactgtagcccacaagtaaattatgtaaccatgaaaatttgcacaggtatccaattcaaaataattattaggcatttaaacaatgttatgcactattggtcatttaacataaaatatatattgtccaaatactgtgtcactaactgctagcaatatataaactgtaaatcacatcctggaaattagtgtttgctatatttatgcattcggtaactacaatagtagggtaaaaccttaaggtagtgcaaacagtgtaaatgcagggcctgaagaagtttaaggtaaacagtgcaaacagtggtggatgcagggcctgaagacacttgtagggacaccaggcctcaccatcacacagcaaaatggagggcatgtcataccactagcgcttgatgacgccagatgctagctgaagttgtttttgcccaagtctagaaaacttctaggtacaccactaattgccaannnnnnnnnnnnnnnnnnnnnnnnnnnnnnnnnnnnnnnnnnnnnnnnnnnnnnnnnnnnnnnnnnagccgttcatctgngccac

SEQ ID NO: 50570 - DNA, 2378 bp, Oryza sativa
  unsure (1)..(2378): unsure at all n locations
ttttcgactttagaaaccactttntagtagtccctggtacacatacttcttttttctattcctacatgagtttcacttgcgattctatctacatttgccacaaaatagcaaagctcgtaccatgaactattttatctcctgacacatttgttgtttataccattgatatgccatatgttccgtgactacaagggtaacataatctcatgctattcattcctgcaggatcaagttgcttcacctgcagaacttgcaaaggcatacatgggttcaagatcttctaagggatcaccattacgtcttagattgcatgacccctctgtactttccaaatcgatagaagctaatacaacacaaataacgaggcctcccaccctctctctgctcgcgagtgcaagaaatcatgctccaaccacctctgatcgtcttgggagcaactacacgacaccaaatagatcagcaatatacaaaatgtcatcatctccttattttaaggttctgttatttcctacttcatttaatgtctaattactttatgcccgcagtatttctgttatgtatttgcacaaagagcacaatagtacatcagatcttgcatatttgttaaatagaaaaattgaataggtagccacagactacttgagaaactcaaagagacaactaaaaatgtattacaccttaatcaatctgtttagtgcagcatggcaatcatcaagttaccttgattcaagtattatgttaccacgctgttgcagttgctctctctgaatttcattagtagaaaataaaccttccatacattattttcttatttggcctcttaaaatcacaatttaacatggaaaggtccaaggtgaccaagttgtcgtatgtatatctagtatatgagttaaatttaattagtgtgtgtgaacaatgccaaatgtgtcttttagcgaacaaatatcagtttatttgttttaagcaatattagaaattttataattgttctttttctatcgaaaacatgtgcaattagctagtgctctacatactgccttattttattctcattcttgagcacaataccctatctctgttactatgtggttacatctctaactcaagttcctcaatctgttcagagtgctgtttcttccagggatttgtttggtactgtatctccatatcaggctccaagcagccttcatacatttggaaggcaggtattaatcacgaaacataatcttattttgctgtaaatttgttttgggtttattaccggcttctggatttatgttgaactgctactgcatgacttttatcttggcttctttgtttgattagtgaatgatttatgacatgaaatgtttggaccttcaatattgatcactgattgactcaccacataattttgttgctttaaagtacacgatacaatgttaattgcagatttttttgatcggatgctgcctattttatgcgtaaaacacaagctattattttgaaatctaaagataaactagacgactctggaatatgttttcttgaaccctctttaatcatggtaaattggtaatagtagttggcaattagtggtgtacctagaagttttctagacttgggcaaaaacaacttcagctagcatctggcgtcatcaagcgctagtggtatgacatgccctccattttgctgtgtgatggtgaggcctggtgtccctacaagtgtcttcaggccctgcatccaccactgtttgcactgtttaccttaaacttcttcaggccctgcatttacactgtttgcactaccttaaggttttaccctactattgtagttaccgaatgcataaatatagcaaacactaatttccaggatgtgatttacagtttatatattgctagcagttagtgacacagtatttggacaatatatattttatgttaaatgaccaatagtgcataacattgtttaaatgcctaataattattttgaattggatacctgtgcaaattttcatgggtacataatttacttgtgggctacagtccacttaatgttctttgctgctgtcctacctgcttagatttgatgctaccttgtatgtaacatttactgttaataatgaatcaacaggttctgaagaggaagagtgctgctctcaataacgagagtgcctctggtggtcccatacgcaaaatgcatcagaggtacaacagagggtcaccactggtgcaaaacttcgtcaaggccaccaggggatatagtgggtagccatgctaagaaaacttgatgaagggttgggaacactcaggacaaaggtaaaaaacttaggtgtctggattaagctggaggatttacctccaaggggtggacatgtcagagcaaaatgatacaatttt

SEQ ID NO: 50571 - DNA, 2402 bp, Oryza sativa
  unsure (1)..(2402): unsure at all n locations
gcgttgancttcnnnnnnnnnnnnnnnnnnnnnnnnnnnnnnnnnnnnnnnnnnnnnnnnnnnnnnnnnnnnnnnnnnnnnnnnnnacattagcaacaaggcaaaagcatgtggacatcttagatgttgaggatcctatttctcagaaaactgaagtatcagcacagggcagtcttttgaaaccatcttcgtcacgagttaaggagtctttacctaataactccaactgcgctgctaaatttacctccgccgcaaaagacagcaatactgttgatgctacatctgacaaatcagctaaattgatgcccaaggtaatgtttggatggcacctttttcctcctagggtacataatattttatcaacatactgacattttctttattgtaggattggttggagatggataactgtaggggaagtacaaagttgtcactcaaccaaggaaatgataaaactgagagaaagcaatcaccaatcccagagaataatgatatgagttctggaataataaacaaggagaaacctccaacattgcctttgagaagtcatgctccttcaaatctagtattatccagtgaaattgaccgaaacaaaatcctagcatcatcaaatggcttttcattcccggttccggctgctctgactggccattctcaggcccctccaacacctactttggcatctccacctgtactatctgttgagaagcagcagctgtctgcatcatctagtgcaccagttacttcagtggaaagtattccaaggttagtttctgatcggttgtttgaactgatgtagttacagtcaaaagcatagttttaaatttgaagtacctttgcaatgaaaatgggcaatggttaccaagtaggttaacacataagtacttatgttatcattttatagtgttttttgacttgattgtcgttttatagttgagatatggtagtctgacacatgccaattatgcttcagtttccaatttatgaggatactcacttatttccagcacattaatctgacatgtctttttctccagggttttcaaaccagtttcagaagaagcctcagtttctaaccaacgtgatacaaagtcgaatacagataaaccaccaatttctcaaagctctgggcaaattgtttctttcactagtaatccagtatttaacgtcatctcctcaaaaccaacaaccttaagcaatggcctggcagatacaacaaaatctgcttctgctgctgtatttccttccaatggatcaaccaagtcagtttgttctacaaatgctggctcttcaacaccttcgttcccaaagttctcatttcagcctggattccgaacatcaacctcttcagtgcaatctagcggtattcaagagcctgctataacagctccattcagcactgtgagtagtttagctgggggcagttcatcgccatcctcaatgatatttgctggtgctacttctcaatctagttccatcaccaccagtggcagtgttcccttccaattctcttctcaatctagcagtgaaagttcattagctggccaagacaaatccaaggcagcaagcagcagtgccccttttagtttctctccacagtttggcagtacaagtccgtttgcaggccagggcaaatccaattcagtctcctctcagtctactttgctgtctggaagccaatttagcaattcactatctgcacagacttcaacaagcaattcaaacctattatcttcagaaaaagtaaatcctgggagctcgccaagctttgcatttggttcatcagcaccaggctcaagccctgtgttttcgttagcagttggttctggcactacttctgcaacacctgcttcagcatcttcaccaattttttgcaaccgtttaactagcacaaatgctccaccttttggctcccctgccacttcaccttttagctcaacctcgagccctgtattctcatttacctcagctacgcctacgataccaaatgcatcacctacaacaccactttttggtacaccgagcccgactgttggtttaagtacaggaactgatcagatgaatggaggtcagatggctggggacaagaacccgtttgctttttcagcagcttcaccctttggtcttccaagcagttcaccatccactccaactctgtttagtacgccagcaactcagtttgcttcagctacatccgcttcaccgggcatgttccaatttggccagcatagtcaatcatccccaggtggcttctcaataggcactactggtggcaacagtgaaaagtctgcaagaagaattctaaaagttaagcgaaagaannnnnnnnnnnnnnnnnnnnnnnnnnnnnnnnnnnnnnnnnnnnnnnnnnnnnnnnnttactaagctggcgatccaccacg

SEQ ID NO: 50572 - DNA, 2022 bp, Oryza sativa
  unsure (1)..(2022): unsure at all n locations
cgcgcgatgaatgcactcccatttncacnnnnnnnnnnnnnnnnnnnnnnnnnnnnnnnnnnnnnnnnnnnnnnnnnnnnnnnnnacattggtcatcgccgaggctttctgttgtgtcgccgctgttgccacctgctccccgcccgccatgtacagggttcgctaccacggccaactacttcggccaccttgctggctgggtggctgccgccgccaccgctgctgccgtcttccggccactgccacctaggcaggtcgctgtcgtcgcctggaccgtatggttcgggaataggggaaacagcgtcagggccgattgaggagacagatttctgctctcattttcttcttttacgtatatcaggggtagaaaggtaaatcaataaattccaaaatgattattcctctttattcttattattttgttatcttaacaattccagtttccgggccgggtccactaacttccataaaaaaagagtaaacacctccttcatttgaaaaaaatgggcaaaaaacccaaaactcgaaaaaaaacacgagcaaaaccataattgaacattaaagtaggagcaaaacaaaattgttcctaataaatataagtcgttttacgtaagcttgcatataaatattcaaaaatggataaacagtccatgtctccatttagggctgatatagctagtgtaatatttttttttggaggaaaggaaagaattggttttacagatgtcaaaggaatttcataggatatatagagaaattcctctacattttggagaatttctagcataagatcttcaaatacttaggagatttgcaatctaacttatgtatctttccctcctttctatctataagaaatcaccccatttgccgcgcaagggcgcagcaagccccacgccctagccgccgtgactggccgtcgctcgtcgcgcctggccaccgctctccacaggaagacgagcctgccctgccgtgtagcgtctgggagcggttgccacaggaagtcacgttgccctgactctccacgcctaggagggctgccgtaggaagccccgtggccgccgccctgccggagacttgccggagtgtcgtcccacgctcgccgccgccgccgtgtaggtctagggttttgttgttcactgcacactcggtgggcaggagaggactcaatccctatctattcactgcacacttttttgattttttcatttgcctttctgtaacacaaaaatgtggggtctatcgaacagccgttaaaagtaagggcaaacgacttgtttgttttggaaaagtgggggcaaaattgcaaaccctaaaaaacgggctgtcggccgacccaccagttgccgtggtccacaaaaaactgaaatttgagggaaaaaagggaaaaatttaggaaatatagaaaatatgttggaaagataggataaatatgaggaatatatgaaggaaatcgggaaaattgagaaaattacatggaaaaagtatatgggctggcaaggccaaacccgtgccgacctacaagataaggtgttggcccaagaaggagatgcaaacagactgggcaggcacggcccactggttgcggatcgatatgtgcatactacttaacggagtatatatttgtacttacggttaaaacagcttgcagatagaaattacgtgcatatgtttgtaaagtgatatcgcatagatcataatctattctgttaaattttattacattcgatctttcataactgattgaccgagttacgtacaagaaacgacggaacatttttcgacagaagacacatgcaactttcacatatatatatgaagttgtacatagtaggggcatacatccaccatatgcaagcacaagcgcgcatgcagctagcattcgcttatttatctacatggagccatagcaacaagcttctaattcagggggagannnnnnnnnnnnnnnnnnnnnnnnnnnnnnnnnnnnnnnnnnnnnnnnnnnnnnnnnnnnnnnnnnagntgctcatcnnggcccac

SEQ ID NO: 50573 - DNA, 2129 bp, Oryza sativa
  unsure (1)..(2129): unsure at all n locations
atcgatgatgctcganggancgatgantgacatcgaacgatcgttgttnttctactatattgatgcacggcgtctcctattntattgacgaatagacgatgtcgataatantangacttncnancnnnncnnaagtgatgaatgcactgcacacttgacnnnnnnnnnnnnnnnnnnnnnnnnnnnnnnnnnnnnnnnnnnnnnnnnnnnnnnnnnnctctccctctaacccctctccttttgttcgttaggaggttccgaagctcgtctcacggtcgccatcgccctccgtcgctcgccgtcgtcgatcgtcgtcggtagggcttctcctcccctttctccctctctcccgcgccggttagccaccgcgccaccgcttagctgcttagccgccgctatcgccgccggtcgccacctcgcgtcgccgctgcgtgcgcgccgcgctgccgcgcgccatggccgccgggccggcttgagccgtgcccgcgcgcgccggccgcgagccgcatccgccgtccgatctaccgggcagtagatcgaggccgtcggttcggctgccgcatggctgccgcgtggccgccgcgtgtgcgccgcgtcggcgccacgtgtgcaccactctctctcttgtggggcccgcatgttggcgccgctctctctctccccaggattttaattattgcgcaataaatcaattaaggatttttctgtttatagtaaaaacacagtgaatattccaaaattcatatctaattcatccgagctccgtttaagcccattcaagtctcagtaaatcaataaaaatgcatagattccattaaaaatggttttgttctctgtttcagtagtcttatagcctgtttgtattgtttgctttgtatgtcgcttagattccggctctcccaacgctccggtgtactttgaaatagtcgccgaggttcctccagcagcagagcaaggcaagtcatgcttgtcacttgaacatgttgatcctatattgcaaatgttttactgtttttgttcaaatattgcattgttttacaataatactatgggatgtttacctactgttatagccatgctatttttgtaccatgctcctttgttagcttgggatatgacatgactagatattggactagggattgcttagccatgcttagttcaactagcacacaatgggggaaatcatataatatatagacttcaggttctagtgttgatgttggattagtaccaccgtcctggtgttgctaattaaaatgaatcctatggtgggctgtgggtgcatggttttgctagtcgcgcccatggcacttaaggactggttcgtgggaaaccctggaagaattcctcgtacttaccacaagccagcgtgggcaatggctaggcttgtagtgtagctttcctctagctgacacatccaggcaagggtgggcgtgatggagcggggcgggccctgcgacggcctctgtcgcttttggattcacctaggcacgagaggggactgcccgttgcccgctggggacgggggtgaaacttgaggtgtggtgtgcttggctagagggggttatgcgaagggtcctgtcacggcctctttccggtatgtcgtggtggcatgtcggcacatggaaacatgtcgtggggctgtgtcttgtgggtacagttgtacacctttgattagagtaaaactattcgaatagccgtgcccgcggttatgggcggtcaaccagattcaccgtgattagattcaccctagactagtctaatggaattgaatagtataggtggatggttgggcctgttgcaacgtggtatagcattggacagtggatgattaatattgattaattattacaacggttttactactttcaactactatttataaatgctcgctttatgcaaaggaaccattatagctatcccttgataattccctgcatcatacccctattccggtatgacttgctgagtacagggggtagtactcagtcttgctatattttccccaaaccccagaagtttgagtatgcgtaagatgggggcttctccgaggaagaggcttctgtcctgcccgtcgagatacttgtggagtggtgttcccgctgcgtgcaagtcaagtttatctn

SEQ ID NO: 50574 - DNA, 905 bp, Oryza sativa
  unsure (1)..(905): unsure at all n locations
gccaagtctggtttccaggcgtgctcctttctcgctttgttggaggtccgctcttgtgtgccacgcgtagtttggaaatcaaacttccagggaccagaagcccaaccgcccggtgtccgtccccgtggttccttgttgcccaacgctttcgtgaggaggtcgtcctcacgtctttgagagcaggcctcttgcgaggcttgttgctcggcaaccaactccatctgcattacaatttagtggggttaaataaactgcacgatgggaaacaatgcgaacatctagtttgactagacacttactatagcttcgtacactcgttgatcttctgcatttggcatgaagattgtgccatcatcattcttctggtacctggccctggcccagttcctagcccgagggtgtgggatatcgccaaacacgagcggtgtgcatgattcctccgcttcttcatcctcacgttgccattcctcttccttactggcatatccggcggtgcccagccggtgcggatgctggttcctggtctggagcaagagatatgcctcgcttctagctctggactcgggggtcgacttcttcgcatgtaattcctcccagacctgttccgtgatccaaggaaatttctctcttggatctagattcgccgggttgtagacgaactcgccgactagcttagtcttgaagttcttccaagcattgcccataaccttgaaagcagcccgcctgagacggtcctcatgctccacaggataatcaaagctctccttgaacattagccaagcaatgtccttctctgcggccggcatgagcttgannnnnnnnnnnnnnnnnnnnnnnnnnnnnnnnnnnnnnnnnnnnnnnnnnnnnnnnnnnnnnnnnnnnnnnnntaaatgcaattcatccat

SEQ ID NO: 50575 - DNA, 1959 bp, Oryza sativa
  unsure (1)..(1959): unsure at all n locations
tatggtgaaaacttttgatagacnnnnnnnnnnnnnnnnnnnnnnnnnnnnnnnnnnnnatccatatagatctcctcctccaactctccattgaggaaagttgtcttaacatccatctgatggatgactagaccatgagaggctgccagagtgagtagtactcgaatcatagtcaagcgagcaaccgatgaataagtgtcgaaaaagtcctcgccttctttttgggtataacccttggccacaagtcttgccttgtactttttaattgtaccatcaggcctaagttttttcttgaaaacccatttgcatcctacatgcttgcacccatatggacgctcgatgacttcccaagtaccattagacataattgagtccatctccctgcgtaccacttccttccaattgtcacttaatcagcgtcaagagaagaatatgcctcttcaatggttcttggagtatcatccacaagatatgcaatgtagtcatctccaaaagactttgcagtcctttctctcttattctttcgagtggctacaatgttatcctcctcaggattttcctcaagcgtttgatcaatgtgttctatcggcacaaagtgttcaggggataaaataggttcttggctagaagtgctaggtgcatttttcataggaaattcattctcaaaaaatgtggcatctatggactcagtaattgtaccaacacgcatgtcgggtactccagaattttctattaagaacctatatcacacactgtggatagcataaccaaggaacacacaatctacggttttttgttcaagtttacgctttttgactatatgtacatttaccttgggcaaacaaccccatgtgcgcaggtgagagagatttaatttcttcctttcccattcctcgtatggtgttacttcctgatgtttagtaggaattctattaagttacttcattatgtatgtaggctgggtgtgcttggtgctcttcttttaagtagcaagcttctttatgttgtctcagagcatctccaacaacctctccaagtgactctctaagctaaattttagctattctagccaaaagacgtctttcaacatcctctccaactggatggctaagccatccggctagccaaaactctcaccctccctccactagtcaaattaggaagctaaaaatcactagccaaccatgggcctcatacacattccacctccatctccttcggctcttctccaggacggcgcaggcggccacgacctcgacgccgccgccgtgcaccgctgcaaccaccagcttccggcaccgctcgatggctgtgagcgctacctgcatctccaggatggcgcagcggagcccaccagccgcaggcgcggggtcgccgccgcccggtgaggaggggccatggcggggttcccggggcagtgcgggccggcaggggagagcacgacggcatgcgcggctaggatgcggtcgaggagcgccatggcgcgtgggatctccgcgaaggcgtccgggctgagggcgttgagctgggcggagcggttgaggcggaccttgtaaaccaccgtggacgggtcgggcggcgtcacggcgagcgtcttgaacccacgccggagctccgcctcgagcaaggcgccgatgccgccgaggcgccctcctagtgtggcgagggagggaggaagcggcggcggggcggctcgacgagaaagaggattggagagaggggaaggaagaagaaagggggatgagaatgactggtggggtccattggttaatagagagtataatgcggagagtctgttggaatagaatgcaaatttgactctctaaacttttgttaggttggccaaataggtatttggagagctaaaaatgnnnnnnnnnnnnnnnnnnnnnnnnnnnnnnnnnnnnnnnnnnnnnnnnnnnnnnnnnnnnnnnnnnnggcaattgaattcaaaaccgg

SEQ ID NO: 50576 - DNA, 2318 bp, Oryza sativa
  unsure (1)..(2318): unsure at all n locations
ccggccagttatccagctcnnnnnnnnnnnnnnnnnnnnnnnnnnnnnnnnnnnnnnnnnnnnnnnnnnnnnnnnnnnnncatatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacactaacccgctcctccccccgcccacaccactccattttcttcctcatctccggtctgcaaaacggtagttaaacaacggggatatgttcgccgcgaaatcaaaccggggaagaatgtacatggcgacgaggagcgccgccgccaggctgctctcctcctcctccgccgccgccgccgcctctcccctttggtccagacgccggcgccgccatccattcctccatccgccctcccgctccaagaccacctcctcctcctccagcagcagcaagcctcctcgccgcccaccgcctcgcaaggacggcggcgggccgcgcccgtgcctcttccaagaactctccggtctcgtcgccccatccgccagcgatgaccccgcgtttcagcctcggcgagatgggcaggagcggtgtggcctcctcggccatgacactgcgcagtgcgcggaaggtgctcgacgaattacccctgagggagcggctgcggcttctggttctttcaccggtagcgttccgaacaatgacgctcttgggttccttcctgatggtgggattgggcctcgtagcactgcaacaggcggtgctccggacagtgagcaatctatccaggaggtgggcgatggaaatgctggagatgttgagaatatcagtgaggttgtgcatagggtaacagaagttttgcgggcagaggtgcctggattgtctgtggaacagaggctggagaacctgggagttacatatacaccgaggcttgtgagcttggtgctcaacaggtgcttcaagaagaggcatttggggttcaaattctttgactgggttaggcaagttcctggattccagcacaccacggagacgtacaacgcaatgctgtacattgcgggtgaggagaggaactttggggccatggagaagttgatggatgagatggataaggagatgtgtttgaaggacatcaagacatggacaatcgtcatatccagttatgggaaggcaaggcagattggcaagatgctatctacctttcaggctatggggaaatcgagacatgtggcagcagatagtaaagtttataggacgatacttcatgctttatgcaattctgcaaagtccgagcttgctcttgagttctacaaagatatggcaaggaacacggaggttggatctgacatttttcgacttctattgtgttgtctcgcaggatcagataatgctgaaggtgttttttatgtcagagatgatatgattaagagcatgaagtatccagaggagtattgttatctggaagctctacggagcttctgtgtttcaggaaaaatagaagaggctcagaaaatcttccagcagatgatgaacaagtccattgctagctcatctgcatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnantnaatattaattatattataaaaaatataatattaaacaactaattataaaaaaaattaaaatttncaaacaaaatattaaaatatatattttcctatcaataatacatatattttataatatttaaattcataaaaaaatattatcttagctaaaaactaatcctgataaagccaactataatattttttaaattattgatgataaaaaaaaatataatatcagttacactatgtggaatttattttacttttcacaatcttcataattaatattattttacaattaaaaaaaatattacaaattaattttttaatttttcaactatatcatataaaaacgatacaatttttgcttaaatataattcaattttatatatataagataataaaacacacttttttacttttatttcattctataacctgttttttctaatttttatttattttagttactctaactatccataaaatttgttttttacaaaaattcttatctaccataatttatttcttactac

SEQ ID NO: 50577 - DNA, 869 bp, Oryza sativa
  unsure (1)..(869): unsure at all n locations
ttgaacccgttgaccaaaaatcgatatggagaatagagtagaggaggtacacagaatcaatgccaggtttgtaagaacagatgacattcaaatttaacaaattggcaatggttcatgagaggataatcatcaaaaattcagttcaaaaaacagtccattgggtacctccatagctcatgtgccaaaattcggatcagccaaaagaaaacactggcatctttgccagctcaggcaaacactcctggtataaaatgaagaaatgtgaatttctgtttgccgatcgcctcagccctgaaaaaccagagcaatttgcaatgcaggctgtaataagttctcatgatccttgtccttgacagaggacgaagtgacttatttctttcgcttaacttttagaattcttcttgcagacttttcactgttgccaccagtagtgcctattgagaagccacctggggatgattgactatgctggccaaattggaacatgcccggtgaagcggatgtagctgaagcaaactgagttgctggcgtactaaacagagttggagtggatggtgaactgcttggaagaccaaagggtgaagctgctgaaaaagcaaacgggttcttgtccccagccatctgacctccattcatctgatcagttcctgtacttaaaccaacagtcgggctcggtgtaccaaaaagtggtgttgtaggtgatgcatttggtatcgtaggcgtagctgaggtaaatgagaatacagggctcgaggttgagctaaaaggtgaagtggcaggggagccaannnnnnnnnnnnnnnnnnnnnnnnnnnnnnnnnnnnnnnnnnnnnnnnnnnnnnnnnnnnnnnnnnnnnnnatcactcacg

SEQ ID NO: 50578 - DNA, 2248 bp, Oryza sativa
  unsure (1)..(2248): unsure at all n locations
cgattcaatgaatgcacctctnatnnnnnnnnnnnnnnnnnnnnnnnnnnnnnnnnnnnnnnnnnnnnnnnnnnnnnnnnnagtgcaacgaggcctgacatctcatttgctgtgagcaagttgagccggtttgttttaaatccgggagatgatcattggcatgctcttgaaagagtaatgcgctatctaaaannnnnnnnnnnnnnnnnnnnnnnnnnnnnnnnnnnnnnnnnnnnnaaagtactggagggctatagtgattcaaactggatatctgatgctgatgagataaaggccacaagtgggtatgtgttcacacttggagggggcgctgtttcctggaagacttgcaagcagaccatcttaatgagacaatggaatcagaactcacaactttagatattgccacagttgaggccgaatggcttcgtgagctcctgatggacttgccggtggttaaaaatttcagtaccagtaatcctgatgaactgtgataattaaacagtgattattaaagtgaacagttcgaaggacaatatgaagtcatccaggcatgttaaaagaagactgaagtatgttagaaagaggaaaaactccggagtgatagcatttgactataccctgacggctaaaaatctggcagatcagtttatcaaggggctaccacataatgtgatagactgtgcatcgagggagataggcttgagacccacttagagatgcacaatggtggtaacctgtccattatgatcggagatcccgtgaatttggatggcaaaacaaactattgggtaactgagagaagagaccctcaaaatgagtttatcttcatgatgtacttctcttctattctgtatggtacgatggtatacaccttaatgtgatccgagtggcttttcataaagcagagatgtcatcctacagaatatcttagaaggaacacacctatatgagtccaattgctagttatagtctatgagatctgggtaatctctagatactcatgaaaagtccaggagtatgacttatatgatccaaacagaggggatgcaaacggcagcccagtaccagttaagggtttgagtgaaacctgaatcgcacaagactgacaattcaatgcatagtccattgttcagttgtgatatggtgtagctcttttcctaggtggaagttcaacttaacagtctccatcaaaacactggtataactaacaggttcagttttgagaacatttgttgtgagccatgaaatttggtggggattgttggaataaataggctaggcccaatttaattcaactaaaatctcaagagcccacaagtaatgttagagacaataatactgccttgaaaatttaggtagaagaacctcaacttaaatagggtgatattggagattccctattgaccggttgaggtgatggttggactgctacacacgcgcgcgtgcgccgagttggcctcggcaatgggcgtggcgaggcggggcggccgactgagccgagcctgcctgctgctcttccgttttgtaatagacgagaataaagtcaccattaacaaatgaaattcattgtgttgtaacctccacaacgaatgagacattcattgtgttgtaacatccacaacaaatgagagatttatttgttgtaatctccacaacaaataatagattcaatgtgtggtaaccttcacaacaaatgagagatttatttgtgtggtaatggagatctctctatatataacgcaaggcagaggctctcaaagatcgaatcttcctcctgctgctgttcctacgtgatactctccttcagttcctgcgctatctctctgtttccccggttctgttcatcccgcgcacacgggtgatcggaacgagtaggtgcctccgaaactccgtccgcttgagaacctgcatgggtagacaggcgaagtttttggggagcgctacacgcgactgcttttgttcgtcttcctctgcatcgtctgcgccaacatgtcgaacaccggcgacaacagtaacattggagacaaggagaaggaggctcccgtcaacaccaacggaggcaatactgcttcaaactccaacggaggaccgttctcggggatataacgatttactattaccattcgttcttcatttcctactactatcagtnnnnnnnnnnnnnnnnnnnnnnnnnnnnnnnnnnnnnnnnnnnnnnnnnnnnnnnnnnnnnnnnnnnnnnnnnntctattncaaagncccagct

SEQ ID NO: 50579 - DNA, 1966 bp, Oryza sativa
  unsure (1)..(1966): unsure at all n locations
ntataagggataaaaatccaagctttccatttttagacacgttcaaagaatgagaaagatcattaagtaaatcaggagctttaagttatccctatgatgatttctatactagtgtaacatgttaggaaacgataggcaaacaaacgataaagaacaatagatcaatcacagaagacacgagattttaacgtggaaaaccctcccaaagcaggagagaaaaaaaccacgggcgctagccagcaaaatatcttcactatatctagggtgaggttacatcgctgcacggcggcttacaagaggtatatatatggtggaaccctaaaagggatgacgatccgtaccgtgggggctctgcccccgcacccccgggcgtccccaggtgcacgggcctccgctccactacggcgaagcaggtctttatcaaatgtaaataaatttggattacaactcaacataacattcttacatgtagcatgaaaaatacacaagcatgcatatctttttaagataaaggatagaaatccgaacagctagcctctgtatctgcaagtaaacagaagcatccacatatatatgtgtcaagtccagaagctagagcttgacgtacaacaggcacgttgagacgacgtacatcacaggggttgatagataattaagtgcagttcttgcggcaggagtcgccgcagctcgtcaagcattcctgcctcagcgcctgaaggcagctctggcaagcctccggcgagcagccgtcgcactgcggggcgcacgccctggggatagtgtctgcgtagatgcacgaagcagtgcagatgtcatcgcagctgccgcagaacatctttgccgcggccggcgcgacggaggaggacagtactagcacggcgaagacggcggcgacggcgatggccgccgtaggagagtttgccccggaaggcatgctagttgtcagcgtactactaattgtgtgggtcaagcaaagctagaggaagaagctgagatagatggagagcgaggaggagactgagattgatgctcggattaatggaccaaaccgatgcggtgcactggggaagatgcactgtgttgactatatttataggcagaaaacgcgacgctactatctgctcccttcgtctctaaatgttttaaccaacacaaatgaagctggaggataaaagtccttcgttaatatggagaaaaaaaacgacttgttattaaagagctctatagaacccactataaaatacaatcaatgtgagataatttgagaacttttatgttataatatattggtggtatatactgatagtataagtgatataagcgtttagattattttgtcctctcttattgtagtaggaaatttgaagtggtaaaattgtcttcctatactattagacggtagcaatgatagatgttttcctcgcttgatctcattcctcgtcatccttcacaattgcgacaccgccatcaaccaccacaatatataggatgactcggcattagttagaaattaaagcatgaaactactaaaattttatttttcatttcatggcaaatttctaaattgtctttgttatcaatatatacttaacgtaaaagttataggctaaaatcaggtttggaaattttggtttagccgatttgatcagacctcgccgaaatgctgaaatttccgtaattttgaataaagtttagttgaatttgaacaaatattaccaaaattcatgaaaaaaaataaaaaaataaaaaaattctgccgaaataatatcgtatcggaggggtccgaaatgaccgatttcgttctataatttccaaccctggctgaaattactttgagggatggaaggagtagctagctatccctaatcagtaaattacatgaccatnnnnnnnnnnnnnnnnnnnnnnnnnnnnnnnnnnnnnnnnnnnnnnnnnnnnnnnnnnnnnnnnngttctactggggccg

SEQ ID NO: 50580 - DNA, 924 bp, Oryza sativa
  unsure (1)..(924): unsure at all n locations
aacgggggtcatcgtggcggatgggcgacaagcccgaaagttcttggaaaaggcacgggcgcggcccgccgctgtccttgcaagccggtgggcggcgagaaggcttcttcttgctggaggaggagaaggtggtcttgaagcggaagggcggatgaaggaatggatgccggcgccggcgtctggaccaaagggaaaaaccggcggcggcggcggaagaagagaagacacagcctgccggcggcgctcctggtcgccatgtacattcttccccgggtttgatttcgcggcgaacatatccccgttgtttaactaccgttttgcagaccggagatgaggaagaaaatggagtggtgtgggcggggggaggagcgggttagtgttacggctcgccggcggagaacggtggcgcgcgggtgggagaaaaggcggggggcggcggcgccggcggcggcggacgcgacgctcgactcggtagagggtagagaggaaggggagggctgtgagacgatggatctccatccgacgtccgaaaaattatccgtactttaaagggtactttgctctttctttttttttttttttttgagaaacagggtaactttactctcatatggataggatatatgccactattactttacattctgatggctaggttagtccaagattatctaaattcgatgtttctgtttggttactgtagaacgttggacctttcgaatgcgttgaacaaccacatcacgaggtgatcgccggccttaggctgaggatgaagggcaattggagatagaggttgagatagataccttacatgtggatccagatgtatttnnnnnnnnnnnnnnnnnnnnnnnnnnnnnnnnnnnnnnnnnnnnnnnnnnnnnnnnnnnnnnnnnnnnnnnnnncgatcaacaaagnggcacg

SEQ ID NO: 50581 - DNA, 1832 bp, Oryza sativa
  unsure (1)..(1832): unsure at all n locations
gtggccaggtaggacactctgctnnnnnnnnnnnnnnnnnnnnnnnnnnnnnnnnnnnnnnnnnnnnnnnnnnnnnnnnnnnnnnnnactaccaatacgggactaaagatcgctatctttagtcccaggtgaaataaccgggactaaagatcgatctttagatcgagctgaccttttttttttgcatggccctgttgctgcatggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatatatatatatatatatatatatatatatatatatatatatatatatatatatatataaacaaaattttttttatctttaaagaaaatgtgctcacatgcattttgaaaaattaacttgatctatatacatatcattatgttgttctatatagatactattacgacgatatatttatatctatctaagaagctaaagacctatgtattgtttttccgccgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcataagtctttctctcatttttccgcggaccaaatgatggaaccgataccaagccctacatggagtttaaagctatgattcgtagtagcaattaattataacaagattcttaattaacataggaatttatgacagtacctgtttataagttcgaaaaccttgtcaaacgtagactcttttttatccattgagtcatatacgttgacggtgcaggcctccaggtcgaagagtaaaagcacccagtggaatctgcaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatnnnnnnnnnnnnnnnnnnnnnnnnnnnnnnnnnnnnnnnnnnnnnnnnnnnnnnnnnnnnnnnnnnnnnnnnnncctcg

SEQ ID NO: 50582 - DNA, 775 bp, Oryza sativa
  unsure (1)..(775): unsure at all n locations
tgtaaataaatatatatatatataaaatatagatatatagatatatatatatatatatatatatatatatatatatatatatatatatatatatatatatatatatatatatatatatatatatatatatatatatatatatatatatatatatatatatatatatatatatatatatatatatatatatatatatatatatatataaccaaaatatatatttacattaaagaaaatgtgtacacatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtattggaattggggtaccaagcgcgntgtcgcactgtgatcaagcaggtcacaagcgcggg

SEQ ID NO: 50583 - DNA, 1040 bp, Oryza sativa
  unsure (1)..(1040): unsure at all n locations
atttaaatttgggttaaagtttttaatttttaaattaagttttaaattttaggttgttataataatggttgtgcttttaatttttcatctataaaaagttttaattttcacgtatatattttaaatctttggttaaaaaatccaacctcatgaaaaaagaaggaaggattttttaaaaaacataattatcggaaacttattccgtcaaataatataatctggattattttctccgaatctagcgcacttgagcacgcttcccggtgttccctcgcgcaaaaaacagaaatagaagtaggccgaagagaaatcacgtacgagaacatgggcctaaaacgcacgctagatggctagttagcgcgtctgcgctaattaggaaattcgcaaatgcaggttatagcatgcgtactgcagtgataaatggtgtctgtattatcttggagatcaatgtttgaatctttatcgctgcaatattgtttcctttttctttcgaagtgctgaagaaaaaagaaaacaagacggaacagattcctaagtggcaaaaaaacaacgataacgcagattctgaagtggcgaaaaaaaacaagatagtggaagtgggtttggacctagcaccttcacaccttatttagaaacaatgatagtgggcctcaacaccatgacccatgacgctgagatagaaatctatttttggtttataattttttagtttgtgtattactcgatgccaaaatatatgatgctaaggattcgtttggagagtttaaagattttaagaagctgctggttgatacccaacttctgataatatgcaaaaaattgagttcaacttctgacttctagcttatatgaatgaaaaacttaattattttgggagttttcgattcagggaaaaaatagagttttccaaagctttttcaaacaggctctaagcttctaatttcaacatcaaggnnnnnnnnnnnnnnnnnnnnnnnnnnnnnnnnnnnnnnnnnnnnnnnnnnnnnnnnnnnnnnnnnnngacggccattcatggccgg

SEQ ID NO: 50584 - DNA, 1357 bp, Oryza sativa
  unsure (1)..(1357): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcgattttcttgtacactcctgctcctttgtaaccaccgtagcccgtctctttcacgccgcatggatacaccagtgcaccttctcaaccacacatcttcctttgtccccatcgctgacgttgtgtctcctctaccatgttccatgatccactctcaacaccatggtgctccctacaagaggggccatttcactttattgacttcaccacgcggctcactaggctctgcatgggaccagatccttggcgagaatacgcactaatctccaccaccaacaacgaggacctggagcgagtgcctcctcctcaaaggtgagagcctccacctacttcgccatgtgctaggatgccaccgttgccatcagctagcctccacaagcttaagtaggagcctccaccatcccctttccttcgtagtccaccatcttcacaatggtatcattccagtttcttcatatatcactagaacggataccctcatctcaatcggacggtaagccccatctcaatcggacacagcatccgtcacaggctagaagtcactgatgtgaagagttatctcaatcgggcaaacggccgtcacgaatgaatatatctcaattgggccctaagtaaagcccgtcaccgatagctttaacccagacgaccagtcaaactatagcccgtcacagatgacctatctctatcgggccacaactagcgcccatcacagatgactactaacctttatcgggcctaaactagagcccgtcacagatgatactcatctcaatcgggcgtaaactatagcccatcacagatgactgatgacctcaatcgggcctaaaatagagcccgtcacagatgactactgacctcaatcgggcctaaactagagcccgtcacagatgactactgtcctcaatcaggccgaaactagagcccgtcacagatgaactcatgtcacatcctgaagttcttctcccaagcctaaattgaatttagaaatggtctcaagaaaataccggtgtaaaacggggannnnnnnnnnnnnnnnnnnnnnnnnnnnnnnnnnnnnnnnnnnnnnnnnnnnnnnnnnnnnnnnnnnnnnnnncgcac

SEQ ID NO: 50585 - DNA, 1157 bp, Oryza sativa
  unsure (1)..(1157): unsure at all n locations
ctggaccacgatcagtggagatagcactgctgccatcgagaggtatcctagttagagaagaatgagtgcaccaggttagctcacgtagaggaggggaatggcaagggacaggctgcgggttaagaaatcaacaggggcggtatctttagcgatcacagctaggttgcactgttgaatgaagaataaatgtcaaagcaagagaaagaaggaataccttataaggtcctcatgcagccagtgttacaacagttcactgctctaaattggataaagtgttcctctgattactgatctgggcattccgcatagtgcaataaataatgtttcttgttcaaatgctcgtaccacatacaactcttgttccaataaataagttgaacatggagcactactcatgataaattttcaacagagaatgtgaattaagcagatgaattgacaataaacgaatctgagaaggtccttcgattccgcaattgccattttgactggagaacagaatcagctagcttgtacttgccctccatattcagaccatggacaacagttctgaagttcactgcactggggatgataccactattcagcatgtcatgaataagctgcaacccatcctctgatctacctgccttacaaaggcatgacatgaacattgagtaggtctcaaagtctggcacaggtcccttcagtttcatgcgttggaagacatcccaagcctctgaaaccatacccattgccatgtgaccacggatcaatgcagagtaagtgacaacagtaggctcacatccattttctgtcatctccttaagtacatccatcgctttggaaacatcccttttccccaagtaatagatcatgaatgaggtatacatatgtgtgctttgagctatacctaaattcttcatttctgcaagcttagctgaagcatcttcaaagcgatccctcctcaacaacgcgtgaatgagactcccatacatgtatgcacttcttgaacatccataattcttaatattatcgaacaaactgagagcttcggccattctatcagacctgcacaatgatnnnnnnnnnnnnnnnnnnnnnnnnnnnnnnnnnnnnnnnnnnnnnnnnnnnnnnnnnnnnnnnnnnnnnnnnnnntgaatcatcaatngcatccg

SEQ ID NO: 50586 - DNA, 2247 bp, Oryza sativa
  unsure (1)..(2247): unsure at all n locations
accattttctgtaatttcgtaaagtacatccatcgttttgnaaacatcctttttccccaagtaatagatcatgatgaggtatacatatgtggttttgagctatacataaattcttattttctcaaagcttagctaaagcatcttaaaagcgatccctcctcaacaacgcgtgaatgagactcccatacatgtatgcacttcttgaacatccataattcttaatattatcgaacaaactgagagcttcggccattctatcagacctgcacaatgatctaatgagtatggagtagccagcctgaatagaaaatccatgtttacataatagtactactgagctttcagcacgatctatcatcccacactcacataacacagaaagatatgtgcaaaccattccattgtcaggtatatagcctgcacgacacatttcatggaaaatcttgactgcagcatctactttcctcccttttctgcggctgaggtacattattaggtgactgtaagtagttttgtcaggctgaaagccaccctgcttcatctggtagaatgtttcaagggccatttcagttagaccagcatttccatactgacaaatcatgacattccatgtatccactgttgggcaacactctgcccatatcatctctctgtaaagatgcctcatgtgcttaaaatcttttgcagagccagcgagttttatggctgtgttatatgtctttgttgtctgcatgtagtaagatcgtttgcctacccaagaaaaaaattgtaaagcagcacgactgtttgccttacaacgcttcataatggcatcaacaagatctggagtaaaagatattgatgtcatctctaaagcctgttctattgagctccagcaatcagaagatgacagaatccgacatatttgttcaacgtcttcattgttgtaatcctttgcttgttctaaatcctgtgtgtcatcacaaggaaagctccctgagacctcacagtctttatacgaaggatgaccaacaaactccactgtcctttccttctcttccggaccagatccagatgatttttcaaatttaccagtgtagtcactttgatccaatgttctgcgttgcagctcttctatagggctacaacaattaaaagatgctcgcatcctctcaatattgctagcttcttccaaatagtgattgtcatacagagtggaaataatcctgctgaaagtttgctcggaaggcctgaaatctgattccagcatttccttcagaagttttagtgcttcaaggggcctggaggccttacagagctcttggatgaacactgtataagctttcaatgtgggtttctgaccattctcattgatattcctaaatgcatcccatgcttcagatatatgtccattacgaacatgcccacctatcagtgctgtgattgccacaacatctggttcaataccattttcctgcatttcctcatacaatctacatgctgcttcatgttgatcaaatgcaaagaggtgttgcatgagctgagtataagatgatgccaatggaacacatccatattccctcatttcctgaagcacctcaagtgccttcatacgctctcctttcctcaggtagccatcaatgagagaaccaaaggtggcactgctcgcagatgagttgcttttcatgtactccataacttgaagagctttatccatccttccatctttgcaaaggcccctcaataggatttcaaatgcagatgagctagcaatggacttgttcatcatctgctggaagattttctgagcctcttctatttttcctgaaacacagaagctccgtagagcttccagataacaatactcctctggatacttcatgctcttaatcatatcatctctgacataaaaaacaccttcagcattatctgatcctgcgagacaacacaatagaagtcgaaaaatgtcagatccaacctccgtgttccttgccatatctttgtagaactcaagagcaagctcggactttgcagaattgcataaagcatgaagtatcgtcctataaactttactatctgctgccacatgtctcgatttccccatagcctgaaaggtagatagcatcttaaaaatctgccttgccttcccataactggatatgacgattgtccatgtcttgatgtccttaaacacaatctctttatcaatctaatcatcaacttctccatggcccccaaagttcttcttctaaaccgcaaaggaaaagn

SEQ ID NO: 50587 - DNA, 2447 bp, Oryza sativa
  unsure (1)..(2447): unsure at all n locations
cgagaccttagaagcccgccgccgttgcaccgttgcaaccaccagcttccgggcaccgctcaaatggctgtgagcgctaccntgcatctccaggaatggcggcagcggagcccaccaaccccaaggcgcgggggtcgccgccgccccggtaaggaggggccatggcgggggtcccggggcagtccgggccggcaggggagagcacacgggcatgcgcggctaggatgcggtcnaggagcgccatggcgcgtgggatctccgcgaaggcgtccgggctgagggcgttgagctggcggaagcggttgaggcgaaccttgtaaaccaccgtggacgggtcgggcggcgtcccggcgagcgtcttgaacccacgccggagctccgcctcgagcaaggcgccgatgccgccgaggcgccctcctagtgtggcgagggaggaagaaagcggcggcgggccggctcgccgaaaaagaggattggagagaggggaaggaagaagaaagggggatgagaatgactggtggggtccattggttaatagagagtataatgcggagagtctgttggaatagaatgcaaatttgactctctaaacttttgttaggttggccaaataggtatttggagagctaaaaatgaccactctattaaagatgctcttcgatttgaacttctttcatgggggatacataccgtcttatagcagcttaatttagaacacgatggcgaagaggacactccattagagtagcaaaagagtgcatggttgaattcaagcatgaggcaagcaataagaatcaaataataaaaaaagccagatttggtggagaaacgtcccccaaacatttttttcaaaattttttgctataagatattatgacttcatggacactctgtaaacgtcagagccgtcctaacaattttggggccagtgaaaaatataaatgagaccttattttctaaaaagtaattgattaatacataagggttatatatttggaacggatattcacagccactgtttttttaccactgtttgttctttgatatgcactgtctgacaagcacgtcaggaaaggtagcatcgacctaatactcttttttaagactgtttttagatcgaggggcaaaaaaaatttttaaggtgtcacattgaatatacggatatacatttgaactattaaacatagtctaataacaaaacaaattatagatttcgcatgtaaactgcgagacgaatttattaagcctaattaatttatcattagtaaatgtttactgtagcaccacattatcaaattatggagcaactaggcttaaaagattcgtctcgcaatttacacgtaatctgtataattagttttttttttctatatttaataccttatacatgtgtccaaatatttagtatgatagggtgaaaaaacttgctaggggatctaaataagcccttagatatattctgctattaaacaagtaggaattgtttgcaatcaatgacaactaatggtatatcaaataagctcattcacctgtatattataatggcgatctggttaagtaaaatatcgttgcaataattcattttttcttactaaatagaaaaatataatctaagaacgcatgttcacatccccgtcatgaaactttacgattaccatcgaacacttgtcggaattgagaaaaaaaaacagcttgttctagtggtggagcaggaagagtgaaattcaaaaagcataatctaaagatcataaacatgtcagaacatcaatttcaattgaaacatatggttattaagcctctgcaggcccggtaaatgtaaaaattagcttatgaacacgtcattattataatattcatttctagttgaataaaagaaaaaaaacccataaaaaattttgaaatacatctggatccacatgtaaggtatctatctcaacctctatctccaattgcccttcatcctcagcctaaggccggcgatcacctcgtgatgtggttgttcaacgcattcgaaaggtccaacgttctacagtaaccaaacagaaacatcgaatttagataatcttggactaacctagccatcagaatgtaaagtaatagtggcatatatcctatccatatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacactannnnnnnnnnnnnnnnnnnnnnnnnnnnnnnnnnnnnnnnnnnnnnnnnnnnnnnnnnnnnnnnnnnnnnaggcgtacctattcatgggcaa

SEQ ID NO: 50588 - DNA, 1091 bp, Oryza sativa
  unsure (1)..(1091): unsure at all n locations
nccatcaagtgagtaatattaatcattaattgagcaatttcatcacgtcttacttttgcaatactgatcttataatatgtgcctctaatttgttttttttattttgtagcaattgattgaagttggatgtatgcgaaaaatttgaaacgtcattctacggagtacagaaagggcgtaataaattttatgaacgccgcgaaggaggatcggatcagaagaaacagtgattacatgtgttgttcatgtgcagattgcaagaatgagaatatgtttgatagcggagaggacgtacatggtcatctgatacaacgaggattcatggagagctatacatgttgggtgaagcatggagagcaagaatcaggaagtggagtagcagcagacagaagtggtgcgcataatcaggaagatgaagatgagcatgacatgtttataccttctccattgggcggtgaaatggttgatgtggatcacgatctgctgcaagacatgttacgtgacgttgaggacccagcccagaatgagagagatggaatgaagttcagcaggttggtaagtgattccgagacgtctctgtatgctggatgcaaagcaaaacacactaagttgtcagttaccttggacctaatgaagctgaaggcaagtagcggatggacagacaagagtttcacagaacttttaggaattttgaaggctatgcttcctattgagaacacattgcccgagacgacatacgaagcaaagcaggttctgtgtccactagggttagaggtccgtagaattcacgcttgtcccaacaactgcatattgtaccacaaggaatatacggacttggatgcttgtcctgtctgcaaggcttctcgatacaagcgaaagaaaagtgctgacgaaagaaataagtcaaagaggggtggtccagcaaaggttgtgtggtatctacctatcattgatcgtttcaagagaatctttgccaacccgaacgaagcgaagttagtannnnnnnnnnnnnnnnnnnnnnnnnnnnnnnnnnnnnnnnnnnnnnnnnnnnnnnnnnnnnnnnnnnnnnnnnnnnnnnnnnnnncaaaggccgt

SEQ ID NO: 50589 - DNA, 1666 bp, Oryza sativa
  unsure (1)..(1666): unsure at all n locations
nacgttgacggtgcaggcctccaggtcgaagagtaaaagcacccagtggaatctccaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatcatctctctaccggtggcgctcatctccatgtacagttgatggaacttgtacatttgagtgggtaggaactgcagctgctcaggcttgataagcggtttatcgagttcgtacatgtatttcactttcgccttttcgattggtgcacctcatatcaattgatccgtagttagcccggtgtcatcaataaattcttgtattccaaaatcttcaccggtcaccaacggctcgatctcctggcttgcttgctctccaagctgagggactggtttggactttccagaagatgctttctcgagtgttcgctcatagtccgatagctttatggccttcttggcaggtgcagacatacccctgaagaagttcttaacactcgagtctataggaatcttcttttctggacttcgaggcttcaattgtctcctgacttctgatgccacataagcgtcaagctcctcttgcgtgcaatcgtaccctagatccttgttcttggcggtgtgaactttcgccttcttcgttgcccttgtgggggcaggcggtggagcttggggggcccttgacttggaaggtgctgaacgaggagcctgcggaggagtcggtgtaggagcctgaggaggagtcggtgcaggagcctgaggaggagttggtgcaggagcctgaggtggagacggtgctggagcatgaggagacggtgcaggagcctgaggaggagatggcggagccggaggagatggtgcacgagacgccgcttgtcgccctgggaggatgatgtatcgcttgcgccatagtataatggcgtggcttgtgtctcgtagatgcgtctcaccgtctcctccagggtaatccaactcgaggtcctcgtacgcgccttcgaccaactcaacttcgaccttggagtatcctgctggaatcgtcctacagtggtaagtacctaaagggtccgttgggatggccatgcccgacgccaccctcacgtggtgagaggttatttattagtaatcaacgtttataagcagcaacttggcgaatgtaccaaatctaaaattattaactacgagcctacccttattgataagtttttgagggaatattcagctcaaatggtgcccgtgagtg

SEQ ID NO: 50590 - DNA, 2375 bp, Oryza sativa
  unsure (1)..(2375): unsure at all n locations
cgtgctcncatggatcgaccnnnnnnnnnnnnnnnnnnnnnnnnnnnnnnnnnnnnnnnnnnnnnnnnnnnnnnnnnnnnnnnnnnncgacgccaccttcacgtggtgagaggttatttattagtaatcaacgtatataagcagcaacttgtcgaatggacaaatctaaaatctataaactacgagcttacctttattgataagtttttgaagggaatatgcagctcagatggtgtccgctgagtgatgtcatcaacggggcaggtggttttgtcctgggtttgcatggcgtccatgctctgtgatcctccctgccccgttgaggcgcagttgctacgatttcctgaagggctcacaattgcaggaggaatggttggctggggatcattggaccaatgtgcggccatgcgttcatcaaccttccttgccacctcctcttgcatgctgagctcgtagctcgataccctgaactcaagatctgcaatcttcgcctcggtatctctcttgctcctcatccgactcctgtacgtgtggatgtcctccttgaacccaatcttccaaggaatcacccctttccctcgtgttcatcctggatgctctggagtctgcagggcgagtgacagctcgtccttctctctgtcgggtcggaacgtaccctgagaagaggcttccactgcgtccgttagtcgacgcgtagcctcgcgtatctgatcgctgaagaccagggagccatcaactgggttgagcgttccaaagtgagcatagtaccagaacttcgatcgttccggttaattagcggtggccggttcgatacccctctcaagtaagctagcctccatctcctcccacttcggcatcgcgacgctatagcctcctgaccccaagtgtgatggtacttcttcttggcggcattttctttgtttctttccatcatcgcctgcccttgttcacatgtcttatgtgcaacgaactcgtcccagtgatcccttagctttgggaatgtgtcgaagttcggtgtctgccccttcaggatatatttctggtacagatctcccttgaagctctgaaactgttctgccattttatttagagtccaccttttcactttgtcctctgtacctgtgggaagggtgaatgtctcgagcattgtggtccacaacatctctttctccgaatatgggacaaagctctcatgatctccgtgtgcccttgttctgcgccagtacaccgtactgacaggcacgttatcccacacaacccaaccgctgtgacgtatgtagttcttggtggcttccgcctaggcactaggtcggccgtcttcgtccacttccgttatgatgtgccaaccctcaagcttcttcgcggcacctcgttgcccgcgtgccctcttctgtccagcggagggttgacttccactagcctcctcctcctggttcccctccacatccctctatacgtgcccctcctggttcccctccgcatccctctccacattcccttcctggttcaagtactggtttggatcctcgttcccctcttcttcgttcaagtactggctgcttccctccgcaattgtatcttacaatatatgttcctcatcgcgatcagctatctgttcatacaagaaatagttcctaagtcatgagacatttttgctttaacaatcttatatgctaacaatcatatatgctaagtctaaacacaaatctaataatcttatattaaaactataataatcgtatacgaaaactcaaataatattgtattaaaactgtaatagtcaactatgctaagtctaagtgacgtatattaggaccctagctagtcaataattatatactaagtctaattacaaatctaataatcttatattaaaactcaaaaaatattatattaaaactctaattataatgctaagtctaagtgtcgtatattaaatctaatagtcttaattgcgttaaaaatctaacaatcatatatttacatcacttgcctgcgcgaattccttcgagggctagcaaccactccggcttgagggacgacgacgacaacgtcttttctgcaacatacaaaaagatgtattaggagaaacgcgaagtaacatatattgtatttctcgttcgcgttctcattaagttcacgtttcgttcacgatcgttcacgttcgcgttctcgttaagttcacgtttcattcacctacgttcgttcgttcacgtgcgtccacgttaacgtacgttaagtaaagttcgttcacgcacgttcgttcgtttacgtatgttcaaatannnnnnnnnnnnnnnnnnnnnnnnnnnnnnnnnnnnnnnnnnnnnnnnnnnnnnnnnnnnnnnnnnnagaagtgtcaattcatgngccac

SEQ ID NO: 50591 - DNA, 2332 bp, Oryza sativa
  unsure (1)..(2332): unsure at all n locations
tggggcgcgngnnattgaaacatggannnnnnnnnnnnnnnnnnnnnnnnnnnnnnnnnnnnnnnnnnnnnnnnnnnnnnnnnnnnnatacacggttccatttagccgaggctaaatatattttcccgatctttccaaattcttttaaacccggttagggttaataaccgggactactgataagcgcactgaatattaatttccattacatatgtgttcctaaaatagaaaataatgcattaaaattttttaaagtcgaaaaattaatgacaattacttcgaaaaattattgttgtctgtagtaaattaagtggataaaacgtaataagcaaatatatgatttaaattaataaaaattctaataatcatatatatacttagcgtatgaatgatattaaattgttaacaattgtaattaacatatgtatatacatacgacatgcatgatttaaaattaataaaaattctaataatcttatataattagcatatgaatgatattaaattaattgttaaaaactctaattaacatatgtaaatacatatgacatgcatgatttaaaattaataaaaattcgaataatcatatataattagcatatgaatgatattaaattaatttttaaactctaattaacatatgtaaatgccacaagcatgatttaaaacttttaaaaatcctaattatcgcgtataactagcatatgcagggtttaaaattgttaaaaactctaattagcatatgtaaatgccacatgcatgacttaaaacttttaaaaattctaattatcgcacataactagcatatacatgatttaaaattgttaaaatctctaagtaaaattgttaaaaactctaagtatcatatgtaaatgccacatgcatgatttaaaacttttaaaaattctaattatcgcatataactagcaattacatgatttaaaattgctaaaacctataataaacgtacgtaattaacatatgccatacaacaactgatttatatggataatcaatacatccaaaatagtttacatcgtgtacacaatagttacgacaatacatcagcggtgacggttgaccgcacgtactttctcctcactattgttccctccttgtgatcgctacgtgagtaaggggtgtcttcatttgataggaggatgctagggtcaatcgttaccatgaaagggggttgcccatcaaactgatcgtaatcctcgtcagtcttgtcctcaactccgacgatttttcttttgcctgagagaaccacatgacgcttcggctcgtcaggccctctgcccttctttcctttgctagacatttccttcacgtaaaagacttgcgttacattattggcaaggacaaaaggttcgtccgagtatccaaccttgttaaggtcaaccgttgtcatcccactatcatcaatcattacgcctccaccagtcaacctaacccattggcaccggaacagagggaccttgagaggaccatagtcaagttcccatatgtcctcgatggcaccgtaatacgtgccagttgttccatcgtgtcccattgcatcgatacgaacaacgctgttttggttcgtgctcttcatgtcttgggctctcgtatagaatgtgtacccattgatctcatatccctggaatgtcgcgatcgacccagatggtcccctcaccaggaaggccagttgttggttgatcgtctcgttacccatgagatgttgtcatagccacgcggggaaagtatcaatgtgatgccgtgtaatccatgcatcggacttaccgatgtttctggcgtgaactagagccaagtgctccttgatgtaaggagctaccaatgaagattgttgcagaaacgtgaaatgggctttacggaataaattgttgtctatcgtcattattgctttccttccgagagttccctttccccgtagtctcccttcatggcgtgattcaggtaccccgattgggcgaaggtcttcaataaattctacgcgaaattcgatgacctcctctgttccataccccttggcgatgcttgcctctggacgagcatggttacgaacatacttcttcagaacgcccatgtacctctcgaaaggaaacatgttgtgtaggtacacaggcccgagaatactgatctctttgacaaggtgacaaagcagatgcgtcattatattgaaaaatgaaggtggaaatatcaactcaaaactccacatcattcagaagggcttctaatctannnnnnnnnnnnnnnnnnnnnnnnnnnnnnnnnnnnnnnnnnnnnnnnnnnnnnnnnnnnnnnnnnnnnnnnncactcaatggcgcaa

SEQ ID NO: 50592 - DNA, 6226 bp, Oryza sativa
  unsure (1)..(6226): unsure at all n locations
tgttgcaaggattcgacgatgaccatgtacacaaccttcttcaagtgcttaagatacgtactttctgtttcatccatacagtgagtgcaagccttgtcccccttgttggactgtccggatgggttgctaagtgcaggccaatcgttgatggttacgaacagtagcactcgtaggttaaactcctcctgtttgtcctcgtcctacacggggacaccttccttcttccacaacagtttaagatcttcgaccagcggtcttaggtacacatcgatgtcgttactaggttgcttggggccttgaataataatcggcatcattatgtacttcctcttcatgcatagccaagggaggaggttgtagatacacatcgtaatgggccaagtgctatggccgctgctcatctctctaaaaggattcatgccattcgtactcaaaccaaaccgtatgtttcgtgcgtcctttccaaagtctttaaattttctgtcgatgtttcgccactgcgaaccatcggcgaggtgtctcagcatcccgtcctgttgacgctcttcagtgtgccatcgcatcattctagcattccccttgttcctgaacaaatgccttagacgtggtattatagggaaataccacatcaccttagcaggaattctcttctttgttagctgcccatcaacttctcctggattgtctcgtctaatcatgtatcatagtgctttgcaaacagggcatgcttctaggttctcgtacttcttaccgcgatataggatacaatcattcggacatgcgtgaatcttctgaacttccagtcctagagggcagactatcttcttagcctcgtacattgtctcgggcaatttgtttccctccgaaagaatgttcttgacgagtttcaataaattgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttctctttcgcagtcctccttggcgtcctgcaacatctgaccaagatcatccgcaacgtcgttaccatcagcatccctttcctcctcgcccgtttgatttccttcaaatccaacgtactgagcaaagtccagaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttatgcctgttagcttcggccactctcaaaaaatcatgcacgccatcaataaactctttggaccgccgatcagcgtacatccattgccgatccatctacatgacatgaaaaaaaatcatacacaaataattattcttacaataatgacagtcatacaataattataaaataattacaaactctttcaacagtcatacaataatgacatatcattattcatacaaaaatcataaaatattacaccaaataattcttatttactatttctaaagtttacaactaatattaatgtgttttacttcttttaattttcattttagtttgttttctattatttaagattaactatcactatattttccttctcaactattttataaaaccttctttagcaaaataaactaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctctgatttctatataatcaccaaaataaatttactagaaattttggcatgacctcccctcttttttgaagaaaaattgaagcttgctcgggcagttggaggaggaagaagacatatatatataggggtaggactttagtcccggttggtaacaccaaccgggactaaagctatgatctttagtctcggttggtgttaccaaccaggactaaagatcccggggggggggggggggcttgataggccttgacagcatttgaatcgggatctttagtcccggttggtgttaccaaccgggactaaagatcaaatatgcccgttaccctttttaaccgggactaaagatcatctttagtgatctttagccccggtttttattgcaaccgggactattgtggaattcggccgaccgacgaaagatggtttctccaccagtgagcagacgactccatttataggcagcaaacgagagttcgatgccactatattgctactagctacttattctatcaccaatttgcatgtggaagtaacatgcatcatggatggtaggctttggtttaggagtaaagaatctcacagaattgtgtttcgattcattcctcatgaccccatgcatgtagtttaagctagatcttttgattcatttaagccaacatgtctgctgatctgctctgacttttggatagtccatgccagtgaagcttgggaactagatatagttttatgattacacatagctagcgcactactggagagatgggcatctctgccggttcgcaaccccctttactcccgggtaatgaaccgagacgtccaattcgggactaaagatacccatctttagtcccggatgaaataacccagagtaaaaatggatctttagtccccgggactaaagattctagcgccattttagtccggtttcctttttttgtttttattcttgcatttattatcaccctcaaatccccacaaatcatccccaaatcacacaaatcacccccaaatcatgcacaacaagtcatccccaaatcatgcacaattctcagcccatccacgaaatcatccacaatccacaagtcattcagaaatcatgcacaacaaatcatcctcaaatctaaaataaactacaacaaaaattacaaatcattcaaaaaaaaatcagaaaacacgccaccgccggccacccggccgtgtgccgcctcccggcctccgcccctcgaccgccgccacccggccgcctccgctaggccgccgctgcccggcctccctcccaccggatatggcggagggtaggccgccggccgtgcgccgctgccgcttcgtgcgctgcggggcgcccgctgtcaccgtcgtcgacgtcagaggagggaggggggagggggaggagagggtaagggggaggaaggggaggagagggggagggctggaggagatgaaggagttagagaaaatggaggggagatgagaggatgagactggaagaagagttggagtggaggggataaggatgaggcggggaggacgaggcgcatgcggctaggtggtgctcggtttttttttaactttgctcctggttggtataaacaaccgggactaaatatgatgaggcgcgcatggctcggtggtgcactattttttttttaacttaatttgctcccggatggtataaacaatcgggattaaagatctatttttagtcccggttgataacaccaaccgggactaaaaaatagggctttgacatgtttttgaatcgagagtaaaattaatatttagtttcagttggtgttactaaccgggactaaagataaaaaaataccggtgtgttttcaaaccaggactaatgtgatttttgagtgacccaacaaagatcatttctccggtagtggcggtaattttatttttacccctacttggatatgtgcccctgttttttttaaagattttttccccagttcttttaaacggagccaaattttatctttattttggagggatatgttgacggtgtgaagtgaaaaggtatatatgtctttacttactgttacaaaattgtccctttatttgtgcattagttgtgtttttccccctaatattgtaaatgcagctcgcaaccactactaaaaaaccctcatagggactagctcataggtgccggttcatttaaaaccagcatctatagagcatttcccacctccgagcaatgaaaaaatatagaaccggcacctttaaccatgttagaaccggcacatatactataggtgccagttttttaaaagaaccggcacatataatatattataggtgtcggttaattaaagacttaaagaacagacacctatatgttgtttttaaaaaccggcacctataactttgagccaagccgacgagccgagaccatccgcgcacgcatgcgcactgcacccaccgcgcgtccttatctactccctcgcctttcctatctctcgcatatctctccctctctctctctcgcgtctctgtacccgtctctctcgcagcggctgcccagtggaggcagggtggcggcgggctcttctcttctctctcccatgttcttctcttctctcccttctagctatctgcatctggggcgggcttggggcggcacctctagcccccacggtggcgcacggcgggtggtgggcggcctccctggtccggcgggaagggagaaggcaggccatgggtggcggccaggcggaggcagtcgggtggcctctctctctcttctttcaggcggtggcaaccgagcggcggtccggcggaggcagcagcggcggcccaagttcatgcggaagcggcaacgcactgtttagttttttttttattcttgtttagttcatgcggcagcggtggcgcactgtttttgagttcttgtttaggtcttcctctcttttctcctccttgatccatgtcccaaatgtatgtgaacttgttgagttcttgatgcatgtaggatttcaattaatgtgattgttgttaagtttggccggtggttcgctgttggtttgctgttgagtacttgatgatgtgatccaggtttgctgttgagttcttgatgatgtgatccaggaggcggtgatgaatgggatgtgaggttggtgagttcgactcgaatgagccggctctctctttttttttttttttttttttttttttttttttttttttttggctcgagcaaagcttaaaatgccggctgtatatttctaataggtgccggttgctattatatatgtcggttgggaaaccggcacctatagacggtttttaacaagcaccaatgagtatttgtgtactagtgaacttgattttttttaaagatgtttaaaatcaaatgatttttgacaacctttgacaaatataacaattttgacagaatatcaatagaactatcacaaatttgatagtagaaattaaacataatttttccagtaaaagaaaacataatttttacatctttttacacagctagcagaagtagtcacagcactttgacaggctgctccttcactgctgagtcgagccgacggctgcaggatcacgttcacctaggctgcctgctccccgcgctctgcctacggagtcatcgccgcgaccttctcctccccgccgctggtcacattggtcatcgccgaggctgcctgcggagtcgccgctgttgccacctgctccccgcccgccatgtacagggttcgctaccacggccaactactccggccaccttgctggctgggtggctgccgccgccaccgctgctgccgtctcccggccactgccacctaggcaggtcgctgtcgtcgcctggaccgtatggttcgggaataggggaaacagcgtcagggccgattgaggagacagatttctgctctcattttcttcttttacgtatatcaggggtagaaaggtaaatcaataaattccaaaatgattattcctctttattcttattattttgttatcttaacaattccagtttccgggccgggtccactaacttccataaaaaaagagtaaacacctccttcatttgaaaaaaatgggcaaaaaacccaaaactcgaaaaaaaacacgagcaaaaccataattgaacattaaagtaggagcaaaacaaaattgttcctaataaatataagtcgttttacgtaagcttgcatataaatattcaaaaatggataaacagtccatgtctccatttagnnnnnnnnnnnnnnnnnnnnnnnnnnnnnnnnnnnnnnnnnnnnnnnnnnnnnnnnnnnnnnnnnnnnnnnnnnccatcaannntcaatgccac

SEQ ID NO: 50593 - DNA, 5437 bp, Oryza sativa
  unsure (1)..(5437): unsure at all n locations
gtgcccccaggatgaggacactnnnnnnnnnnnnnnnnnnnnnnnnnnnnnnnnnnnnnnnnnnnnnnnnnnnnnnnnnnnnnnnnnnnnncttagccagcagtgcagcacaaggattttaattaatcatatccatgatgcatgtgatatatattctccttgcattgcaagtctaaatgcaatgagtcaagtcaactccgatacattcatgttgatctccattacaataacagatatacgattacagtcagggtttcaaaaaccgctgggggcccggttaccgccacccggcggtacggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctgattacagatttacagtacgtcaaatgcaaattgattacttagcttgccaggtatttctaatcaatagtcaatggtgcgaaaaatagccctaaaaaatcataaccagccaaccaacaaattcaacaaaaggggaaaattgatggaataaattctgaaggagcccatagtagagattgcatgcatgtcagttgcccagtcggtgtgcgtgatcaactgttggctccaaacttcattaatttgaactagcttaatttggttgtcagcagggtacgataataggttatctttcaatatctctccattaacgggctttcaatggtgacatgctcctagctagccacccactgattacccttcggcttataattacgccacattcaaattttgaattttaaacatcagtttggagttgatcttatgttttctttcgttgtagtttattttctaacattttcttttaaattgctaagaaacatattatcattaagaattattttttattgctcataagcctattgaaagccaaaaggtttgtgctgggaaaatctagacaccaggtttacagcgtagggagggtcaaagccctcctaaaggaaaacagacagactccaaaacttactaccagctctaaaagcagcaacacaactaaaagaaccaaaagggctgccagtacaagcagatttcaaacatcacaacttcagtagatagaggatagtgccacaacttagggaacctcttaactaatctatcacccaatacccagcctatcactttcagagttggcagcagcggtcttcatcttctctgccacaaccatcatcgtgctagcttcttcagtatgccctaaaaccttccactgcagcaaataagaagcaatacaaaaaggaagcattaggggggaatacaccaattgagatctgaatatcatattgtttcttgtggtccaaagaacccaacagatagcagcaagcaaagaaaccaaagctcttctattactacaagcattatgttttattagcaagaaaaactcttcaaagctgcaggggacagtatcccagttcacaacatctctacaaatgcagcaagcaaaaattgccattggacagttaaaagaatgtgattggtagattcaatagtattgcatagcatacaaagttctgaaccatcccaacctttctttttcaattgttcacaagattggatcctatctctacttgccaaccaaaggaaatgtttaatttttatgggacagggagatttccagattagttgtagcatctcatctttcacccatctaaaagccatagctctgtataaagagttggtagtaaatctcttactagctgtcaaaccccatttcaaaatatcaggagagtcagtcaactctagctcttctaggattgtcctaacctgctgccattggtcaagttccagagggccaaaagttctcctaaaagataaaccacctatacctatctgtttcagctcagaattgtgattgattgtgggttgcatatctcaaaaatctcatgaaaacttgttttcagagggcaagacccataccaaacatctagccagaaccaaatatgggaaccatcaccaatcttctattcaattcagaaccaagcatcattcattttcttgtattaagaatcccagaccaaaactgagaagcaccttcagtagagcactgaaagactcccccagaacacaagtatttctttcttaatagctcaaaacagagactaccatcaggagattcaaccttaaccaaccatttagccaacaaagcaatgttaaacattctagtttcagtaagacccaaccctacaaactcttttgggaagatcaaatctgcccatttcatcatatggtattttctcccttgtttgttaccagcccagcagtatctacctcgaattgaattaaatttctgatgaatcccctcatacagctgatagaaccccatagcatacgagggaatcgatgagagacaggcattgatatgtacagctctccctgcatgagagacagaacaaccagaccaatttcctaacctcttttccattttttgggctaaacaataatgatgatattataagcctgtaaggtttataatatcaacataagcgaaacaataattatgattaatccaacctaaagaagtcaatggtcagcacacagcaggatattcttaccctgaattatatattatcacaaattatcagacgtaataagatgcacgtacgcacgataatgaacaacatgcgtatgcagacctagagaaaaattactctatattatctcaagatcgatcgatggaccaattctagtcaatacgtttaccaggaccaatattttactgatagttatctcatcaattaaactatgtaataaagctcacacagatatgtttacgtactccgccgaaatttagctttgttcctaattaatttgcgccctatctggaatatgcaaaatatcacattatggtttcaaaggaattttatacatcaatagttcaattcccagatggaagggtacgtagaggccattaagagcttgtggggaaaagaaaagggtgaatagctaatacggtctctgaagtttcgtttcggacttagtttagtacttgaggttttaaattgtctaaactagttctccaaattaatcatttgggttaatatagtacttggacccacaaaaagtgtcacgtgagcatgccaaatcatcctcacatgcaacggtatgaatgaaatgaccattctacccttatgtaccaatagaaaagaaagaaaaaaagaagatagttgtttcacacatgtatgatcgttatagaattgtcacttgcgattgctgtagccaagcactgatcgtataaattcctttgtcacttacgatttctgtttgtatcttttctttcttttctatatgatatgatatataagggtagaatgctaatttcattcataacgctgcatgcgaggatgacttggcatactcacgtagcatttgtttttaggtccaaagactatattaacccaaatgattaatttggaggacttgtttggatgatttaaaacatcgagaactaaactgagcccgaagcaaaactcacccgaaagaaaacgatctcttccgtaacttcatttttctgtgccgtgtctttccggacggcttcggtaactacttgctgttgtcagctagtacaattattatgcctgccttgcaacgtttaccgttccataatcgcaaaatttgattagtgtgcgcgcgcacgatttggcgttaaccaacaacacgtcggtgagccgtttgattgtcataaaccacatgattattgcatgtatggacgtggacgtgggtgcagatagagccttctatcagataagtacacatgtggagataccgcgcaccaaacaaacttatgtaatgtttggtacatctctactaatataaaaagtatgagttcatccacaatcctgcaatcctacaatcctggatccaacccacccagccacctggacccactccttatcacgtctccacaaaccgaacccacgtcggtccgggagaaagaaaaagaaaaagaaaccgagaaaacccacaaaccaccgttttctcggccgcttctctccgcntgngcagcgctcctcacgccgcgcgcnttttccttttgcctccccacgccacttgtcggcgctaccctccccgctcccgctcgntccgcagcttccctccacttgcgccgccgccaccgctgcctccaacgctgactccgacttcaacgctgctccggttgctgtgcaagagggaagctgtagtggcggcttaacgagcgagacctcctcccaccccgcctccaccgcatcaccgccgttgcgcagctcctgctcgcccgcatcacctcctccttcaatccgtgccgcccctaaccctagccaaaccgagctgcatccctcgaaaccgagccactccgctcgcgcgcggctgcgaacctaacaagggaaagttttaacagaggaaacttggtggaaactggattaagctctactgttggttaaaaaaaaagcatgcttctcatatgtcaccactgtttgcacctattccaaaaaaccaccctcttccagcattttgactttcaacaattagaaacggacactaggtaatggtgagcagcgactcccttgtcatatccaattagatttgataagacctaaactgtagtaaaaaaaatgtaccacatgctttctcatatgtcatcaatgtttccacctattcagacaacctccctcattcagcattttggttttcaactagtatcaaacactaatgaagcaatcgccactaggtaatggggcactaccttgtcagatccaactagaattgacaaggccatcattactacaaggcattcagcttagccgtgaattatgtcggcggctacgacggtagtgcaactaaacttctaaattggtttgatctttctttgttttggtaactccatactcaaatggtttgatctttcttttgtttgctaactccatactcaagagtagaagatcaaaggaatgtttctctcaaattacatgaaacgttcgacagccttcgacgatatcgnctcatgctcaattcagagaagtgcatgtttggagtaccaatcggcaagctacttncgtttctcgttn

SEQ ID NO: 50594 - DNA, 2370 bp, Oryza sativa
  unsure (1)..(2370): unsure at all n locations
cgtgcgncattgatcgnnnnnnnnnnnnnnnnnnnnnnnnnnnnnnnnnnnnnnnnnnnnnnnnnnnnnnnnnnnnnnnnnnnnnnnnnnagcgactcccttgtcatatccaattagatttgataagacctaaactgtagtaaaaaaaatgtaccacatgctttctcatatgtcatcaatgtttccacctattcagacaacctccctcattcagcattttggttttcaactagtatcaaacactaatgaagcaatcgccactaggtaatggggcactaccttgtcagatccaactagaattgacaaggccatcattactacaaggcattcagcttagccgtgaattatgtcggcggctacgacggtagtgcaactaaacttctaaattgttttgatctttctttggtttggtaactccatactcaattgttttgatctttctttgttttgctaactccatactcaagagtagaagatcaaaggaatgtttctctcaaattacatgaaacgttcgacagcctccgacgatatcgcctcatgctcaattcagagaagtgcatgtttggagtaccatcgggcaagctactcggtttcctcgtctctggcagaggaatataagcaaatcccgagaagatcaaggcaatcaagaacatgaagtcgcctacaagactcaaggaagtacagaagttaaccggatatatggcggcattaagcaggttcgtcgctaggatgggagagcgaggacaacctttcttcgctctgctaaagaagcaagacaaatttgtatggacacaggaagccaaagaggcattcattgcactcaagcgctacctatcaaatccccctatacttgttgccccccaacctaatgaagaattatttctctatattgccgccacgccatattccgttagcactgtcattgttgtcgagagagagaaggtgcaacaaccagtctactacgttagcgacgctctccacgacacaaagacaagatatccacagatccaaaaattgctctacgcggtaatcatgacatcaagaaagctacgccactacttccaagcccacagggttacagttgtatcctcctgccctctcggtgaagtagtgagaaacaaagacgttctcggccgcattgtgaaatgggtagtcgagctaagccaatttgacatccgctttgtgccacgaacagccatcaagtcccaggtacttgccgacttcgtagccgattggactatgcctgataacaggtcagacaaccaaattgacaacgaaaggtggacaatggcgttcgacggcgcactcaacagccaaggagcaggggcaggattcatcttgacatcaccttcgggagatcaattcaagcatgcaattcacctcaacttcagggcgaccaataacacagccgagtacgaaggactactcgccgggataagagctgcagctgcactcggagttaggcgactaattgtgaaaggggattccgaactagtcgcgaaccaggtgaataaagattacaagtgctctagccccgagttatccaagtatctcgcagaagtcaggaagctggaaaaaaggttcgatgggatcgaggtctgacatgtataccacaaagacaacatcgaaccggatgatctagcacggcgtgcgtccagacgagagccacagccaattgaacctggcacctttcctgaccaggccatcagtgaaagaggcaagcggcgaagatagcccggtcacccctaacatcagctcgggggctacagaggcagagcgcgccgttgccgatatcgagagcacagatgactggcacaccccactcattaaattcataggcagtgaagagttgcccgaggacgacacagaagccaagaaaatatcccgtaaagcaaaagtctactgtatgatcggcaacgatctatacaagaaggcaccaaacggggtacttctaaaatgcgtctcgtccgacgacgacagacacctcctccttgacatacatgaaggaatccgtggatcacatgccgccggtcggacattagtcggaaaagcttttcgacaagggttcttctggccaaccgcccttaaagacgcctgcgacatgattcagcggtgtgaagcctatcaattctacagtaaacacacaaggctaccagcgcaagcacttcagactatccctctcacttggccgttctcgtgctgggggctagatattctcgggctattcccacgaggatagggcggctgcaggttcctattcgtggcgatcgacaaattcactaagtgnnnnnnnnnnnnnnnnnnnnnnnnnnnnnnnnnnnnnnnnnnnnnnnnnnnnnnnnnnnnnnnnnnnnntcctatctcgtgccg

SEQ ID NO: 50595 - DNA, 1139 bp, Oryza sativa
  unsure (1)..(1139): unsure at all n locations
gctggttgtatttgcacatcnnnnnnnnnnnnnnnnnnnnnnnnnnnnnnnnnncgtgatatattgttgttagacaacgatgaacctactacctacgaggaagcaatggtgggaccagactctgagaaatggcctggagccatgaaatccgaaatagaatccatgcatgtcaatcaagtttggaacttggttgatccacctgatggtgtaaaagccattgagtgcaaatgggtctttaagaaaaagacatatgtagatggaaatgttcacatctacaaggcacgattggtggcgaaaggtttcagacaaattcaaggtgttgattatgatgaaactttttcgccagtcgccatgctaaaatctattcagattgttttagcgattgctgcctatttcgactatgagatatggcaaatggatgtcaaaacagctttcctcaacggaaatctcgatgaggatgtgtacatgacataacccaagggatttgttgatccacaatcagctaaaaagatatgcaaattgcagaaatccatttatgggttgaagcaagcatctcggagttggaatattcgttttgacgaagtagtcaaggcgttgggctttgtcaaaaatgaagaagagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggagaagcagcatatattatgggcataaggatctatagagatagatcaaagaggctaattggattaagccagagtacatacattgacaaggtgttgaagaggttcaacatgcaagattctaagaaaggcttcttaccgatgtcacatggcattaatcatggcaagaatcagtgtcctcaaacgactgatgagcgaaacaggatgagtgtgattccatatgcctgggcaatcggatccaatatgtatgctatgctatgtacacgtatagatggttcatatgcacttagtgcaacaagcccattaccaatcagaatccaggtgagagtcacctggatagctgtaaaagaattatcctaagtacttgagaaagacta

SEQ ID NO: 50596 - DNA, 1873 bp, Oryza sativa
  unsure (1)..(1873): unsure at all n locations
gctggnctnnnnnnnnnnnnnnnnnnnnnnnnnnnnnnnnnnnnnnnnnnnnnnnnnnnnnnnnnnnnnnnnnnnnnnnnnnnnnatgtcactgtcaaggcggatgttgccgcgaccgttgacctcgccattacgcgccacggccgcctcgacgtcctctacagcaacgccggatcataggagcacaggctccggactcgctcggcgtgctcgacatcgacgagtacgaccgcgtcatggctgtcaatgccaggtccatgttcgtatgcgtcaagcacgcggtgcgtgtcatggcggcatggtggcgtggatgcagcctctgcacggttagcacggcggcatggcggccatgacgccggccggcaactccgacactccgcctcctcgacctgttggctctgccgtccgcgacgtcggcaagctgcttttcaaccactcggcgtccgtctccatcctcgccggccgtggccgcagccgctccccgcgctcgcgaagttctcgccggcggccgcctcgtcttcttgccctcgccgtgcctacgtgagattagaggatgacgacgtgagagagaacgacagaaatagtgacggagtggcatggtttcaattttaaaaatttgtagtggcacctagccaataaaacaaatagtagtggtatttttctaatttgccacatttacagtggcatggatccaattaaccctaaaaactataacaaaaatataccaaaaagctcatagctcgtgactaactcgactcggctcgtttgtatttattaacgggctaagccagggttagctcgtttgctataacgagcgagctcaagctggctcgcgagctaaatgagccatggaaaaacaaagcagcccaggagtgctgaggtggatcgcattgttatttgtaggcctaaggcccatcagatccactgatttccactaaaccctagttatatcaaatagatcgattgatttccccattccccaatctacagcgcacgctgtttctgtccagtatcacatcgccatagtgtcgcccaagccctcacgccggcatcgtcgacgacctggccgtcaccaccagcctctagggggcagcaacagcgtggtttgtgagctcacggtgccgcgcttcctctcgtcgccgctccagccggtcggccaactccgtggcaagcgtggccttgtctcagtctcgtcgtcgtgaggaagacgaacaagcagggtgaaggtcccctgctgcaggatgcaagagcatgcaactccatcgacagcgctacaagttataaatcaaggagcaaaagttcaatcttgccgtcctcgtcgccgtcggcagttcggcacttcggcaagtcaatctcccatgttaattttggttggtctaggattcactagggtgtttgcttggtgttttgtttggttccaatatgacgagactttcagatctgtttttatggatgcaatgtgtaaaaaaaaatttgtgccaagtctttgtgatttgtcggttgtttgatttcttaagcaattgcaaaaaaaattgttggcagccagaatctcgaagtgagagatttctattgagtcacggatgtattggctcgcgagctaaacaagctagctagagttgccagtcgagccgagttaggattaggctcgttatcctaacgagtagaccgagnnnnnnnnnnnnnnnnnnnnnnnnnnnnnnnnnnnnnnnnnnnnnnnnnnnnnnnnntaaaaatcggcgttcaccacttgnnnnggnnnngagatgnaatatgcaatcgcgatcgcgcacgtacgacancaagcataaaaatagaatagagagntaaaatgcatatccacacacacgatacaacatactntaagcgacatagt

SEQ ID NO: 50597 - DNA, 999 bp, Oryza sativa
  unsure (1)..(999): unsure at all n locations
cgtgccccaagttacgacnnnnnnnnnnnnnnnnnnnnnnnnnnnnnnnnnnnnnnnnnnnnnnnnnnnnnnnnnnnnnnnnnnnnncctctgtcgcttttggattcacctatgcacgagaggggactgcccgttgcccgctggggacgggggtgaaacttgaggtgtggtgtgcttggctagagggggttatgcgaagggtcctgtcacggcctctttccggtatgtcgtggtggcatgtcggcacatggaaacatgtcgtggggctgtgtcttgtgggtacagttgtacacctttgattagagtaaaactattcgaatagccgtgcccgcggttatgggcggtcaaccagattcaccgtgattagattcaccctagactagtctaatggaattgaatagtataggtggatggttgggcctgttgcaacgtggtatagcattggacagtggatgattaatattgattaattattacaacggttttactactttcaactactatttataaatgctcgctttatgcaaaggaaccattatagctatcccttgataattccctgcatcatacccctattccggtatgacttgctgagtacagtgggtagtactcagtcttgctatattttccccaaaccccagagtttgagtatgcgtcagatggtggcttctccgaggagtaggcttcgtccgtgccgtcgaggatacttgtggagtggtgttcccgctgcggtgcaagtcaaggcttagctccagttatctttttattttccgctgcatttatgtaatacttttataatgtttgtaagacgtggatctgtatgtcaaatttgtcgtttgtgtaccccgaccggtcctggacgggggttttaatgcacattctgcttggaattctattcgggaatttctgggcgtgacaacctatttcaatcgggcatttagttatggccggcacagatggctttaattcacaaaaaaatttgttttttgggtaagccct

SEQ ID NO: 50598 - DNA, 799 bp, Oryza sativa
  unsure (1)..(799): unsure at all n locations
gcggcccaagtaatgcagctcnnnnnnnnnnnnnnnnnnnnnnnnnnnnnnnnnnnnnnnnnnnnnnnnnnnnnnnnnnnnnaatggacttgttcatcatctgctggaagattttctgagcctcttctatttttcctgaaacacagaagctccgtagagcttccagataacaatactcctctggatacttcatgctcttaatcatatcatctctgacataaaaaacaccttcagcattatctgatcctgcgagacaacacaatagaagtcgaaaaatgtcagatccaacctccgtgttccttgccatatctttgtagaactcaagagcaagctcggactttgcagaattgcataaagcatgaagtatcgtcctataaactttactatctgctgccacatgtctcgatttccccatagcctgaaaggtagatagcatcttgccaatctgccttgccttcccataactggatatgacgattgtccatgtcttgatgtccttcaaacacatctccttatccatctcatccatcaacttctccatggccccaaagttcctctcctcacccgcaatgtacagcattgcgttgtacgtcttcgtggtgtgctggaatccaggaacttgcctaacccagtcaaagaatttgaaccccaaatgcctctttttgaagcacctgttgagcaccaagctcacaagcctctgggtatatgtaactcccaggttcttcaagcttttgttcacaaacaatccaagcacctttgcccccaaaacttttgtaccctatgacaaactcactgtaat

SEQ ID NO: 50599 - DNA, 1142 bp, Oryza sativa
  unsure (1)..(1142): unsure at all n locations
cgggcggagaagaaggagaccagcctgcggcggcgctnccttgtcgccatgtacattcttcccaggtttgatttcgcggcgaacatatccccgttgtttaactaccgttttgcagaccggagatgaggaagaaaatgaagtggtgtgggcgggggaaggaccgggttagtgttacggctcgccggcggagagcggtggcgcgcgggtgggagaagaggcggggggcggcggcgccggcggcggcggacgcgacgctcgactcggtagagggtagagaggaaggggagggctgtgagacgatggatctccatccgacgtccgaaaaattatccgtactttaaagggtactttgctctttctttttttttttttttttgagaaacagggtaactttactctcatatggataggatatatgccactattactttacattctgatggctaggttagtccaagattatctaaattcgatgtttctgtttggttactgtagaacgttggacctttcgaatgcgttgaacaaccacatcacgaggtgatcgccggccttaggctgaggatgaagggcaattggagatagaggttgagatagataccttacatgtggatccagatgtatttcaaaattttttatgtgttttttttcttttattcaactagaaatgaatattataataatgacgtgttcataagctaatttttacatttaccgggcctgcagaggcttaataaccatatgtttcaattgaaattgatgttctgacatgtttatgatctttagattatgctttttgaatttcactcttcctgctccaccactagaacaagctgtttttttttctcaattccgacaagtgttcgatggtaatcgtaaagtttcatgacggggatgtgaacatgcgttcttagattatatttttctatttagtaagaaaaaatgaattattgcaacgatattttacttaaccagatcgccattataatatacaggtgaatgagcttatttgatataccattagttgtcattgattgcaaacaattcctacttgtttaannnnnnnnnnnnnnnnnnnnnnnnnnnnnnnnnnnnnnnnnnnnnnnnnnnnnnnnnnnnnnnnnnnnnngtatccactgggccag

SEQ ID NO: 50600 - DNA, 1861 bp, Oryza sativa
  unsure (1)..(1861): unsure at all n locations
gtggcccaggtacannnnnnnnnnnnnnnnnnnnnnnnnnnnnnnnnnnnnnnnnnnnnnnnnnnnnnnnnnnnnnnnnnnncacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatctgcgagctaaactacgtcaagttcaaggttcgtttgttccgctgccattgggtgaatctaagcactggtgtcaaagccgacaaggaaggtttcactttagtagatctatctaaggtgggatacgtcgatgaaccatttgtacttgcgaaacaggtcgagcagatattctacataaaagacccttcaaacaggaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaagtcataaccttgtgacatgcatttgtacttatctattgtaatgaatgaagtattttgttttattacaaatgaccaaaataaaagttgtagatcctgatgagaggatcaactttgtttttgaccatatttcaatttgaaatcatgtagtatttacaaatgctgttaattagatttgttatattgtcaaaatcaatttcaagttgttgggaaaaaaattatatagaaaaatgaccaaaataaaactagtagatcttgaaaggctctacaactttgttgttgaccatatttccatttgaaatcatttactatccaaaaatgtattatgactaataaaatgaattattacacagcagctatatattttgcacccacaacaaataaaagatggaaaatgagtcatcgtgacgggccttagttcaagcccgatagagattaatctatctctatcgggcattatcttagggcccgtcacagatgagtcatccgtgacgggcctaaatgtcatctcaatcgggcattattatggagcccgtcaccgatgagtcatgtgtgacgggccctacggcaaagcccgattgagatgactcatcactcttttgtaactagggtttctcagatcggattgaaaaattttctaagtcctgctatagtttcccgcctccttagaaccctagcgccgccgccaactcctacttcaccgccaccgccaccgagaccgtcaccgccgccaccgagcccgccgccgcctccaccgagcccgtcgcctccaccgaccggcgacgccctccaccgaacctggcgccaccgccaccgagcccgccaccaccgccctcgccaagcctgccgccgtcgccaccgacgttgagcccgcggctgccgccaccgagcctccttggcccttcattcggaccaccgccacttcttcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccaggnnnnnnnnnnnnnnnnnnnnnnnnnnnnnnnnnnnnnnnnnnnnnnnnnnnnnnnnnnnnnnnnnnagcagtttcattccgcgg

SEQ ID NO: 50601 - DNA, 1206 bp, Oryza sativa
  unsure (1)..(1206): unsure at all n locations
gcgcgccagtgagtacngctnnnnnnnnnnnnnnnnnnnnnnnnnnnnnnnnnnnnnnnnnnnnnnnnnnnnnnnnnnnnnnnnnntcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggaggaattacatgcgaagaagtcgacccccgagtccagagctagaagcgaggcatatctcttgctccagaccaggaaccagcatccgcaccggctgggcaccgccggatatgccagtaaggaagaggaatggcaacgtgaggatgaagaagcggaggaatcatgcacaccgctcgtgtttggcgatatcccacaccctcgggctaggaactgggccagggccaggtaccagaagaatgatgatggcacaatcttcatgccaaatgcagaagatcaacgagtgtacgaagctatagtaagtgtctagtcaaactagatgttcgcattgtttcccatcgtgcagtttatttaaccccactaaattgtaatgcagatggagttggttgccgagcaacaagcctcgcaagaggcctgctctcaaagacgtgaggacgacctcctcacgaaagcgttgggcaacaaggaacannnnnnnnnnnnnnnnnnnnnnnnnnnnnnnnnnnnnnnnnnnnnnnnnnnnnnnnnnnnnnnnnnnnnnnaagtcattcaaangactcg

SEQ ID NO: 50602 - DNA, 1030 bp, Oryza sativa
  unsure (1)..(1030): unsure at all n locations
ccccttctccccctaaggaattactttccaaaaccctgagccaaggggaaggaaagggagaaaaggtgcggcctcggttctagctcaaggaagttagatctggcaaggccaagaaaaaaataagggcaaaaggtcaaaaaaaaatacgttgctccacaggagttcaaactaggcatgccattgggtgaagatgacgtgcttgccacaatgggcaccgcttggaaggaccttcacttatactacatggagaaatctaacgccaggaagccgagtaaagctaccgatatcttggagagcacgatggaaagccattccttggtccaacaaattatgtcgtggtcgacttcaaggatcttttcgacctctacaggctccgaacggtggacacaagcctccttaagtgctactccttgtaagtattgtcgcccaactcattctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcctgccgagacaaggagtacattatgtgcgcctataatcaatagtaagtgtgttaactaaatatacacaacaaaatgacacacattccttgagtacttaattaactttcactatattaatgccgcagtgcccattggatccttctggtcataacacctaagtggagtacatgtcactacctgaactccagaattgataagaacgcatataattggaccccaattcaactagcaatagatgaagcgtgggcccaatatgtgcaaagaggagacctcaggaagacaggacatgacaccctcatccacaaaaaagacttcccggtgaagnnnnnnnnnnnnnnnnnnnnnnnnnnnnnnnnnnnnnnnnnnnnnnnnnnnnnnnnnnnnnnnnnnagcggtctacttgngccacg

SEQ ID NO: 50603 - DNA, 1386 bp, Oryza sativa
  unsure (1)..(1386): unsure at all n locations
cgtgggcccagtannnnnnnnnnnnnnnnnnnnnnnnnnnnnnnnnnnnnnnnnnnnnnnnnnnnnnnnnnnnnnnnnnnnnnnnnntataataccacgtctaaggcatttgttcaggaacaaggggaatgctagaatgatgcgatggcacactgaagagcgtcaacaggacgggatgctgagacacctcgccgatggttcgcagtggcgaaacatcgacagaaaatttaaagactttggaaaggacgcacgaaacatacggtttggtttgagtacgaatggcatgaatccttttagagagatgagcagcggccatagcacttggcccattacgatgtgtatctacaacctcctcccttggctatgcatgaagaggaagtacataatgatgccgattattattcaaggccccaagcaacctagtaacgacatcgatgtgtacctaagaccgctggtcgaagatcttaaactgttgtggaagaaggaaggtgtccccgtgtaggacgaggacaaacaggaggagtttaacctacgagtgctactgttcgtaaccatcaacgattggcctgcacttagcaacccatccggacagtccaacaagggggacaaggcttgcactcactgtatggatgaaacagaaagtacgtatcttaagcactgtaggaaggttgtgtacatggtcatcgtcgattccttgcagcaaaccacccggtacggaagaaaggcaagcacattgaacataaggcggaccaccgtacgaagcctaaacatcgcagcgggaaaacagtgtttgctgtggttaaagatcttaaagtagtgttcggaaaggggcctggaagccagcctatagagagcgaagatggtcacgcggcgatgtggaaaaagaactctatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataannnnnnnnnnnnnnnnnnnnnnnnnnnnnnnnnnnnnnnnnnnnnnnnnnnnnnnnnnnnnnnnnngggcgtgccaatcgangttcaactct

SEQ ID NO: 50604 - DNA, 1553 bp, Oryza sativa
  unsure (1)..(1553): unsure at all n locations
atttaataaaatttgctattacgtttatcccttatttactaaaacccaataattttcgagtaattgcattatttttcaactttaatattttatgcaattttttctatttagaaacacatatgtaatggaatttaatatccagtgcgcttatcagtagtgcggttctttaccctaccggagtttaaaagaatttggaaatagcgggaaaatatatttagtcccggttgatgagaacaaccggtaaagatatctttactcccggttgttctcattaactgggactaaagatctagaggtatatatattcccgatgtgcgccctcgtcttctctaccaacacttagaaatttttgccccgatcgatctctctcggcttctccttcgcagccactgcctagggcatccccgcaccgacgccgccgtcgtatctcgacgccgtcttgcgcgtgtcgtcatcgccgcctccgctgccgcctccgaccccgacctcgatgcggccggcaccggcgacaacgtcgccctggcagtgccgacgaagccgcgccacaataccgcggcgacacgacacgccgggacgccacgacgccgccgcggcacggcaccgccgcgccgccccgccgccgccgcacccaaagccgcggccgcgctgccccgccgctgctccgctgccgccccgtgaacgaacgaacgtgaacgagaacgtgaacgtgaacgaacgaacgaacgtgaacgtgaacgaatgaacgaacgtgaacgagaacgtgaacgaacgaaacgtacgtgaacgagaacgtgaacgaacgaacaaacgtgaatgaacgttaacgaacgtgaacgtgaacgaacgtgaacgaacgaacgttaatgaacgtgaacgtgaacgaacgtgaacgtgaacgaacgtgaacttaatgttgtatttgaacatacgtaaacgaacgaacgtgcgtgaacgaactttacttaacgtacgttaacgtggacgcacgtgaacgaacgaacgtaggtgaatgaaacgtgaacttaacgagaacgcgaacgtgaacgatcgtgaacgaaacgtgaacttaatgagaacgcgaacgagaaatacaatatatgttacttcgcgtttctcctaatacatctttttgtatgttgcagaaaagacgttgtcgtcgtcgtccctcaagccggagtggttgctagccctcgaaggaattcgcgcaggcaagtgatgtaaatatatgattgttagatttttaacgcaattaagactattagatttaatatacgacacttagacttagcattataattagagttttaatataatattttttgagttttaatataagattattagatttgtaattagacttagtatataattattgactagctagggtcctaatatacgtcacttagacttagcatagttgactattacagttttaatacaatattatttgagttttcgtatacgattannnnnnnnnnnnnnnnnnnnnnnnnnnnnnnnnnnnnnnnnnnnnnnnnnnnnnnnnnnnnnnnnaggggtagctaatggggcac

SEQ ID NO: 50605 - DNA, 978 bp, Oryza sativa
  unsure (1)..(978): unsure at all n locations
ccgggccattgagtacagctggnnnnnnnnnnnnnnnnnnnnnnnnnnnnnnnnnnnnnnnnnnnnnnnnnnnnnnnnnnnnnnnnttaatatatggtcaatatgtctctctcacatatttttttggtcttgtgcctaagccggctgtaatcgtgccatccgcttcttctctcactcctctcctctcttatccacctcagtattcagtcttcttatggccttaaaaaatttatggaactttatatccttatgtccggtgagtacaaaagtaaagtggaaggaataatttttttttgtttgcggggaaaaaggaataaattttagaagggtaagtacaaaatgcaggatctggggtacttgcccatcctgatcagtatacttatagctgtgtctcagatatccatttcacctataacttttcaacatgccaatgcacgagaagcactcttaccaagaatatcactatcaacacaactatacaggtactagctagctagatccaataaacacgcttgttttagtagtgcgtctgcaagcaattaagctaggaatcaatcagataacataaacaaggaccggatctatagtcgatactactagatctggtaaatgcatgcgttcattgactaaatctacacagccttcactaggtgatatcgcttacgtagttgggaaaaaaaaactatagttgttttggaattgttactgacatttagtatagtcactgcttgcataggactagtaaatgcatccatagcgtatagttcatatgcgatactagagaggtgggacacacatcaatcataacaattaggaaaatttgttacagggtataaaacacctatagaaataatcataggactcacccatattaaaatagaggaaataatagagaggtgtagcttgcaacctgtaagcacgatttatctgacatgagggtccaaagacactctcgtaccatttgaaccaaggacgagt

SEQ ID NO: 50606 - DNA, 2652 bp, Oryza sativa
  unsure (1)..(2652): unsure at all n locations
cgggccagatggaacncatgctnnnnnnnnnnnnnnnnnnnnnnnnnnnnnnnnnnnnnnnnnnnnnnnnnnnnnnnnnnnnnntgcagaaatccatttatgggttgaagcaagcatctcggagttggaatattcgttttgacgaagtagtcaaggcgttgggctttgtcaaaaatgaagaagagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggagaagcagcatatattatgggcataaggatctatagagatagatcaaagaggctaattggattaagccagagtacatacattgacaaggtgttgaagaggttcaacatgcaagattctaagaaaggcttcttaccgatgtcacatggcattaatcatggcaagaatcagtgtcctcaaacgactgatgagcgaaacaagatgagtgtgattccatatgcctgggcaatcggatccattatgtatgctatgctatgtacacgtatagatgtttcatatgcacttagtgcaacaagccgataccaatcagatccaggtgagagtcactggatagctgtaaagaatatccttaagtacttgagaagaactaaggatatgttcctagtctatggaggacaggaagagctcgtggtaaatggttacattgacgcaagctttcaaaccgacaaagatgattttagattgcagtctggatttgtgttctgcctgaatggacgcgctgtgagttggaaaagtaagatacagtgtctgattctacaacagaagccgaatacattgccgcttctgaagcagcaaaggtttggataaagaaatttgtttctcaactaggtgtgatgactagtgcttctagccctatgaacctctattgcgataatagtggtgccattgtgcaagccaaggagcatagatcgcatcaaaagtccaaacacattttacggcggtatcacctcattcacgagatagtgggtagaggagatgtgaagatatgcaaaatacatacggatttgaatgttgcagatctattgacaaagccactccctcagcctaaacatgaggcacacactagggcaatgggtataagatacgttcatgattgactctagtgcaagtgggagactgttagtgatatgccctagaggctattatagagatgattgtatcacacactatgtttacatatttatctgactttgttccttgaaatagataaactcattattggttaatgaatatgtgattctttcatgagactctttatgttatatgttgctatttctaaaggatccctgatcaaatatcatatatggaacaaatatgtttagatgatcaacacatgtattaattgatgatcatgtctcatggatcatggtatagagataccaaattaataatgtggacacatgttagtgaacatgttgttgaatagacccaacatgagacactgcaagagccatatgtgttgtgtcatcagtgatctcatttagtgttggtgttgaatccatagacctgatattatcatggttcccaacatgtgtagtagcttacttagggacagctaaacgctactccgtaattgggtagttataaaagtagtttttgggtatgctatgaaacatgtagtgggatatgaataatcaagatgggatttgcccctcctatagagagatatctctgggcccctcgatgttgtagattatggaagtgcatgaccatgccaaaggtgattgagtagtcaatcacaagttatataatctatcaacaggttcaagtgaatgattgagctattagaggatggcacatatctagccttgagcttaatcgatatcgtgaggcaaaggggttcatacaagtatacagtagaggttcagccgatatgatctttatgtatgcccggtaggtcaatacgttctgctacgggccactgttgacgcgtggaccgaaaaggagttttcgggttacagccgagtatacatgaacctaaagggtcgcacacttaatgggccggaataaggggattggatggagatccaatatgagcttaattcggatagggatccgaataggagtcctacgggccatgtaggcccgagtgatggatcctatatattcgtgaggggtgtgaccggcggaggcattgcatcacgtgagaaaccctagccatcacttccctccccgagcaaaaaattagccgcacgcgggtgctagcacatctgcgcgtggcgttccgtccttgtacgtgtggataccggtagaggcgccgctggtttgtggtgctgatcggcgtgggagtacggtgaggagaacgcacgaagagcagaaggtcgagctgatgccgatcgactacttcctttacatcgacgcgcgctacttcgcgagagttccttcgacttctcagcgtcttcttccgctgcgcagcgcgtcgagtggtaacgatctatgatctnnnnnnnnnnnnnnnnnnnnnnnnnnnnnnnnnnnnnnnnnnnnnnnnnnnnnnnnnnnnnnnnnnnnnnnnnntcactgcaaantcaaaaggccagcg

SEQ ID NO: 50607 - DNA, 1783 bp, Oryza sativa
  unsure (1)..(1783): unsure at all n locations
cggcggaatgatcgacnnnnnnnnnnnnnnnnnnnnnnnnnnnnnnnnnnnnnnnnnnnnnnnnnnnnnnnnnnnnnnnnnnntcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatcagtgacgggccacaacttgaggcccgtttgagataacaactaggcccgtcacagatgactcatcagtgacgggctatatacttaatctctatcgggcattaactaaagcccgtcaccgatgactatttttccatttttcatatgaaatgtttatatttgtaagttgactatagcaaaataatttttacgggtagttgactagcccatcacagatgacccttatctgtgacgggcattaactatcgcccgtcacagataagggtcatctgtgacgggcgctagttgtggcccgattgagataggtcatctgtgacgggctatagtttgactggtcgtctgggtcaaagctatcggtgacgggctttacttagggcccgattgagatagaatcatccatgacggccgtttgcccgattgagatagctcttcacatcagtgacgccatgcccgattgagatgggcttaccacccgattgagatgagggtatccgttctagtgacacccaccactgcagcagcaacgccggatgttagagatgacgagttcaccattaaagctaggttccactagcagttcttagtctaacctgaatttctacgcttgggtgttttctgaaatttatatctcaagtataatccaaattgtcatgataatgtttgaagaaagaaaaacaatagctagaaatcctgagaattttggcaatctcttgtgcacgaagccaaactccaacaataatcagtagcatatctgccatgattttcatttttacctttgaaagcagctttccgaatggttcccagttcgttatgagttggatcgtcggaggcaaggcaatgttcacttagaccatagtctagacggtctagaccgcgtctagacgctagacgacgggttatcgtctagtttaggacctaaactgtgaattagaccgtttgaccgtctagtcggtcaactagaccatctagaccacacaattaaacaacatttagatgactgtagaccgtaaacctatcgtttagattgtggtctaagcaatagatgtgacatcccggcccaataaggattaggcctgtgtagcccatgtgagctgtgtccgcatgtttagtaccaccttgctagtttagcacgagtggaaccgacttatgaggcctcttccctccaaccacatcactcccgggttaacccttttacacgaagcaaggacgaaagtgtaagtggggtggtgtgtgtaagtgggcccgctcatcggttgggctgggctacgcggatctggagggagggctgttacaaatggtatcagagccgaccctcgcggttgcgcgtacgggtcagtgtgcgggcatatggcgcatggcgcatgtgcgcactgtgtgaggcacaaggcatggcatatggcatcgacactggacgtacggatgtgcgctaagagggggtgtgttcctggacatttgcctgtgtggctgggtaagttggacn

SEQ ID NO: 50608 - DNA, 2072 bp, Oryza sativa
  unsure (1)..(2072): unsure at all n locations
ggggttttaggggattttccttcgaaccaaatcatcgcggggttaaccttttaccccaaaaagggcacaaaagtgtaaatgagngtgttgtgtgtaagtgagcccgcttcttcggttggggtggattacgttgttttgtagggagggttgttacaataggccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaactacttttatgatatatgtaagttacttttatcatatatatatatatatatatatatatatatatatatatatatatatatatatatatatatatatatatatatattacttttagatttgactaagttacttcttaaacattcataatgctctaaaatgattatttttattatttattctagtcaattctataatttctggactttaaatttaatttttagatagaccatatttttctccttccaacgaatttacttctaatggtgtaataacttacttccattttatgtttgtcaaggttatggataccatatacctaatagtagttaactaaatctcggcaggacccaccacataccatgtcttatacggaaacaaccttcggatataggaggagttccgcataaggaaggatgaatagagttctacatggaaacgataaggactactcggattgtatccatattggtttctctagttctatttggacaagaggacacctatgggtataaatacaaggccccctaggaagagaggggacactgaacaatagatcaagacacaaaatgaacatacaagccaacatgcgccaagacaagacgctggatatcgacttcagagataagcatggctagtcccctacggtgtctacggatactgtcaggagagacatagcgttgtctttgatctcgtcggatgtggattcgaggaggaaggctaccgactacgagtcagcactttagaccgccagatcgacaacagttagataggctaccccaaatattgtactggtgtgattatggtgaataagagcaacgaccggcttcagccaacaggagtagggttattacctgacaattcaggggtccgaacctgtataaaaatcctcgtccctatctcttttcttacaatctagcatatatcctagtaccaacgatccccatactatgcaaataccggaatcgcgacatcaaacatcgacaatgttaagttgcttttatgatttatgtaaattactttaagactttattgaatttactttcataaatgcatttaattaaaaatcttctctacatttttctcgtgaatttactctacatataatttcttatttcaactcagtcataacttagttgcttctaatctatagagagttacaatttaaataaattacttttaaattaataaaatgtttaaatatattcaacatggatcttgttttatcatatattttatgtagagtacaataatataaatatatcttgaagataatatgtaatttaaaagatataagttattaaagatgttaaaaaaagacatgcaccatatactaaagggagaattatatatggaatggagtggtctactgttaggactaaagcactaccatgcgagttcagatcccctggagttgaggccaacttcaccagataggtttgggtaaatctgaaccnctcggtttgcttctacagcttgcatnctttccccccccccccccttcccttgatttttattatgtccattggaagggaaagtttccaggggtccccccataatattaaaccccttccggctaat

SEQ ID NO: 50609 - DNA, 7995 bp, Oryza sativa
  unsure (1)..(7995): unsure at all n locations
tggaatgannnnnnnnnnnnnnnnnnnnnnnnnnnnnnnnnnnnnnnnnnnnnnnnnnnnnnnnnnnnnnnnnnnnnnnntaaacagaatacaaggcacattctttccacaaagaacaaatcaatacgtagtgcaataaactaatcaaacatgcatctctttctccacacacaacatgacttgttagagcaattcagagcgacaacattcaacacatttcatcaggagaaccgtatggtatatccccgaggccacgcactggccatcgtcggcaccgcgtgccactgacaagccatggccgctgcgccaggctacacgcctaaggacgtactccctctgtcccaaaaataacttacctaggatgggtcacatcctatcctagattgagctattttgggacggagggagtagaagcaaaacttagattttttttataataattattaagagatatgatctcagccgtagaagaaaaggagggtctatatttggccaaatccacctggtggggtcgtccacaactccaggagatctgaacccgcactctacctagtcacgtccatataggcaagatgggtaagcagatgggcaagacaaattcggatggaaaaaattccaccttgaaatttttaaaaaaaattcaaaaaatttattaattagccaaaagaatattctatacggggaccgaaaatgcaatccaaaattcaagatgggtaagcagatgggcaagacaaattcggatggaaaaaattccaccttgaaatttttaaaaaaattcaaaaattttattaattagccgaaagaatattctatacggggaccgaaaactgcaatccaaaatatgagccagccaaatcctagtcctttaaggcagaagacaattttccacgggaattagttattggtgaagaaatagagtgcaggtatcttctatgattatgctataatctatatatgaacccctcattgattgagcacgttctaggattggaatttggatttgagggcatttcacacatttcccacatttgtctgttatcgttcaaatcacttcatgtgcatcactaaacatatacagtacgtgcgttctcttatcttttttattaaactagtgaacgtgcacgtgcaaagacacgttatcgtaatatatattattgcaaatagaaacatatcaattattaagtgatagttacaaaataacttatcccttctattaaaaaaatgtaattgtaaaacaatgctgtcaccttagcaatctgcaaccaacaaattaatgtttcatgactattggatacatgtgagatccctagctagatatgtgaactaaaagcatgtaggatttctttcaaaaacaacacaagggaaaagaaatcagatttgatccttatgggctttcaccttgtcaaattcagtgtcctatactctcatttgatcataccagattatataagatttctttcataaacaacacaaggaaaacaaaatcagatttgatccttatgggctttcaccttgttaaattcagtgtcctatacttcaaaaaaaggtatcttgttgctgcctctagcaaatccttatgcacattctagttcttgaaaatgtcacaaatatacataacttatgatttttttttcaaaagggaaaatgtcaatatcaacatttgctttaggcttgtacgatgctattgtctttatgatcatcacgattcctcgtgtttttaggaaaaataaacacaataaaatgatctagatttacctacaaaatatcagcatacgtatagaaaaataaatgtaaaactggatcatggcatcttgcagttacagaacaaattgggcaatttatcaaacttgggaagccacacataagagagcagatttatatgctttttagtgcatgtacaattcatacaacagaagttaaacaccattatatttgccaatatattcttgagaagttaaatacatttcctttctatggaatcccaacttcgcctaagcatctgtagctagaagtgctcatctcgtccctttcctatgtggtcttcctcaaaaagactcaccagagatggttgcagcggtgattaactttctgaacttatgtcatatcttacaaagattcctctccaacaagctcatttttgccacataattcctcatatttgagctccctttggtgcatctgcttgttgccctcctccaaacctatggctagaggtgccaccatcccaagtaggttgcctcctcttgcatgcacagatgaaaaaaaaaggtctattaagaactcgttgaaatgctgaaataatccaaagagcaatacatatatagaaatccatattttaattacattgatagcacacattgtgccactggttaaagaacacagaaagtgagaatatctgaatctgtgatgttgaacctgatcatcacctaattctctgatatttatactaccaattagattccccttgactgaccagtaggatgagacagccttcctgatccaaagcacaccaatatatcgtcatcagtataatccttcagaataaagctcatagaccacaacaagttcaaaaacactacacttgaatgcaactttaggtttatacagacgttagtgatgcagtactttgcagagtcaactgaatgcaatcaaaagaggaagttacaacttgtaaatataaaggggtggctgttgatgcgaaaaaacacacactggcctgggagatctgcttaactccagtgcatgtcctaaatcttgctcttgggttcaaaggcgtgccagttgatttgatcttgcaatcaacaagaaggaaaaacaagaaagacgaggttaaatccataaacgataaccgatcggctaagggccgatggcatatcgttaatcattgaaccgatgttactggcattagatcgacaatgaagaataaagcaatataaagttaaatctactcgattggctatagatatcaacgatatataatcctcttctcgagatatatttaagccaagtgattgggatagatcgaacagtaagtcgagacaatataaatcacttatgcttaaaggtactttaagatgaagattatatatacgttcatagcatagccgatcaaatagatctaacatgtatcgactaatactctgatatcactctttattaagatattaaaacagacaaaatatatcaaacgacaagtctaatatactttaatgcaataagatcttaatataaaggacagatttagcatatcaagtgaacatgtaagcattaaaggtaactaaatcaggtaagatcggctgaaaccccgatactatatctattgatgatcataagacaagctagatattgcaattatgaatattacttaatagatcaaactcaaccgatgcagcattaagcataaaaataaatacaagatctaaacaggttgatgaaaacctctgaaagatggtagatatgctatataatctagattaacaacgatatctaactctatcagctgccttccaatgatagatgttggccggtttagggttagattatgatattaataaatattatgaagcatatatgataactcaatgatttacataaccaagattagagtgtcataaagatgtaagcactaatcccgagaacacaagtcgtcatgacaagttttacctcttgttgaagatcgaaattgatgcagctcaacccaaaagcaagaactcgtcgaaacaatgaaaatagaaaaaggtggcgatgcgccgaaagtgttattaaactgtcgttagatgtttacatgggatcgggttatatttatacccgagatacatgactggtccttgccgaacacgactcttatctctaacaaactctaagatacgaacaagtcttcacgatagactcttgccgaagcatatgtctaaataaactttttaaaatatcctaattaatagatacaattgtctatccgtgtgcttatctcaatcatggtaatccttgcacagcacgttgatcaatctcggagacgattatataaccaccttaacgagatcagctacatcggctgtcttctgtctgatttagccgatgcagtcttcagccaatgccctcgtagccgatgcgtactctgtttccagaagacaattccctatcaaatccgcttcgatcccgatgccgaatctagttcatggcttaccaaatttgatcgttaacagtggcctggacattgaactgttattttttttcactcacagatctcctcgctgccttttctctggtacagaacaaaaaacaaatttcctcactgggggattccatcgagcacctactacagaacaaacatgatacctaacagagtttatatccacaatttatggaaacaaacatggtacctatcctagttcctggacaggtttgtgtgactatagaagcattagtctcttcacgggttacattttcttgaccttgagcagcctttccatgagtgggaattacaaatagagagcatgtttaagaaaatggatgaagtattatacttgcttgtggtgtcattcgagggcaccagcctcactggggcatccggactggcaacggcggcgatgggtgtagcgacctgggggcatggaagtgaagtgaggaatcatgtgcatatatgtaaatcaaaaacaatatcatttcaatgacaatgtgagaataaaaataaaataaatagaaaatctagattatcacaagtggagcatcacaggtggtatgtaaaataaaaatataattctgttgtttcattcatacgaaaatttcacatgtccatttgccatgatcaataaattcagagagaagtatttcctctcataacagcacgacaatgacacttcgatagaaaaaagaaattcttgtgaaaaaatccacgtttgttttcattgttccattttcttttgaataaccaaacaccatattaatttgcatttaagaaattaacataaaagcctgagtatggtctgatataagatgctttctttaatgtgtaatactcataatataaagcttatgtcaatttaagaactatacattaatgcaagaagaattgttggtatgtgcagacaaataaaggttagaatgtactaatctaagaaaaggaaattaacatagcactctttgaaatttgaaacaatagggatatgtctcaatttcttagattatacatagttggttagatgttgctctgaagaaaaataagcatatttaatcataaataaacataatagaccatgcagttcttattcaatagaacatatgcatcatgggttaatcccatctctgtagaagcaggtcatcaaggcatataaatacgaattaacattcattgacaaacgtaactaaactctgattttgcttggtgcctatgctttcttaccctgcaatgccatgatgtccctcttatctaccttgacaacgacaaaatccatttgttactccataaacaaaaataataaacaagatcatgataaaaaggaagatgatcaccaataaaccatcattgtaggcaatacatatgtcaattgtcaagtcagtgtgtagtaccatcacagttttagtcaattagcataacttccagtaaacagatgaacagaaattgtgcgacagcaaggtagtagtaaggtggctgctgctcctcgctggagtagccctgataccccgaaggagaatggtttggcaacaagaatctgaatcaatcagggagtcaagcaaaaacctgggtagcctcgtcatgggtaggatagccaccgccaggatcaccattgtatataaagatcagaaagttacctctatattggcctttgttagtgtcctcttctctcgaaagtaatgaaaaaatacataaagattttgttcatttaaattaactaataaaatgtgcattcaagggaaaacctattttctaaatatcatgccagcacgcgcatctacattcaaaggaaagcaacctaagccattgatcctgttcacttgtaaaatcttgacaaatagatattttaaatgaccatcagaatcatgacaagagctagctatatcgtttgaagatatattattttcgtaccaactatatcattttatgaattgggtctggatttttgaatttatcctagtgatcgaattgaaattttctgttttttgtgtgcatttacattcttaaattgattgttcagggtactgatttgttgctacttgattagcccgcaaatcttattgttttggataccatcaagtggctagaggctggagagctaccttaagacacaagaagtgtcgataatcatcatttctcacaacagggcttttctgaatttgtgtgctctgtgatgactgatgaagcaatctgaaattctgaatgtgttcgctgtctgtactcagaaattcaaagaatgtgtattgagtttgtagtgtatttgtgcatttttgccaaaatctgagaatgtctacaactggttcattgatcaaaacgtgagcataggtatctctgattttttttgtcacaacctgaccatgtaattactgccatgattctgcaaaatgtgcaaatacattattcatcactaatttaatatagtcctaatggctgtgacttatctaaactcatttttttcagtgattgattctatatatggactgcacatcatagccataggtacggcaccactggtataatactccctccgtttcaccataagtcattctagcatttcccacattcatattgatggtaaagaatatagacatatacatctatttagatttattagcattaatatgaatgtgggaaatgctagaatgacttaaattgtgaaatggagggagtagaacataaggaggcgattggaggaaagacttaaaagaacaccatatatagcaggatgaacaacaggaagatctttagaagttatcaacgaaacatagccataggttcgctggaatcaaagaatttttttttacctccacgagacgaccagttagctaggataccgccaccttctccttctcttgatcctcattgacttgcataaagtatgtacactagtaacatcgctactcatttctatttctattttctccagttactctctgcccctatctgtagctttcccatcaacattacaaatgtgaaatgtgatgccctgtacatggccaaggtgaattatactctcagaaatctttggtgcctagctaaagaacaaactccagttttcagtttttcaatcaattcccctcccccgtcccaccccctctctctctctgtgttaaaataaaattcattgccgtttctgatcaaatacaaaagaaaggacaaataagaagcggaaggagcaaatcaagaagacgatggacgtgacctggtggcggtgaatcggcgacggcgctagggatggatcggcacggggcagatggggcgacggtgaatgctcgacgacgagcttagggtcggcggcggcgccaatctggcgaggctggaggtcggatatggccgaactggtggaagcgtggacgacaaatgacgcggggcaagtatggcggattggagcggccatgctgcggggcgaagtcggtggcggaggggacaggggcgccgggcgcaacgatgtgcgagggaacagaggaggagcgacggggctgcagcggcttgtagcggccgcaccatggggcgaagtcagcggtggagggggacggggggcgcagcgacgtgcggaggatggcatgcgacggcggcggggttacaaattgcgtgcgtgcttttctgccagtgaaccccgcagcggcttcggcgggcgcgcgcccggaagtcggcgcggaaccccgtgcgtgcaaagaggcggcgaggtaaggcgcgcgactctccaagaagcggcgagctgctttcgcatgaagccgtctgcggcgggcttgccagccgagaaacttttttcgtttttttttcgcttggacgaaccctaacccgctggtaaaccttgtagaacg

SEQ ID NO: 50610 - DNA, 860 bp, Oryza sativa
  unsure (1)..(860): unsure at all n locations
ctctcaaaaggcaatgtagaaggtttctcctgtttattatttcaagaactcatatcattattctctgggattggtgattgctttctctcagttttatcatttccttggttgagtgacaactttgtacttcccctacagttatccatctccaaccaatcctacaataaagaaaatgtcagtatgttgataaaatattatgtaccctagaaggaaaaaggtgccatccaaacattaccttgggcatcaatttagctgatttgtcagatgtagcatcaacagtattgctgtcttttgcggcgaaggtaaatttagcagcgcagttggagttattaggtaaagactccttaactcgtgacgaagatggtttcaaaagactgccctgtgctgatacttcagttttctgagaaataggatcctcaacatctaagatgtccacatgcttttgccttgttgctaatgtgccttccttctgtgaaggaattatcgtatcaagctgcttcaatatctttgcagccatttgaattgactgtgctggtgcctgaccaaaactgctatcatttgctctgtcatgtacaccacttcgagtaatatcaccaactttatccagacacctacgtttttgactttgtactgagtgttccaaaccttcatcaagtttgctagcatgactaccactatatccacggtggcctgaccgagtttgcaacagtggtgacactctgttgtacctctgatgcattttgcgtatgggaccaacagaggcactctcgttannnnnnnnnnnnnnnnnnnnnnnnnnnnnnnnnnnnnnnnnnnnnnnnnnnnnnnnnnnnnnnnnnnnnnnnnntcatcatggccac

SEQ ID NO: 50611 - DNA, 1445 bp, Oryza sativa
  unsure (1)..(1445): unsure at all n locations
gtggcccaggtagaacacatcctnnnnnnnnnnnnnnnnnnnnnnnnnnnnnnnnnnnnnnnnnnnnnnnnnnnnnnnnnnnnnncacccggtacggaagaaaggcaagcacattgaacataaggcggaccaccgtacgaagcctaaacatcgcagcgggaaaacagtgtttgctgtggttaaagatcttaaagtagtgttcggaaaggggcctggaagccagcctatagagagcgaagatggtcacgcggcgatgtggaaaaagaactctatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataaggggtatcctttccagacaatgttcgggcaacaataacaaagctatgtgcattcatgaacgcaatttcgcagaaggtcaccgatccggatagattagaagcccttctgaatgatgtggagttttgagttgatatttccaccttcatttttcaatataatgacgcatctgctttgtcaccttgtcaaagagatcagtattctcgggcctgtgtacctacacaacatgttttctttcgagaggtacatgggcgttctgaagaagtatgttcgtaaccatgctcgtccagaggcaagcattgccaaggggtatggaacagaggaggtcatcgaatttcgcgtagaatttattgaagaccttcgcccaatcggggtacctgaatcacgccatgaagggagactacggggaaagggaactcttggaaggaaagcaataatgacgatagacaacaatttattccgtaaagcccatttcacgtttctgcaacaatcttcattggtagctccttacatcaaggagcacttggctctagttcacgccagaaaacattggtaagtcccatgcatggattacacggcatcacattgatactttccgcgcgtggctatgacaacattttatgggggacgagacgatcaaaccacaactggcctttctggtgagggggaccatttggtcaatcgcgacattttcagggtattagaacaagggggcaccatactatacgagaggcccagaaatggagaggaccaaccaaaacagggttgttggat

SEQ ID NO: 50612 - DNA, 807 bp, Oryza sativa
  unsure (1)..(807): unsure at all n locations
cgtggccccattgtaattannnnnnnnnnnnnnnnnnnnnnnnnnnnnnnnnnnnnnnnnnnnnnnnnnnaacgacaactataaacgattcctagttgttaaacaacataatggttaaagaagccttgccgagcatatgtgctaccgtgggacaatttatacttgccaacagaaggaccagatttaatactgtaaagcggtcaattagcgcgacacgattgatcttgatctgcgcactgattaggtacaccaggatcatcactgtaagaaatccgttgggcttggggacataaatcctagcnnnnnacancntgncncnnnaaanaattatgagcttggtgacttcgggttagcaaggcttgttgagcatgggggagagccacaaacaacacaagttgtcgcagggacccctggatacattgacccagaattcatcaacaaccgctggcctcgcaccgaattggatgtgtacagcttcggtattgtcctcttagagatagcttgtggcaagcggccggcatcgaggcagctgccaaatggagcttcatcactgctagcctgggtgcgtgatttgtatgaccagggcaagattcttgacgcagcagatcagagactgaacggcgagttcaatcatcagcaaatggagcgtgtgatcgtcatgggtctctgctgttcacatcaagacccgatccagcgaccgtctatcgtgcaagctatggatgttctgtgatctgcatacacagagttgccggtacctcccgcagcacatgatacaggacacatgcggtccatgcaagaacaagcttt

SEQ ID NO: 50613 - DNA, 998 bp, Oryza sativa
  unsure (1)..(998): unsure at all n locations
ccggccttagtggctacncatgctnnnnnnnnnnnnnnnnnnnnnnnnnnnnnnnnnnnnnnnnnnnnnnnnnnnnnnnnnnnnnnatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataaggggtatccttccagacaatgtccgggcaacaataacaaagctatgtgcattcatgaacgcaatttcgcagaaggtcaccgatccggatagattagaagcccttctgaatgatgtggagttttgagttgatatttccaccttcatttttcaatataatgacgcatctgctttgtcaccttgtcaaagagatcagtattctcgggcctgtgtacctacacaacatgtttcctttcgagaggtacatgggcgttctgaagaagtatgttcgtaaccatgctcgtccagaggcaagcatcgccaaggggtatggaacagaggaggtcatcgaatttcgcgtagaatttattgaagaccttcgcccaatcggggtacctgaatcacgccatgaagggagactacggggaaagggaactctcggaannnnnnnnnnnnnnnnnnnnnnnnnnnnnnnnnnnnnnnnnnnnnnnnnnnnnnnnnnnnnnnnnatgacgtgcncaacatgggcccg

SEQ ID NO: 50614 - DNA, 1464 bp, Oryza sativa
  unsure (1)..(1464): unsure at all n locations
cgtcgcccatgaatggacactcnnnnnnnnnnnnnnnnnnnnnnnnnnnnnnnnnnnnnnnnnnnnnnnnnnnnnnnnnnnnnnnnnnnnnntcatacaagtatacagtagaggttcagccgatatgatctttatgtatgcccggtaggtcaatacgttctgctacgggccactgttgacgcgtggaccgaaaaggagttttcgggttacagccgagtatacatgaacctaaagggtcgcacacttaatgggccggaataaggggattggatggagatccaatatgagcttaattcggatagggatccgaataggagtcctacgggccatgtaggcccgagtgatggatcctatatattcgtgaggggtgtgaccggcggaggcattgcatcacgtgagaaaccctagccatcacttccctccccgagcaaaaaattagccgcacgcgggtgctagcacatctgcgcgtggcgttccgtccttgtacgtgtggataccggtagaggcgccgctggtttgtggtgctgatcggcgtgggagtacggtgaggagaacgcacgaggagcagaaggtcgagctgatgcgatcgactacttcctctacatcgacgcgcgctacttcgcgagagttccttcgacttctcagcgtcttcttccgctgcgcagcgcgtcgagtggtaacgatctatgatctaatacttgcatggttcctggtttacgcgatagaaaattttgatttatgctatcgtagcctacgcgtaacccaacacttcttaccgggctgctttgctggacagaataaaacgcaaattgtgcatcttgttatgttgtgcttcctgtggtcactagcttaatacggtgttggccttggtggtgtgtccaacagtgtaatccagagagaactccattgacaattgtgtaactgtcattatcaaatagtggaatttttggagagggccgagtaggtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatcagtgacgggccccnngnnnnngncccnnngcnnnncgcgccccccgctccagcccgcccttccggggcttgccccccccgggtcggcggttttcgttggcgcgcctcggccccttgtcgctttttcgcgcac

SEQ ID NO: 50615 - DNA, 909 bp, Oryza sativa
  unsure (1)..(909): unsure at all n locations
cgcggatctggaggaaggggctgttacaaaatggatcagagcccgaccctccgggttgcgcgtacggttcagtgtgcgggcatatggggcatgggcaatgtgcgcactgtgtgacgcacaaggcatggaatatggcatcgacactggacgtacggatgtgcgctaagagggggtgtgttcctggacatttgcctgtgtggctgggtaagttggaccgacggggacgtcgggtcctttgagggggggtgtatgcctgtgtggcccatgtgagctgtgtgcgtatgtttagtaccaccttactagattagcacgagtggaaccgacttataaggcatcttccctccaaccacatcactcccgggttaacccttttacacgaaacgaggacgaaagtgtaagtggggtggtgtgtgtaagtgggcccgctcgtcggttggggtgggctacgctgttctggagggagggctgttacaatagaccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaactacttttatgatatatgtannnnnnnnnnnnnnnnnnnnnnnnnnnnnnnnnnnnnnnnnnnnnnnnnnnnnnnnnnngagagtcaagtcaacctct

SEQ ID NO: 50616 - DNA, 799 bp, Oryza sativa
  unsure (1)..(799): unsure at all n locations
gcggcccagggtaggcacgtcnnnnnnnnnnnnnnnnnnnnnnnnnnnnnnnnnnnnnnnnnnnnnnnnnnnnnnnnnnnnnnnnnnnacatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcctaagtctttctctcatttttccgcggaccaaatgatggaaccgataccaagccctacatggagtttaaagctatgattcgtagtagcaattaattataacaagattcttaattaacataggaatttatgacagtacctgtttataaagtcgaaaaccctgcaaacggagactct

SEQ ID NO: 50617 - DNA, 802 bp, Oryza sativa
  unsure (1)..(802): unsure at all n locations
actttcaagatttttttttaaaattttcacccagaattttgaaaattttcatcatattttcgaaactttcaacttaactatttatgtattattttgataataaaaactataactagattaatccatatggttagcgttgttattagtgctaatgacgcgtggctgtagtggacccacacgcttaacctcccctgaagcgatgcggaacagaaaaatatacaaaacgacgaaacaggaggaagttacggaagtgcgcgctacaaaattatctggcgcgtctgcgctaactaggagcccccccgcatttgtgcctattattgttttcgtagtatattccacggtgttaaggtgttgggcctcagcgtcaaagcccgtggtgctttggcattgtagtaaagttccatttctaattatgtttatgttaaggtctagtcaaaatgtctggcataaatcactcctatgtctaaagaaactggttattttatcactagacattttattcttgtgaccttccacatgaataataattagcaaaaaaatacgaacacccgtactgtttaagaatttgaatctaaatgtgtagatttgactataaaaaaagttatgctcagttcatgttctctcgttttattttatatccatgataaatattgattatccgtatcagtagcagcgtcgtttcaacttgtcggtaatttagtagtgtccactagaattnnnnnnnnnnnnnnnnnnnnnnnnnnnnnnnnnnnnnnnnnnnnnnnnnnnnnnnnnnnnnnnnnnnngtcgatcaatggcgacg

SEQ ID NO: 50618 - DNA, 1998 bp, Oryza sativa
  unsure (1)..(1998): unsure at all n locations
atttgtttggaaacggggggccaaatttccaacccctaaaaaaggggttgtcgggccacccccccagttgcctttgtccacaaaaatacttaattttgggggaaaaaaaggaaaaattttaggaaatatagaaaattatgttggaaaagataggataaattttagggatatatgaaggaattcgggaaaattgagaaaattacattgaaaaagtatatgggctggctaggccaaacccgtgccgccctacaagataaggtgttgccccaagaagaagatgcaaacagactgggcaggcacggcccactggttgcggatcgatatgtgcatactacttaacggagtatatatttgtacttacggttaaaacagcttgcagatagaaattacgtgcatatgtttgtaaagtgatatcgcatagatcataatctattctgttaaattttattacattcgatctttcataactgattgaccgagttacgtacaagaaacgacggaacatttttcgacagaagacacatgcaactttcacatatatatatgaagttgtacatagtaggggcatacatccaccatatgcaagcacaagcgcgcatgcagctagcattcgcttatttatctacatggagccatagcaacaagcttctaattcagggggagaattcgcatataatatttggttcagctgttgacgcagttggagcggcagtaggagccgcagtagtnnnnnnnnnnnnnnnnnnnnnnnnnnnnnnnnnnnnnnnnnnnngaggaggacgctgggtcagtgcaggcgccgctgcagccacccatcccaccggcgcacgacgagttgcagtactggtcacacttgctgcagatcatatgcaccaccgcgggctctggtaacaatacagcactaccagcacaacgcacacgacgggtacaacgactacatcaacagggaagacaaccatcatatgggctttgtaacgttatttggataatggcaagaacaggaattaagatgtgagatgtcataggcaaaatatcaggcaattccgctatttatagctaggcgactgatgctcaagcttgctaatatatgcacttgtatatatctgtgtgtatcgatcactggatattgcgtgcaggtaacatgcactgaatacgtcgtttatcatatctctgtattgacttcaaagatggagggtggtatgacataatatattagttcattcaaactatgtgccgttattcctcttgtgcttgtaaggtcaaatatagcttctgatttagttaaacacacacatatataaatcacctgagacaacgtcattaaataattttctccatgcagtttgtacgtaccaaattaagtaaaatggcccagcaactagcttagccagcagtgcagcacaaggattttaattaatcatatccatgatgcatgtgatatatattctccttgcattgcaagtctaaatgcaatgagtcaagtcaactccgatacattcatgttgatctccattacaataacagatatacgattacagtcagggtttcaaaaaccgctgggggcccggttaccgccacccggcggtacggcggtaaccgcggtaaccgcgcaaaaccgcgacaaatttacaaatcgaaatttgaattcaaaaattcgggcaaaccgcgcggtttggcgcggttaccgcgcggtttgacgcgggaaccacgcggtttggcgcggttaccgcgcgatgtgtaatgggttgcacagtaacgggccggcccatttttttttttttttcaaattttcaaatttatttctcgttttgctctcaaatttgaataaaaattacttttttttgagaaaatttcttaccataaaacacttttaaatcaagcacttaccttcactatttttttttgaattttattctttttttttaaaatttttgaatttggaccaattttatttaaaccgtaccgggcggtacgggtaaccggacccccggggtacgg

SEQ ID NO: 50619 - DNA, 809 bp, Oryza sativa
  unsure (1)..(809): unsure at all n locations
tcccccagagttatagtattggcgatgacatgtatatttcaattcaagatcaatttgaagaaacaaagttatattttctacatatnttgcagatgatggagatacgtgaagcagttaatgatgccaatgattctcaaaccctggagaagatacaatctcaggttctgttaagcacaattatgtcatggttgttatttcgaagcataaatacgcttgactgatttctaggctcgcactatatcacctttatcagattaagagaaagctggaaacctggtcccattccttccaggaagcatttgaaaggagggatttcgaccgtgcagtgaaagctacacagagaatgaggtattatgaacgcgcagtggaagaaaccataaagaagctctaattgtaaagtgtacagtggcaacagatgtggaggctagcccatgttcttggatgacccatgtttactacattgctcttaggatgaaataatgccggatgcttcctcaccaccactcaaccagccagcgctctcttcactccatggttgcaatgctgcaggaaggggaaagacatatttccacatttctcctcgctgtaaaaatatttcatcacagatatatacaggcagcactaggcagacaatgaaatggaaactgatatttgttattaccaagaattacattcattctttgctcaataagttatatgtaaaatgtgctacacttgaaaagtnnnnnnnnnnnnnnnnnnnnnnnnnnnnnnnnnnnnnnnnnnnnnnnnnnnnnnnnnnnnnnnnnnnnnnnnatcaatgngcgcat

SEQ ID NO: 50620 - DNA, 806 bp, Oryza sativa
  unsure (1)..(806): unsure at all n locations
atgttaaaaacccatgctgtggctatttaagggttattgtagaaccgttaactcttcttttttgtagagtaataaattctgttttatagtataaaaatcttattttaaaaaacgtctattttcttaaaccaatgtaaataaattttttatgtcttacataattttaggtcttatagcttttattattttaactcgtgcttatataagtaattttttttttcaagtgaccagtatcttttcttttatctttttttaatatagctatttatcgtacgtgcgtatgtatgctgaagggttcgttaatcgtttgatcgtttctttccatagtacgtacgtatgtttttctggtgtaaacggtttcacccatatctacagaatattaagagtaagcaatagatctaatctaatggcctaaaataatgggcccactaatttaaatgaaaattgatggtgagattataaactgccacgtggcaatctaggagtgtttttaggagcgtcacttggtggcttaaaaacgtttgtaggaaatttaatggacttttagtatataatagaatagatatattgataagtgaagagtactgtagggataaaacttatcaattgaactatggattagaatataggtaaaaaagtataaattgattagatttgtgacaaagttaaattttaggagttcatttattttggaaagaagggagcaagtctctacgtttcagcannnnnnnnnnnnnnnnnnnnnnnnnnnnnnnnnnnnnnnnnnnnnnnnnnnnnnnnnnnnnnnnnnngtcatccatgggcac

SEQ ID NO: 50621 - DNA, 806 bp, Oryza sativa
  unsure (1)..(806): unsure at all n locations
attcagaatttgtttttataaggaaagaaacttctcactttccaagtttgcatcaagacgtaatcgtactgtaacccaagcttttacgtaagtttttatttttactgaaacatacctttctattaagcacgttttaaatgaactgagaatggttcggggtctttgagatagagcaatgcaaaggctttgaacctctttgttatctgccatggtctcctctggattttttttttctattctcttcagttggagacccttcctgttgctttcggccttgtactaattcttttgtaacgttaccttttcagttcaagtcatgggcttccttctgaacagacacagaaacgaagattaagtagcaagaatagcagcaaaactttgcaactttggttcaacacatagtttacagttgatgtattgcaaggaatcaagcaacaacaaaggtactttacttatacctatcaagccatacaacaatagaaaagaactatgtggttcatttgttgctcataccatttcctaagactttcatcagtaatatgacaaattaagaccagagcatgagggcagacttcagtgtgagctctgcgattattaaaacgccagtcagtggctcagtgctaaaatttctactatcagattacagtacagggaatcagcataaaaaaatttcttaaaaaatttctactatcagattccagtacagggaatcagcatnnnnnnnnnnnnnnnnnnnnnnnnnnnnnnnnnnnnnnnnnnnnnnnnnnnnnnnnnnnnnnnnnnnnnnnnnnnctcaaagngcgagg

SEQ ID NO: 50622 - DNA, 806 bp, Oryza sativa
  unsure (1)..(806): unsure at all n locations
agcaattattaacccttattatgcattggtgatgatgaaactctgaggtttagatttaaggaaaaatttcctaggtttatgttaaaacttgcttaaataaatatttgatccaattaactcggttttgcaggtgaaatatgataaatatttgaataattgtgaaatatgtgaatgaatgtaaaatatgagatgcctgtgaatgtgtggttgtgtaaaatatgttaatgtgtgtgtatgtgaatgcatatatatatgaatgggtaatgctggggagctggggatattggatatctgtgtttgtttctgttatttatgcagcgggcatggctagcaaaggcctgaggctagccaaaaaacaaatttttttgtgaattatagccatttgtgacgggccataactaaatgcccgattgagatgaggtgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagcgggaacaccactccacaagtatcctcgacggcacggacgaagcctactcctcggagaagccaccatctgacgcatactcaaactctggggtttggggaaaatatannnnnnnnnnnnnnnnnnnnnnnnnnnnnnnnnnnnnnnnnnnnnnnnnnnnnnnnnnnnnnnnnnnggtgttactcaaaagcacac

SEQ ID NO: 50623 - DNA, 801 bp, Oryza sativa
  unsure (1)..(801): unsure at all n locations
catacattgattcacacatcacattcttttaactgtcaaaggcaatttttccttctgcctttgtaaaatggtgtaaactggattcttgtccctcaagctttaaaagtttttctttgctaataaaccataatgcttgtagtaatagaagagctttggtttctttgctggctgcaatctgtggggttcttgggccccaaagaaacaatataatatccagatctcaattggtgtatccccccataatgcttccttttgtattgcttctaatttgctgcagtggaaggttttagggcatactgaagaagctagcacgatgatggttgtggcaagagaagatgaagaccgctgctgccaactctgaaagtgataggctgggtattgggtgatagattagttaagaggttccctaagttgtggcactatcctctatctactgaagttgtgatgtttgaaatctgcttgtactggcagcccttttggttcttttagttgtgttgctgcttttagagctggtagtaagttttggagtctgtctgttttcctttaggagggctttgaccctccctacgctgtaaacctggtgtctagattttcccagcacaaaccttttggctttcaataggcttatgagcaataaaaaataattcttaatgataatatgtttcttagcaatttaaaagaaaatgttagaaaataaactacaacgaaagaaaannnnnnnnnnnnnnnnnnnnnnnnnnnnnnnnnnnnnnnnnnnnnnnnnnnnnnnnnnnnnnnnnnnnnnnnntcatcaatncgcgg

SEQ ID NO: 50624 - DNA, 808 bp, Oryza sativa
  unsure (1)..(808): unsure at all n locations
aaaagagaatttggagggaacccctgccactggtggtgatgaaactagatttgagaagtagcccccagcaaatatcattgaggatgccgatgactggccccccagttaaactactcacagtgctgaatgaagctgtaatagcaggctcttgaataccgctagattgcactgaagaggttgatgtccggaatccaggctgaaatgagaactttgggaacgaaggtgttgaagagccagcatttgtagaacaaactgacttggttgatccattgaaaggaaatacagcagcagaagcagattttgttgtatctgccaggccattgcttaaggttgttggttttaaggagatgacgttaaatactggattactagtgaaagaaacaatttgcccagagctttgagaaattggtggtttatctgtattcgactttgtatcacgttggttagaaactgaggcttcttctgaaactggtttgaaaaccctggagaaaaagacatgtcagattaatgtgctggaaataagtgagtatcctcataaattggaaactgaagcataattggcatgtgtcagactaccatatctcaactataaaacgacaatcaagtcaaaaaacactataaaatgataacataagtacttatgtgttaacctacttggtaaccattgcccattttcattgcaaaggtacttcaaatttaaaactatgcttttgactgnnnnnnnnnnnnnnnnnnnnnnnnnnnnnnnnnnnnnnnnnnnnnnnnnnnnnnnnnnnnnnnnnnnnnnnnnntcataacaaagngacac

SEQ ID NO: 50625 - DNA, 984 bp, Oryza sativa
  unsure (1)..(984): unsure at all n locations
actatctcaatcgtaatgttaaagtatagaaataaaaatataatgtaatgtaaagattcgtaattntagtctaaccccaaccacacaccaccccgggggtgattgcgatccttgggcgaaccnactcgncccccgggtcatattatttattgaacattatagttgtttagcaaacattgtgggattcgattgaagagctggtatagattcaatgccctctaatgcagcggcggattcagaaaattttatgagcctaggcaagtcaaatgatagatgataaaagcgcacaaatccgtataactctgtacaaaccatttctcattgatgtaaacaatttgacactacatagttattattttggagagaaactaatgcaaactacaaataatgatttgaacctcaattactaatttcataatttgcgtggttaatcttccctttattagaactaacagtgtattaacagtgtatgttcatgaggcggagcctgggcaatggcccaggctggccgggccttggctccgccattgctctaatggtttagaagttgtgaactatcctagatatcgacaatccttgaaataaaataagaatttatcaaccatcatatgtgaataaaataaacgggagaaaaagtactggctgcgtttcatcatctctatatgatctgtcgttactgtatgcaccgttgccatcatggaccaaccacttcctcataaccggatctggagaagaagcagtgtaggagaaaaggcaaaaaccataatggaggaggacggacatatacactagtacagatccttccatctgtgacggcccataacaagactggaatttgcgggccgtcacaaggaagtaatcttaattgggccgaagtttcgcccgattgagatatggtnnnnnnnnnnnnnnnnnnnnnnnnnnnnnnnnnnnnnnnnnnnnnnnnnnnnnnnnnnnnnnnnnnnagcagacctacctggcgac

SEQ ID NO: 50626 - DNA, 906 bp, Oryza sativa
  unsure (1)..(906): unsure at all n locations
gtgtgnnnnnnnnnnnnnnnnnnnnnnnnnnnnnnnnnnnnnnnnnnnnnnnnnnnnnnnnnnnnnnnnnnnnnnnnnnnnnnnncttctttttttctcacttaccgagaccaattttctgtggtgaagttatacttcattgttaatgtcatgaaccgaggccatgatggcataaccaccactgggagggtagccgggcggcgccggctattggagaagggatgtatatttagactagggataagaagatattaaggaaagaaattatactaatctgattcattgcttaatgataatagacacaatcccatccttatatagattatataacttgatccttaagtaaggactcaatctaatctttgactgataatcttatctctatatgggctgcttatggccctcagccttttggctcaatgctcatcacaattaacttactttattgtagttccatttaggctggtatacattggagaacactaagaaaattgatacatcctgcatagaaaaagaagttcgcattttctttgtagcagttaatgcatcagcctgcagttgtatatgatttgcgtacatgatttgtatggagtagcaatgcagttgggggaacacatcttcttgatagttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttnnnnnnnnnnnnnnnnnnnnnnnnnnnnnnnnnnnnnnnnnnnnnnnnnnnnnnnnnnnnngaagcagatcatcaattgcgcag

SEQ ID NO: 50627 - DNA, 1566 bp, Oryza sativa
  unsure (1)..(1566): unsure at all n locations
ccgcggcattgatggacagnctnnnnnnnnnnnnnnnnnnnnnnnnnnnnnnnnnnnnnnnnnnnnnnnnnnnnnnnnnnnnnnnnnncctgaactccagaattgataagaacgcatataattggaccccaattcaactagcaatagatgaagcgtgggcccaatatgtgcaaagaggagacctcaggaagacaggacatgacaccctcatccacaaaaaagacttcccggtgaagcaacaaataggtgaccagtgcagattccatgtgtgccacaacatgcgccttctgtatagagaaaaggtgaagactttggctgagtttgaggtcggtggtctcaattgtgatagactaaatatattttagtacttatatatgatcgatcaattaatctggaattatgacaatgtagggcataataaccaagtctgcctaccagctttgaggaggttcgcgaggagatagccagcttcatcctgtgcgaaataattaaccccaaaggaatgtttaggcttaaactaaaatgatgaacaatgttgaacttttatgtttaggcaatgatgaacacttattatgcaattgtgatgatgtaactctgatgtttatatttatgtatatatttcatatgtttatgttaaaacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtgtgtgtatgtgaatgcatatatatatgaatgggtgatgctggggagctggggatattggatatctgtgtttgtttctgttatttttgcagcgggcatggctagcaaaggcctgaggctagccaaaaaacaaatttttttgtgaattatagccatctgtgacgggccataactaaatgcccgattgagatgaggtgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagcgggaacaccactccacaagtatcctcgacggcacggacgaagcctactcctcggagaagccaccatctgacgcatactcaaactctggggtttggggaaaatatagcaagactgagtactacccactgtactcagcaagtcataccggaataggggtatgatgcagggaattatcaagggatagctataatggttcctttgcataaagcgagcatttataaatagtagttgaaagtagtaaaaccgttgtaataattaatcaatattaatcatccactgtccaatgctataccacgttgcaacaggnnnnnnnnnnnnnnnnnnnnnnnnnnnnnnnnnnnnnnnnnnnnnnnnnnnnnnnnnnnnnnnnnnnnnnnnnnntgattgatcaatggcccacg

SEQ ID NO: 50628 - DNA, 1503 bp, Oryza sativa
  unsure (1)..(1503): unsure at all n locations
cgtgtccattgaagtgcgannnnnnnnnnnnnnnnnnnnnnnnnnnnnnnnnnnnnnnnnnnnnnnnnnnnnnnnnnnnnnnnnnnnnnnnnntaatgtttgtaagacgtggatctgtatgtcaaatttgtcgtttgtgtaccccgaccggtcctggacgggggttttaatgcacattctgcttggaattctattcgggaatttctgggcgtgacacctcatctcaatcgggcatttagttatggcccgtcacagatggctataattcacaaaaaaatttgttttttggctagcctcaggcctttgctagccatgcccgctgcaaaaataacagaaacaaacacagatatccaatatccccagctccccagcatcacccattcatatatatatgcattcacatacacacacatcaacatatttcacacaaccacacattcacagccatctcatatttcacatccattcacatatttcacatccattcaaatatttatcatatttcacctgcaaaaccgagttaattggatcaaatatttatttagcaagttttaacataaacatatgaaatatatacataaatataaacatcagagttacatcatcacaattgcataataagtgttcatcattgcctaaacataaaagttcaacattgttcatcattttagtttaagcctaaacattcctttggggttaattatttcgcacaggatgaagctggctatctcctcgcgaacctcctcaaagctggtaggcagacttggttattatgccctacattgtcataattccagattaattgatcgatcatatataagtactaaaatatatttagtctatcacaattgagaccaccgacctcaaactcagccaaagtcttcaccttttctctatacagaaggcgcatgttgtggcacacatggaatctgcactggtcacctatttgttgcttcaccgggaagtcttttttgtggatgagggtgtcatgtcctgtcttcctgaggtctcctctttgcacatattgggcccacgcttcatctattgctagttgaattggggtccaattatatgcgttcttatcaattctggagttcaggtagtgacatgtactccacttaggtgttatgaccagaaggatccaatgggcactgcggcattaatatagtgaaagttaattaagtactcaaggaatgtgtgtcattttgctgtgtatatttagttagcacacttactattgattataggcgcacataatgtactccttgtctcggcaggaccgcaaggtgtcgtagaagaaatagnccnttccttggcggtccttttggagntttgtgncngtgtcctcttgtggntcgggtgccgagctcgnnttcggctgtggtngataagagtgctactaattgcaggggggggggggggaaaggaagagtaataagattgtacatgcgtatatcgatcttaaatanaggtagtacattagaaacgtatgcgggctgaggg

SEQ ID NO: 50629 - DNA, 818 bp, Oryza sativa
  unsure (1)..(818): unsure at all n locations
gcgggccattgtcgannnnnnnnnnnnnnnnnnnnnnnnnnnnnnnnnnnnnnnnnnnnnnnnnnnnnnnnnnnnnnnnnnnnaaaacggaagagcagcaggcaggctcggctcagtcggccgccccgcctcgccacgcccattgccgaggccaactcggcgcacgcgcgcgtgtgtagcagtccaaccatcacctcaaccggtcaatagggaatctccaatatcaccctatttaagttgaggttcttctacctaaattttcaaggcagtattattgtctctaacattacttgtgggctcttgagattttagttgaattaaattgggcctagcctatttattccaacaatccccaccaaatttcatggctcacaacaaatgttctcaaaactgaacctgttagttataccagtgttttgatggagactgttaagttgaacttccacctaggaaaagagctacaccatatcacaactgaacaatggactatgcattgaattgtcagtcttgtgcgattcaggtttcactcaaacccttaactggtactgggctgccggttgcatcccctctgtttggatcatataagtcatactcctggacttttcatgagtatctagagattacccagatctcatagactataactagcaattggactcatataggtgtggtccttctaagatattctgtaggatgacattctctgctttatgaaaagccactcggatcacattaaggtgtataccattgtcccatacagaaattgaagagaagcgcatccatgaagaacaaactcattttgagggtctgttctctct

SEQ ID NO: 50630 - DNA, 3238 bp, Oryza sativa
  unsure (1)..(3238): unsure at all n locations
gtggcattgatgtcagcttcnnnnnnnnnnnnnnnnnnnnnnnnnnnnnnnnnnnnnnnnnnnnnnnnnnnnnnnnnnnnatgtataccacaaagacaacatcgaaccggatgatctagcacggcgtgcgtccagacgagagccacagccaattgaacctggcacctttcctgaccaggccatcagtgaaagaggcaagcggcgaagatagcccggtcacccctaacatcagctcgggggctacagaggcagagcgcgccgttgccgatatcgagagcacagatgactggcacaccccactcattaaattcataggcagtgaagagttgcccgaggacgacacagaagccaagaaaatatcccgtaaagcaaaagtctactgtatgatcggcaacgatctatacaagaaggcaccaaacggggtacttctaaaatgcgtctcgtccgacgacgacagacacctcctccttgacatacatgaaggaatccgtggatcacatgccgccggtcggacattagtcggaaaagcttttcgacaagggttcttctggccaaccgcccttaaagacgcctgcgacatgattcagcggtgtgaagcctatcaattctacagtaaacacacaaggctaccagcgcaagcacttcagactatccctctcacttggccgttctcgtgctgggggctagatattctcgggctattcccacgaggatagggcggctgcaggttcctattcgtggcgatcgacaaattcactaagtggattgaagcgacacccacgagggaaatcaaggccgacaacgccatcaaattcatcaaagggatattctgcagattcggattgccccaccgtatcataacggacaacggctcccagttcatcagtgccgattttcaggattactgcatcaggctgggagtcaagatctgcttcgccgacgatgaggaggaattttgaacggagggtaatttggtcaaatttatggttgtaatggtgtggaatcaatggtgcgttgatggcgatggcatttctggaagaaaaagacttgtacgatggcattttatggattttctctaatttaaaattttaagtaatactctctccgtcccaaaatataagcattgttggacttcgacaatgtcttcgagatgctacattgatcaacaatatctataaaagtaagatgttttaaataaaaaaagttacacattatgataatttgcttaataacaaatctagtaacatcaaatttacatgattgatctgtttttgttcgtttgctattaatagtcaaaatttaaaagtttgatttgccactattctaagaatgcttatattgggatggatggagaattttttttcttgtatactaaggatgtatgtgaggtgatatttataagtggacgtgccgattggatgggctaggctgcgttattctagagcacagattgttaaaaattgtaaagtaaaattacttgaatcacgtcgtcttaaatttatgagaaaaaaaatgctgcaacaatagatgttgactttcgcccagggatcaaactgccggggagcaacgaactacctttggcgtaaactcacgcgagcacacaacacacgcgatggttcagatgaacacagggaacacaagcaagctttgcggcaacaaatgcccttttctctgtttatctgtgactcacacacttaactgaaaatggatcagagcacggcttaaatagccttacatgcacgaactgttgccggtcttcatgcgcacgcacgcactacctgaatacatgagccactaactccatgcattacgagacccactcgtccaactaaccatgcatgcaactaactatctgctaacttgccgcactcaactaactacacaagctaattactcggtcaactaatcaccaagtacatggctgtgacagatctaatctcctatatgcatgcatcatatatgcaatactccactacgtgcatgacacacatacacgactaactactgcagatatttaaaatatgtaagtcaggattaatgctaacaatagagctggttcatatgaaactatcatttatactacatgtgtagatggataatagatagatagatagcacaaaactatgaacaaaatagatgtgtgcctatcagcaatcttgttgacaaaacaatctaaacaggcgcatgtaaacataactaatattgctattcaaaagagagaattcgttatccttcagcaagtagataaactgaatccttggaagtaaaatacgtacttcgggtgacagtatgcacagaatgatcctcaactggcaggtcggcataagcctgttcttgcatggaccggatgtgtcctgtatcatgtgctgcggaaggtaccggcaactctgcgtctgcagatcacagaacatccatagcttgcacgatagacggtcgctggatcgggtcttgatgtgaacagcagagacccatgacgatcacacgctccatttgctgctgattgaactcgccgttcagtctctgatctgctgcgtcaagaatcttgccctggtcatacaaatcacgcacccaggctagcagtgatgaagctccatttggcagctgcctcgatgccggccgcttgccacaagctatctctaagaggacaataccgaagctgtacacatccaattcggtgcgaggccagcggttgttgatgaattctgggtcaatgtatccaggggtccctgcgacaacttgtgttgtttgtggctctcccccatgctcaacaagccttgctaacccgaagtcaccaagcttagcattgtgtgacacatcaagcattacatttgcaggcttgatgtctccatgcacaatgcatttctcgcagtcatggtggaggtagagcaaagcagagcccagatcaagtacaatcttgtcagttgaattaaacaggttagcaaatttaatttggtacctttgttgccaagttaaaattttctcagggtcgtagagatgcttgtcaaggcttccttgagccataagttcataaacgagaaggagctgtttcttgctgtcgctccagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 50631 - DNA, 2071 bp, Oryza sativa
  unsure (1)..(2071): unsure at all n locations
cgcggaatgaataccnnnnnnnnnnnnnnnnnnnnnnnnnnnnnnnnnnnnnnnnnnnnnnnnnnnnnnnnnnnnnnnnnnnntctagatatccatttcacctataacttttcaacatgccaatgcacgagaagcactcttaccaagaatatcactatcaacacaactatacaggtactagctagctagatccaataaacacgcttgttttagtagtgcgtctgcaagcaattaagctaggaatcaatcagataacataaacaaggaccggatctatagtcgatactactagatctggtaaatgcatgcgttcattgactaaatctacacagccttcactaggtgatatcgcttacgtagttgggaaaaaaaaactatagttgttttggaattgttactgacatttagtatagtcactgcttgcataggactagtaaatgcatccatagcgtatagttcatatgcgatactagagaggtgggacacacatcaatcataacaattaggaaaatttgttacagggtataaaacacctatagaaataatcataggactcacccatattaaaatagaggaaataatagagaggtgtagcttgcaacctgtaagcacgatttatctgacatgagggtccaaagacactctcgtaccattgaaaccaaggacgagtactagtacttggtctcaggctgaggcctgctaaaaatataaccataatgtatagggctagcatcatgcccttatctctcgagaaagctagttgacgatcagtcgcgtgcccccctccccgcgtgactggacatgtgtcgcgcgtggaaagggggcggcggacgcgccgcgcgggtaaggagggagagcgagttttcctttttcccccccttttttccgtttccgttcggttggttttccttttttttttccggttcggttggttttccttttttttttctggtttctcttctgttttttcccggtttttttaaggtttatgaatacaaagtttatattcgtatgtataccaagtttgtatacacatatgtcatatttgtatacgcgtatacaaactttgtatatgttgtgtattttctagtttttttattttttaatacgtatgtatataaagtttgtatttatcgtatacaaagtttgtctatgtcctatataaactttgtatacatcgtatataaactttatatacatcatatctatacaaactttgtatatgtgtatatattttttatatattaaaaatatacttatatatatacacgcatgtatatactatatatattatatacatatatagtatatacatacgtatagaagtagtagattagatacagagagattagaggaagggggcggctggccccgtgcgcgcctccccacgtggctgatcgcttatcagccgtccccttctctctccactagtatccctctaaatctacaatgcaggtactattaccgatggttctcaaactggtagtgctttatcggtctccaacaattcatcattatgcatcaaatatcatgttaaaagtcacaataaaaataaatggcacttatataacatttttaatgaaatgaatggtcgaatatcatattatctaataaaaaccggtgtcatattatttattgaacattatagttgtttagcaaacattgtgggattcgattgaagagctggtatagattcaatgccctctaatgcagcggcggattcagaaaattttatgagcctaggcaagtcaaatgatagatgataaaagcgcacaaatccgtataactctgtacaaaccatttctcattgatgtaaacaatttgacactacatagttattattttggagagaaactaatgcaaactacaaataatgatttgaacctcaattactaatttcataatttgcgtggttaatcttccctttattagaactaacagtgtattaacagtgtatgttcatagnnnnnnnnnnnnnnnnnnnnnnnnnnnnnnnnnnnnnnnnnnnnnnnnnnnnnnnnnnnnnnnnnnnnnnnnnntgcatnnttgatnttcaacgcgntgcagacca

SEQ ID NO: 50632 - DNA, 2628 bp, Oryza sativa
aatgagcataccatgtttataccttctccattggccgttgaaatggtgaatgtggatcacgatctgcttgcaagacatgttacgtgacgttgaggacccagcccagaatgagagagatggaatgaagttcagcaggttggtaagtgattccgagacgtctctgtatgctggatgcaaagcaaaacacactaagttgtcagttaccttggacctaatgaagctgaaggcaagtagcggatggacagacaagagtttcacagaacttttaggaattttgaaggctatgcttcctattgagaacacattgcccgagacgacatacgaagcaaagcaggttctgtgtccactagggttagaggtccgtagaattcacgcttgtcccaacaactgcatattgtaccacaaggaatatacggacttggatgcttgtcctgtctgcaaggcttctcgatacaagcgaaagaaaagtgctgacgaaagaaataagtcaaagaggggtggtccagcaaaggttgtgtggtatctacctatcattgatcgtttcaagagaatctttgccaacccgaacgaagcgaagttagtacgttggcacgccacggagagaaggaatgacggtatgcttagacacccagcggattcgattgaatggaggaatatcgatcgaaaacacaaagactttgatgccgaccctagaaacatgaggatatgtctatgtacggatggtatgaatccttttggtgacatgagtagtactcacagcacttggccagttcttattgcgaactataacctcccgccatggttatgctttaaacggaaatatattatgttgtgcttgttaatccaaggtccaaggcaactcggcaatggtatcgatgtattcctggagcctgttatcgacgatctggagattctttggaaagaaggtgtggaaacttgggatgcatatggtcaggagaacttcaagctaagagttctattgttctgcacaattaatgactaccctgcactcggtaatctttccggacaaactataaaaggaaagaaggcatgctccgattgcaaggaatatacacaaagccggtggctgaagaaatcacgaaagatggtatacatgggtcaccggaggtggctcccgctacgtcacgcatttagaagaaagaataaaatttttaatggtaagagagaacttcagcctgctcctaaagatttgtccggagatgaggtccacaatatggtcaaggacataagcaatgagtttggtaagaaaagaaaacgtagcaagacaaaggagaagggtatgtggaagaaaaaatccatattttggcggctaccttactggaaagatcttgatatccatcattgcattgatctcatgcatgtagaaaagaatgtgtgtgagagtttggttggcctgatgttgaatattcccgggaagacaaaggatgggttgaacgcgcgccttgatctacaggacatgaatattcgcagtgaactccagcccatacgagatgcagagacaggtaaagtgtacctccttccagcctgccacacactgttgaaggatgagaagatcgcaatgttatcatgcttgaaggatattaaagttccatcgggctattcagcgaggataagtaagtatgttaaattggacgatctaaaacttgttggaatgaagtctcacgattgccatgtgctaatcacacaaatcttgccagttgctatcagaggcattctagcaccgaaagtgcgtcacacgatccaacgtctgtgcgccttcttcaatgcaattggacagaaggttatagatccagaagatctagatgggctgcagaccgatattgtgaatacgctctgtcacctggagatgtttttcccactgtctttctttgatataatggttcatctccctgttgatatggtgaagcaaacaaaactatgtgacccggcttttctaagggaaatgtggccgtttgaaaggtacatgggagttctgaagtcgtacgtttgtaacagagctaaacccgaggggagcatcattgaaggttacataaccgaggaggctattgagttctgtgtcaattacatgtccgatgctgatcctatcggagttcctgcgtctcgtcacgagggaaggttgtcacgtgttggcacaattggaaggaaaagaatcaggcctgatcaagcatcgtacgcgtaggctcattacgctgtgctccaacatatggcagaagttggcccatactttgaggagcacttagcgaaaatctgagatgagaacttggggcgatctgatgcatggattaacagagaacataattctcggttcaacgaatggttcaagaatcgtgtgataatgtccacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatcttggagcttaactacgttaagttcaaggtttcgttggttcggttccaattggtgaaattaaat

SEQ ID NO: 50633 - DNA, 1550 bp, Oryza sativa
  unsure (1)..(1550): unsure at all n locations
ntggaactagggtttctcagtccggattggaaacttttctaagtccctgctatagtgtcccgcctcctttgaaccctagccccacccccaactcaactttccccgcccccgccaccgagaccgtcacccgcagccaccgagccctccacggcctccaccgagcccgtcgcctccaccgaccggcgacgccctccaccgaacctggcgccaccgccaccgagcccgccaccaccgccctcgccaagcctgccgccgtcgccaccgacgctgagcccgcggctgccgccaccgagcctccttggcccttcattcggaccaccgccacctcctcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccaggtgagtcctccattgcgcatgaatgatgaatagatgaatgtggttcgattgatgaatgtgatgaataaatgattagatgaatgtatttgaatagttaaatgtgtatggatatatgaatgtggatgaatagatgattagagatgaatgtggatgaatagatgaatagatgaaatatttaatttatttatatgtgatattcaattcattttacatgtggatgaatagatgattagatgaatgtgtttgaatagatgaatgtttatgcatagatgaatgtggatgaataaatgattatagatgaatgtggatgaatagatgaatagatgaaatgtttaatttatttatatgtgatattcaattcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggagnnnnnnnnnnnnnnnnnnnnnnnnnnnnnnnnnnnnnnnnnnnnnnnnnnnnnnnnnnnnnnnnnnnggcgatcatgcac

SEQ ID NO: 50634 - DNA, 944 bp, Oryza sativa
  unsure (1)..(944): unsure at all n locations
tggtaagcgatgggatggcatgtattggtttnctagctatttttactcttctatgggtaatggtaggtattggtaatgggaagggancnnnnnnncnaagatgagtggacgccancnnnnnnnnnnnnnnnnnnnnnnnnnnnnnnnnnnnnnnnnnnnnnnnnnnnnnnnnnnnnnnaagcgtgtttattggatctagcttgcttgtacctgtatagttgtgttgatagtgatattcttggtaagagtgcttctcgtgcattggcatgttgaaaagttataggtgaaatggatatctgagacacagctataagtatactgatcaggatgggcaagtaccccagatcctgcattttgtacttacccttctaaaatttattcctttttccccgcaaacaaaaaaaaattattccttccactttacttttgtactcaccggacataaggatataaagttccataaattttttaaggccataagaagactgaatactgaggtggataagagaggagaggagtgagagaagaagcggatggcacgattacagccggcttaggcacaagaccaaaaaaatatgtgagagagacatattgaccatatattaatagttaagagctaaccagttagctaagaggtagactgtcaagatctatatagtaaacagctggttatattattagccttgcactaaggatctaaggttctaagcacaaactccaaagtgtctatgcttaaatgatgttgtggaggagagaagacaagaaagagagaagcagccccccctcgtataaggggaaccctccacacaacttcaagaacaaaagaaaatgagaggggctgattggtggcaagtgtattggaaatagtgtataagtaggtttaatttttggatagatgaccggataaaaatggaggggtgcccaccacctttattataaacctg

SEQ ID NO: 50635 - DNA, 3651 bp, Oryza sativa
  unsure (1)..(3651): unsure at all n locations
gtggtgatcgccagctnnnnnnnnnnnnnnnnnnnnnnnnnnnnnnnnnnnnnnnnnnnnnnnnnnnnnnnnnnnnnnctagctgttcggatttctatcctttatcttaaaaagatatgcatgcttgtgtatttttcatgctacatgtaagaatgttatgttgagttgtaatccaaatttatttacatttgataaagacctgcttcgccgtagtggagcggaggcccgtgcacctggggacgcccgggggtgcgggggcagagcccccacggtacggatcgtcatcccttttagggttccaccatatatatacctcttgtaagccgccgtgcagcgatgtaacctcaccctagatatagtgaagatattttgctggctagcgcccgtggtttttttctctcctgctttgggagggttttccacgttaaaatctcgtgtcttctgtgattgatctattgttctttatcgtttgtttgcctatcgtttcctaacatgttacactagtatagaaatcatcatagggataacttaaagctcctgatttacttatgatctttctcattctttgaacgtgtctaaaattgaaagctggcatttttatcccttataagtgccggtttattaaaaaaaccggcacaagcataatagaaaaccgacacctatcatgagtcgagccgagccgacgtgcttgagaccatgagagaagatacatggttttttaaagtcactggtggcaccgagtcctctcccctcccccatccgtatcctcttctccatctccccatctcctctcctctccaagtagcctctcctttcctctgtctcccgtccttggatacctctccagtgcgggtggcagatgccactccctccaccgttgagcctcctcctctcctctaccacagccgcaatcggttctattggcccacgacgcctcctcctctccactaatgcagctgcagtcgccgacggtcctctttgcccatgacagctcttcctctcgctgctgcagccaccgacagccctcctcacccgcatcgtctccaccactctcgagggtggccggatctaccaccatgagcacggggacgggtggatccggcaacgcgaccacaggatggcctgttcaacaatggtagcagcggtgacagtggtattctctgtgtgttcttcttagttgattttgattctctctctatttactttggggatggtgtcatatgttgattttgtttttgaatgtcgattctgtggttgtgttcttgggtgatgggagtgatgatgatctcagtggtgatggggagctattcaatgcatcagcttgattcgtggcgatgcattgagctggcatttttttttcattcctgaaacctcaaaggtaccgctgcagggtaccggtcaaaaaatccaacacctatgtccgattcctaacaagtataatcatccttttttatagtgttaggactttgtgtaataaaatgtatttctttattgttattgagaaagtaaaatactttatagcaaaacttacaatatctttgggctttggctaagtgcgatgattagttttgtgttctcttttaattttgcaaacttcggtatggtgtactctcttcgtcccaaaaaaaactcaacctaggagaagatgtgacccctcttaggataatggatctggacagaccctctatccagattcattattttaggagaggtcaaatctcctcctaattaagtttctttgggacggagagagtaacagttttggtttttgctgaccagaaatattcatgcccaagctggcaaggcccatccatcgcttgccagtttcccacagccaattaagagcaagtttaatagtatagctaactactagctccaaatcatttatagccaatgtaatagccaattcatactatagttgtttactacactattaatatctggtcccacctgtcatatacacattacgtcttgaagtccgtgctgtagctggctacagatcagtaacaccactgctcttctctcttattttattctttaaaatatatttatagattatagtctgtattccagctctaattaatgctaaaagtttagtagtggcttctatggtctcgtgccctttgacctcgatggtttcgatcgtctcgttccctttgaccttagattgcctcgccgccagtcatcggcctcccctccttcgttctctgacaaaatttgccaaatgacaaaagtttatgcaatttactgactggtatcataaaagcatgtcatgaataattacggaacatattctgcccaattgaatagagaaattataaaaaacaaaaaacaaaaatacccataaagccacaagcctggctacatgactagttttcctgtcatggcccatccaaaagttatagtgtcttcttgctgaaacgtagagacttgctcccttctttccaaaataaatgaactcctaaaatttaactttgtcacaaatctaatcaatttatacttttttacctatattctaatccatagttcaattgataagttttatccctacagtactcttcacttatcaatatatctattctattatatactaaaagtccattaaatttcctacaaacgtttctaagccaccaagtgacgctcctaaaaacactcctagattgccacgtggcagtttataatctcaccatcaattttcatttaaattagtgggcccattattttaggccattagattagatctattgcttactcttaatattctgtagatatgggtgaaaccgtttacaccagaaaaacatacgtacgtactatggaaagaaacgatcaaacgattaacgaacccttcagcatacatacgcacgtacgataaatagctatattaaaaaaagataaaagaaagatactgttcacttgaaaaaaaaattacttatataagcacgagtaaaaataataaaagctataagacctaaaatatatataagacataaaaaatatatttacatcggtataagaaaatagacgttttttaaaataagattttctatactataaaaacaaaatttattactctacaaataagatgatttagcgtttctacaattactcttaaatcgccacatgcatggctctctaacattttgctatcaattttcatttaaaatgacggaccattattttagatcattagattagcccatttcctcttaatttcctgggtatacaaccgaatgctctattgaaaaaatacaaagacatatacatttatatgataataaagcccaaaaaaactagaaaataaaataaacctttacatattgttccctagaaaaagtacgtacggatacacgagtaaaaataaaagccataagaccctaaaaatatatatacgtcggtaggaaaaaatagacggtcttttaaaaatacgattttctatactataaaaataaaattcattactccacaaatatgatcatgtagcgtttctgcaagcactcttagaatgctacgtggcactctataatttcgttgtcaattttcattcaaaatgatggatccattattttagannnnnnnnnnnnnnnnnnnnnnnnnnnnnnnnnnnnnnnnnnnnnnnnnnnnnnnnnnnnnnnnnnngtcgtacctggacag

SEQ ID NO: 50636 - DNA, 1736 bp, Oryza sativa
  unsure (1)..(1736): unsure at all n locations
tatgtcatcgtatatgtatcgtgtattgttttggcttttgtttggttttcggtaatggancggttagtcaagggtatatcgcttatggctatttctacgccnnnnnncnncnnaagatgagttgagaccanttttannnnnnnnnnnnnnnnnnnnnnnnnnnnnnnnnnnnnnnnnnnnnnnnnnnnnnnnntgaaaaccaccatcttacagcattctacttgcaagctacttgcacatatactaattaggtgagattgagaagataagtatatctcagctttgctgccaataaatatcgtcggctgcatgccccattacactggacaccactccggctagtcaattaaccatcctgcagctgcaggcacaccaaacacacgcatgcacaataatccacacaagatggccaccggcgtagcctcgatctcctacggctgccgtcgccgtcgccgccatggcctgcgtcgtgctggttgtcctctcctcctccgccgtcgcgccggcggcggcgaagatgttctgctggcagctgcgacgagacatgcgcccattcgtgcgagtacaccgacaccgtcgccacggcgtgcgccccgcagtgcgacggcggctgctcgcctgaggcttgccagaactgcgtgctggcgatgagccaaggatgcttgatcatctgcggcgacgactgccgcacacactgcacttaattaattagcgtacgtaaagatcgagtaaaccatgattgtctccggtttccattatttttaacgttgtctagatcagcgcgtactacgtgtgcatgtaagtcaaattttatcaagtatcgttcaggacttgctgtaataaatgggtgtattttcattgttattgagaaaatgcaataggaggtagcacaacttgcaatgtctttggacttggaagacactattgctacctgttggaaatttggtcataattcaatatattttaatccaaaatattaagacaataaacataacatttgcaatttgaatagatctagtgatagtgctagatatgtacaacattagcatgtttaatataaaataagcatcagaatagataaggcaacgtaacaacattgcgactgatagtagtaggaaatgaagaacgaatggtaatagtaaatcgttatatccccgagaacggtcctccgttggagtttgaagcagtattgcctccgttggtgttgacgggagcctccttctccttgtctccaatgttactgttgtcgccggtgttcgacatgttggcgcagacgatgcagaggaagacgaacaaaagcagtcgcgtgtagcgctccccaaaaacttcgcctgtctacccatgcaggttctcaagcggacggagtttcggaggcacctactcgttccgatcacccgtgtgcgcgggatgaacagaaccggggaaacagagagatagcgcaggaactgaaggagagtatcacgtaggaacagcagcaggaggaagattcgatctttgagagcctctgccttgcgttatatatagagagatctccattaccacacaaataaatctctcatttgttgtgaaggttaccacacattgaatctattatttgttgtggagattacaacaaataaatctctcatttgttgtggatgttacannnnnnnnnnnnnnnnnnnnnnnnnnnnnnnnnnnnnnnnnnnnnnnnnnnnnnnnnnnnnngagttgaagattcgagnnttcaactcatc

SEQ ID NO: 50637 - DNA, 2479 bp, Oryza sativa
cttcctaggaggaattctggaggagtaccggagctgtcggtacactctgctccgggtccggagaacttcttctgtaaagtaagcattcgtgtttctttcttatgttatttaataactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagagattaacgatggaatgcaggaattcgggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtgggtagatataaaccatggcctaggaggaattctggaggagtaccggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagagattaaccatggaatgcaggaattc

SEQ ID NO: 50638 - DNA, 33686 bp, Oryza sativa
  unsure (1)..(33686): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtgctcctgaaaatgcagggatcaggctggacaggcagttacatgaagcaatcaacaacaaggtgagtactaatatatgagcaattccaagttgttcttcctgtcagaaacaaaatgctcaaagattgctcatttctttgcatctttgttccagcaggagatcatgcgtgactcaaaggccgagcaatcactaaatacagctcgtttgatgaacaagcactgcacatccgatgggcattgcaactcaggtacaatggagcagacgattcccagttcttctgttgttgcgaaggatagcgaagtggtcagtgcgattgctcggtctgtaccaaggttccatgaagattactacgggccaagtggccatgaacctaatcaccattaagcacagctagctagctacatatcgccttaattagttttgcccttttctattttagcagcagcagcttactttcttagtagtgatccgtagtagttcttctctcctagatcgatgctgcgttttggctggaaaatgtaaagggagaagtattatgtagttcttcaccaactagctatgatcattagtaccgtgtgctacttgagtctagttcattcatctcactgctctcttccggataatctctgctaattgcatgcatcggtttccgtgcgtggcccacagttcgatcgatcgattccgggcagtaacgatactactagtcagtgatgtcagaacagtatgagatcccacagtagaaactcagcaccacagtcgccgaaccggcatgaatgaacatttgggatcttgtaaaacggctgtaaactgtaaaattgctagtgacgctagctgcagcttttcgcatctttcaccttcctctggcagctttaacccgactgttcttttacgacgtttgatgcaggaaaggtacaaaggccagtggtgcaggctgaggcaggcgcagcagcgaagcagcagcagcagaatcaggtcagtccactagtacactgcactccctgcaggctttcggagattcagctgagcaatcttgtcttgtcacgcatgaaaatggaacggattaacttacctccggcgatgtgaatatctttgcagagcctagagagatcaggtgatgccaatcagcaggagcaggagacggcgccgcgacagcaagagaagacgtcgtcgacggctacggcgacgatgacgacgtaccctgacatcctcgacatcgccggaatggactattcgccggcgacgagaaagccgccgatccacaactgagtggcacgcacgcacgcacgcacgcagtactagctagaaagctggtactttcactggcttagtgcttgctgtattagcttagtttagcagtttagctactagctagctagctagctatagcttagccatagctagctgctagtattagctaagtataattagcttagctagcagcgcgagtcctgatcatcgaatagaatagtagtgcgtacagccagtgaccgatactgggacagcattgcaggaaatgctgcaccttttgtgaagaagatgatactacaaagcttggcgtctctctcgtgtatcccgcggatgtaacatgcgcgcctgtgtaacaccgccattttgaccgctagctagctaactaattactccgtagctcgtttgagatctctcccattcgtcaattcgtttttctgttcttgatgacattctccaaaagtcttttttttttagaacactccaaaagtccaatgatactatattcactcagtgagatggagtagaccggttaattaagttgcacaccaattctacttgtgacgcgagtgatcatgattggtactatattccagcatgctaatcatactatctccatccaaaaatatatacgatgctgttaattttcatttaacgtttgattatttatcttatttaaaattttagtataaatatgtaaaagtacaagttaagattatagtttctttatgataaaataagtcacaacagatcgaatgaataaatatttataattttttaataagacaaatagtcaaacctcacataaaaactaacaatgactgaaatgatgtgacactacgtataacgaatctaaacatatgtagtgctacatcctaatttatacccatccgtctaaaaaaaggtcctatactagctgtgaacctagatatatatgtgttcagatttgtagttagagtttgtttttttggatagagtgataatttggaacgaatgaggtagtagatactactattaattaagagatggatgggttggtgagagaatttgtcacatgcatgccgggtgtgttagccaaggtttgcggcaggacgcgcgtaatgggcgcggcccgtacgtgttggctcgtgtcgccggctggagcggacggatcatggatgcgcatgcatatggccggctacatgcatggacgaccctggcacacgttgctgtcgcgcgcgcggcggcgagacatcgctgtccggcgagaggcgcgagatatctgcgtgcgccgaccgatccatgcatatctcttctcgtcgcgcggcggccactccgcggcgagatggcgatgtcaagtgggctacggcgtgccggcgccggaggctgcagcgctcgcgtggtagaccagcgccgtgcgacgcgagaggcggccggccggcaagacagcgaagcgccatccgtcccgtagccgtcgacgccgactcgcgcgccgcccggttggacgtccggtcttcacaaaccgtttcttgactcttcaaagccaataaccccaccgttgcaaaatataaaatgcactattctctccgttctaaaatataagagagtattttgtttctttaataaagtatctaatcttattaattaaaacaccatttatgtgatacaagagcatgttgataaataggtatttaaggatatgaatatacaaatttaattttatgtcacatactttcactatttaattcttattctatatccggttttaaatagatggtgtagtttacttttaaacatatgtttgattgtttgtcttattaaaaaaatattattatttatatttggtgacttgcttctcattaaatgtagcatgacttattatttttaattttcatatttgtacaaataattcaataaaacaaatcgttatttaaaagtcaacgatttcatctattaaaagccggagccagagggaatacacaagttaaaagaaatttgtagcacaatattataaaatttctttttgttatatatgataaacttgaccgaagagcaataaagtgcctggttaaccgttaactaatttgctttgtgctcaaggatgtaaggtgtgctgcgtgcacacaattacgacgttggcaacttgtcaattgtcatgctaccagcttatgaacctgtcagccggttgttgtcaagcgttggaacttggaagtgcagtgaaaaaaaaagagagagtgagagagtagagtagcgccagtatacaatgggcctgaagtaaacggcacagagcacgtatgcttgccagtatgccactgtaagtttctgatgttttcttactcgatcgatcgcgttacagaattgcagtgtcgcagactcgcagaacagggattaactaggccttcacttctcttctgtcgcagcatggtctcatgcgttggaatgtgtactgttctagttgcagcagcagatagtgtagagacgaagcaccatgcacatttgtggcagcaacctatatatattttcagtttctgacgcggcctttttgtttactgttttctctgtgcttgagttattcttgtaggctgtatgctgacaaccagctgacaattttgatgattgccttgccttgcctgcctgcgtgtcatcagtcgtcactctgaagcctgatcgattggagacgaaaattagtgaggagtcacatgaaacaagacggatatgtatgtattcagtgcacgcccatcctgtcctcgatttttctactcgaccagaagacttgataacccctactgaatgctcacgacaaaccgaaaaactcaaactgtttcctgaatatatttagctggatttcggtggaggatacacatgttgacctgtgcataccctcaatcatttccttgttttatcttctttcagaaatttaggtcgattgatcggaggagaattctgaagtcacaaaacgaagaaatttacttctgaactcaagttctgaattggtgtacactccggcttggcccattaatctttaggcccaacttaaactccaccaggctttcatgggccggatgccattgggtaggcccatttaggcccacaatgggctgattgggccagattacacgtgcgacgtatctgtttgacctcccgtaagactgaccggaaataggaaagcaaagctgcatgcagaaacgcctggcgctgctgctatttatggaccagttttggcgggtgcaaaccgcggggcccaccctggaggttcgtctcctcgcgcattgccatcgccgagctcccgaaaatggtgcggtaacgggagcaatcgcagaagaggactggaggagatcgattccccattgaggacgtgaaattggattctgtggcagaagaaagatcgatcgatctggtttggtctggtctcctgtaaaagaattctcccatggcgccgccggccacctcgctcatcggcggcggcgtcggcggcgtcgcctatgtcgttctgctcttgttcctcgccaacgcctgcgtctcggatgctgggttcgaggtatccagccgtgttctgatgtcaggtgcgtgcagatagcgtatccatcgaccatggcttccttcttcaagcctgatcagtctgttgcaattcgtgacttgcaccatggtgacatccagatgagcaaggaagaagtgggttgctggctacatggaggcgattgatcgtcgagacaccgtcgccgggagccggtgctgacgctgctcatccaggaaccaaatctcttccgctggccgcggcgaggactcaccggagagaccccctcgccaacctcaccatgtacagcggcggctggaacatcagcgaccagcattactgggctgtaagtacaccaattcaattatttcctactcctgtaattcagtaattaattgcttctccatgtgaccattaattcttttgatcttgtgcatttctgttccttgtgcagtctgtggcatacaccgcggttcccctcatcctcgtcggcatgctgtggttcatcgtcttcgggatcgtcctgctcatcatctcctgctgctgctgcttctgccggaaaaagtacaacacctactcgccggcgacctacttcatctcgctgatcctcctcataatattcaccttggccacaatgtaattactcttaaaccatatttcagttcttatctccagttcgccattactttgatcgatcgttcttgccttgaactgaactgatgaagaatctttctccttttgttctccgtttggtgattaatttcagagccggatgtatcatactgcattgtgggcaggagctattccacagtagcacgatcaaaaccgtggactacattgtcggacaaggcaatctgacggtggatagtctgaggaacttctcaggtagcttggctgcagccaagaacatcggggtggatcaggtcttcctaccagttcaagtgcagcagaagatcgacgtcatcgaggataagctgaattcttctgcaaatgagttctccacgcgcgcgctcgaaaactccaagaagatcaagcatgtgatggacaagatgtgcgtatgatggctgcgtaataacccaatcagcactgaacttttacctggaaaaatctgaacgtattcattgtgatttcccttttgttttgttccttttaggcagtacaatttgatggttattgcagctgtaatgcttggccttgcgatattcggattccgtaagcattaaccaatctttgacttgattctgcttgtactgtcaaagcttcacttgcaactgatcttggcttcttttttttttcccgtgcagtcttctccatcctggggctgcggtttcttgtttccctgtaagaaaagctgttctaatttgcagctaattactgtaactgaatatgttcctgttgtttgctaatctttacaaactcccatctcacatgtatgcaggctggtgatcgctggctggttcgttctcgtcatcacaatcatgatgtctgctgctttcctcctcctgcacaagtaagcctgaatttttccgatgaagaaatgcattcgcagcgtgttcaggcactgacactgacagaactgggctggcagcgtggtcgccgacacatgcgtggccatggacgactgggtgacgcacccgcaggcgcacacggcgctggacgacatcctcccctgcgtcgacgtcgcgacggcgaacgagtccatgtaccggagcgaggaggtgacggtgcagctggtggcgctggtgaacaacgtcatcgtcaacatctcgaacagggacttcccgccgtcgttccggccgctctacatcaaccagtccggcccgctgatgcccaagctctgcgaccccttcaacccggacatgagcccccggaaatgcgcccccggcgaggtcaacttcgacaccgcggcggcggagtggaagaagttcgagtgccagaccaccgggccgcccgggtccgaggtgtgcgcgacggaggggagggtgacgccggcggcgtacgggcagatgacggcggcggcgagcatcagccaggggctgtaccagtacggcccgttcttgatggagctccaggactgcagcttcgtccgggagacgttcacggcgatcagcgacaacaactgcccgggcctcgagctctacagccggcacgtctacctcggcctgctcctcatctccggcgccgtcatgatgtccatcgtcttctggatggtgcacacgcggcagcggcggcggcgctcgctcgggctcggcaggtagatgtgaagagtgatactgtacatcgcaatatggcatgcctgccatggcagccatgccccgcacctgttcatcaatctgatctggtgatttgtactatatgatgtgaatgatgtcaatatcgagtatattttggaagtgaaaaaaagaaaatgtttagctgctctcttaagctagagaaaatgcgaggttaaccactaaaaaaatcaagaacaaaaaacagatattccaaacaaacattttgaattcagataagttaattttgctcgattttgatcagtggtaaaaaaaatgttactcctgtacataaaacagccatattgtccagccagaattaagaagaaagggggagtgatgagtgactaaaaacaggtttgcatcgtgcaagggaaaaggacaaatcatggtgtgttcgggatttcagtgttcagatgttttgcttctccgtgactctgtaagctttgtactccctccgtcccaaaaaaaaggcaaaccttggtttcccgtgccaacgtttaactgttcgtcttatataaaatttttttataattaatatttttattgttgttagatgataaaacatgattaatactttatgcgtgacttatctttttaatttttttcataattttttcaaataagacgaacggttaaacgttggacacggaaatcatagtttgtcttttttttttttggtacggagggagtagaccagtcggataggccatactttggttgtttcttactacagattggactatgctatgcatgcttgaaaactgaaataattgagaatttgagatctcatgaacaatttgagaatttgtgaccatcgtgcagacttggagtaagcaaatgcaatgcaccttcttcagtagagcatgtgtgatctagtcatctacaaacagttcacatgttacctactactactaggagtactgcatttggcgaaacatatggagaaaacttcatggtgagacgacatacgatttaatctgctgatgtagggggtacgttatccgttaggcttaggcattgattaccttcatggagacagtcctagtacatgacaaaagtcacaagcctcacctgttcccttgcccgtgctgccgtccgattcgtactccaggaaacggacggcccagatcacccgcagttcccagattcgccagtacaatccttcgcttgctataaattccggcgacttgtcactcggccggccgatcatccgatcgggcagaggcggagaagagagtcacgtgagcggagaagattccggcggcggcgaagtgaagtgaagaggcgatgggaatggactggtacgcgtggctgtcggcggcgaggctggaccaggcggtggcgtacgagtacgcgctggtgttctcgcgcaacgagctggaggccgacgacctcgcctacttcgaccacgagttcctccacagcatgggcgtctccgtcgcaaagcaccgcctcgagatcctcaagctggcgcgccggagccgccgccgcgcggcgctgtcgtcgcgcctcgtcgccgccgtcgaccgcgtcgccaggtacgtgcgcgcgctcgtcgtcgtcgtcgtccagggccgggaggacgagtcgtcctcggcgctcgtgctcgtgccgagccagcagctgcagcccgacgtcgacaagacgccgaggaggagcaggtccaagcccaagtcgaccaaggaggtcgccgccgacgccgccgctcccaccacaccgaaagccatgcggtcgccggtgctggccatcggcggcagggccgcctcgacggtgcacgccgtgaaggacggcgagaaaggcggtgaggacatggtcaggtgggaccgcctgttccaggacctcaagcccaactgagcgcgcaacgacgacgatgccgcgcgtgatcgcggcgccggcggcggatgcagcggtgtgttactgttagggtttaatgcttgttcatctccatgctttggtaatggtcgagcactgtgctctttcttcctcctgcatgcacagttgtgcactgctccggcgccattgctgcatgtacaggaagcacggtgcatcgtgccgatgcgacgacagcaattcacgccattgggagcggtttgggttgctccacttgtctgtagactagctcgtggtgaggttattgctgtacaataaatgcacatggagtggttaattgcgattaatcgtgccaacgaaaatcaacaatgcctcagtaatttccgtgatatttggttcatacacgttacatgtccgtgtccccggccgtaacagaaaaaaagaggtactagtggcgaatctccgattcactaaatttctgaagagcctccggccataacacaaaaggagatacttcaatctcactaaatttctaaagagcctcctgccgtaattttattttggctgtggctacagtgtatctgtggatgcaactgtaactctcaccaattttagctgtcttccagacttcagagcagaaattgatggtttttttgtcaaatactacctccctcccaaaataagcgtagtcatggatatccgtgtccaacgtttgaccatccgtcttatttgaaaaaattataaaaaagttaaaaattagtcgcacataaaatactattcatattttatcatctaataacaacaaaaatactaatcataaaaaatctttcaaataagatgaatggccaaacgttggagatgaacagtgcaaaactgcacttattttggagggagtaattaagtggaggttgctcactagccctcttgtagttgttagtacgatcgtatactaagttttggttgcgtcagtacagacgtactgtcatgcttgattggtaatcatagagcagttaaacatctttttctttcgtatatgtgtggatgtgtatttattatatccatgtatattggatgcttgtaaagcggcagtataatctgatatgcaagaaatgagggcagggatgcttcaaggttttaaaaaaaaaaactctcccaaccaccagaatgaaggccgagtttagttctaaattttttcttcaacctttcaacttttccatcacatcaaaactttcctacacgcacaaactttcaacttttccatcacattgttctaatttcaaccaaacttccaattttggcgtgaactaatcacacccgaagtggagtatacaagaaatgagtgcatggcataaagaaaggaacacagaatcacaggcatacagtaaactgacaaccaccagaattccaagtcctgagattgtctcgtaggagtaagtaaaactcttatgttttcatgctagtgtaaactgtagttgttcagtttttattgtcgtgtttctgcttcacaggaaacagcctgctggttggttgttgtcggtagatggtgctattgtagacggaataactgcagataaacttctgtaaatacaatccaaccaaacaaccgtacgccaattcataccatttaagaaagacagtaccacaaacattacagcggtgtgatttgcggccggtaaggccacttttggtagattttgtggatgtacgggcagtgaaaacaaaaatgtaagcaaacagtatcactttgacttcagaggtaactggaatgtgcaattcaagccatgaaggattgcatttgtcgtaatttaccccccaaaattattattctagtggatgatgaactctagccatcggaaaaatatccgttttgacagtttcaacatcaaaaaagaaattagagctgttatagcttccctttcccaagtaaactctttagagttgaaagtactggcagaattgatttctaacatgaaactcttactaaaatactcattcacaatagtagttagttcatggcaaacatctagagaaaaaattggacaaaatggtcccaaagctacttatgctaaaaaggttaaaaaaatataatagatcagagttggagatataggggaatttgaaaagatatttctctacttaccgtgattcgttgttgaactgcatttcctctgtcacttctgagcataccgtacgcaattgttcttctgttctctgtttcttcatgctctgtcatatgatgttcttcatttccccaactttgtcttcacaattacatatcttttagcattactaagcatgggacttcatttacaccctttgttagttcagtaacaaaaacgaagcatgttcagaacagctatatagtactatatatggtctaacatttccttcacgatccaaatttgaaactattaattagccagctagtacttatctagtagtatctcctttatggcgtcacaatactaattttatagctaacagtcggcgactttgattttttttctatttttgggttgggggtgttggttatcatggcaacttctaacaggaagaataaaatcagaagaacaaaaatgatattagataaatacatactatcactgcactacatttcttgcatccagcgctggttgctacagtatgcatctaaagtaatctgcagtaacaacttcctcagtatcctaaaaccatagtacattcttgtttcatgtaattcaggagcattagaggttagttttaaagtgaactgacaaatgcatgggaattatagcctgtctcagtctcttaacattcacgactcaaaatttcatataaactctgcaagagtaatatagtaggccaaacgcttgcattatcttcagtgttctttagtattccttcctttcccacaaaaaaaaatggtaaggaatcatattcagttttaagttatgctgaaaggtataatgcttaaacttcacagagatcaagtattgttgtttggaaaagggtataaatttaagcttcaaagtagggagtatgagactaccactacttttttcactgaaacagagtaatggagaggaggccctatctgaagatatatttttttttcaaaactctattggcaatctccaaatcaaaatttccatagcccacaataacaatcatcggcaaagcagaacatatgaatatagttgttcagcagctggattcaactagaaaggtcaaataagaagacagaaaaatgcactactttactgtagtcagaagaaactagaaacctaactgtatattatcagactttgtggacataagaaaactgaaactctaaaagtgttgagaacaaaggaatatatacctgacatcattgttgaacagttaaaaatgagcacaatgctacattacgagctccacttgaatatgtgtagaacatgcctaactagtgattaaagcaaatggtgaaatggtaagcataatgaacaaaatgctcctggagttctaacttttagtctaatttgttgtaattcaggacatgccaaacatgccgtctttgccgtagaacattctctcagaaaatatgcaatagaacatataacttgcaaataaagactagttatagatgtagctaatagaaacaggacaaccatactatgcgtgacacttgtatgattacattcgacatggtatgtgatccaacatttatgatttattatgtcataagtactaatgaagttagatattggctagtcaaatgaattcattaaccgataaaactatattagacagaagcagctccaatggaggcttagtattattagttgcataagcattccatgcgatgctgggggactacagactactatgtacattgcgaaatactgtgaagcacacataaattcttcactggtttcggcttaccaggcttaagtgcacggcgagaacatccctgatcctctctccttccttgtctttctctccttcaaagtccgaaaatagttccgcagcggcaccttcctgaatttcctcaggatccggttcgccgcatttgatgagaaaattatggagaagacagccagcaaccacaacatacggcagtgcctcttggcactcacccttccagcattcgtcaagaagccgccaccgtgatcgcacatgcccaaatgcattcctcaccagccgcatcccgtgtgaatgcacattgttgaagatgctctctttggacatgccattcttggcgtccatgtcattatacggcgtcacgagccatgggagcattgggcagcatgctggccccaagaagtagcgcggcactgagccgccgatgagctcgccgtgaggagcgttcgcgagcaccagtgactgagagctgtacagcttcgtccgtgggaggatttccgccggcgccatcgcggtgtcccacccgacggagacgtcgagaaagcggccctcggcgtccaccagggcctgcgcgatgacggcgtccccgatccgcgcgtagccgagcgcgccgcagcagttgggcagggagagcgcgcagaatccggggacggcgcgggcgatgcggtcgggcgcgccgaggtcgagcaggatggcgaggcggtcggcgatcgtgcggcagacctcgtagaatgcgcgcgcggcgacggccggggaagggaggccgaaccggcgcgccacggcgcgggcgggcgcggcgtgggcgaggcggaagagcgcggcgccgagcttgtggtcgggcggcagcgcgagggaggaggaggaggcggcggcggggtcggagagcgcgagggagtggaggagctgaaagaaggccggcctggacatgcggaacgcgtcgcgccaggcggagtccgggagggagtgcgactccgagaggagacggaggaaccacgaggatgggagcggcggcgacggggccggcggcgacagcgacatggaggtgagcgtgagggtctggaggtggagcgggagcatcgcgagcaggcgggacacgccgcgcgccgcggcgaggacgagcggatcgagctcgagcgtctgcgacgggtgcagcagcaggtcccggtccgacgcgaacctgagggcgagcgacaccgacgacgccagcagcgccagcaacgacgtcaactgcggcggcgacggcggcgacggcgtcgccggaacgaccgccaacgcgctccgggaccggcgcttgcggccggcggccaccatcctcggggcgcgcgctgcggttttcgcgggtggcgatggcgactggagcgagagagagagagagagagagtgggagaagtgcgcatgcgtgtggctgggtgggtcaagatgggctagccgctgcgcctcgggcttgatgacgacatgggctttttctctgcggcggtcggtggtggggcccactcgtcttcctcctcgggagaggggaagcacagcattgttgcagctgcaccgcacctgccacccacttcgtcgtgcagtggtcacgtcggagtaaattgcagtcagggctcgggtcggggttccaagttccagccggatttttttttttgacatgcttccagccggatttttggtcccgagaaaaggtttttgttttgtggggagagagaaaaccggttggttcttgtcaatacttgggttccgattaggccgcaaatctgtgtgggcgttgtggcccaacctgaactgtagcctggacggctgaaaaaaattggaatgggccactttaaaaatagtatagctgggccaggccagggaaggtcagatggtaagtcgtagtctcatcggttgccatatttcttaataagcttttttttattgggaaaattggaaccatgtcattataattttgtaaaatttgagatatgccatcctgatccacatgtcatttacatgtcattgagataccgatggcatatctcaaactttacaaaattataatggcatggttccaatttatccttttttattaggaaacaaaatttaatttgtagttaaaatttttatatattgttcgtaatgatttaaagccaacactaaaaataacttgcattgaaaatatcttaaaattaaattaaaaaaaattaaattttaactttgctttgacttattaggtcactcgtctctcaccgttggccatcattgttggtttaacttgagcttcccaatctctcttttcccatcccttgctatgtggatgaagcgtcacttaagaatattctgactacggctgtcctcgaggaggatatcggctccaacattgcgcatgaaggacttcgttggtggctgagaactttgatggcagtgctcatgtgcattgctacttgttatagaaggaatagacgaaaaagaagagacgaaattatagcgactaatagatggttgttgatgggaccaccacctcagttgccacgaaggcaaaaactattgtttggactggtttggagggggttgtaattgaacggttttgacaagtgaggggtgttggatgtctggttttatagccgacgaatgtattttatatgaacataatagttgaagggtacaaaataaacttgtccttattttatggagtatgtatctatccattcagatttgattgttttttaatattaagaagtttgtaagagtgcgatttgcaaaatctataataggagtactgagtggaagatgcacagttaccattacaaattaataatcccttaattagctttgttataaataaaatagaagtcttacattggccaagagtggaactgtggaagaaactcttttgagacaccaatgaagaaaagcggatagaaaagcgcctactttacaaagtgttatgaaaatatatgcacaacggagacacgaattttacgtggaaaacccttgtgggaaaaaaccacgggcgccgaccggcaatgatcactatagaggagatgattacaaacgtaggggaatcgtaatgggaacgtcaccccttcccgtacggcttacaagagtatatatagggataaaagaaagacacctaataggactcctactaggaaactaatccgaatatattgtgggcccaaaattcggatcacatatttaacaatctccaccttgagacgaatttcctcttgtagcataaaaacatcaatcaccaaaaatacctcatgtaggtaaaatcaccgcacgccaaatagtctctaggactatactgtaacacccaccaagcttgagcaaagctcaaacttagtagcaggaactggctttgtcatcatatcagctgggttatcatgagtacttatcttgcatactttgacatcaccttcagcaatcacacctcgaataaagtgatatctcacatcaatgtgctttgttctctcatggaacatttgatcctttgtaaggcatattgcactttgactatcacaaaatatattaatgcaagacgtaactccacaaagctcagtgtataaacctctaagccaaatagcttctttacaagcttcagaaatagccatatactctgcttcagtagtagataaggcaacagttgcttgcaaacttgccttccaactaacagcacatcctccaatagtgaaaacataacctgtgagcgatcttctcctatccaaatctccagcaaaatctgaatccacataaccaacaagtccatctctagatctcccaaactgcaaacaagcactagatgtaccatgtaggtatctgaaaatccattgaacatctttccaatgctctttgccaggattagccatgtatctactgacaacacttaatgcatgtgataagtcaggacgagaacatatcatggcatacataagtgaaccaactgcacttgaataaggaactctagacatgtactcaatattataatctgactgtggacataaatctgaagataatctgaaatgtgcagctaaaggagtactcactggttttgcatcatgcatattgaaacgacgaaaaactttttcaatataacctttctgactaagatataacttgtcagaatgtctttctctagtaatttccataccgagaattttcttcgctacacccaaatccttcatctcaaattcactactcaattgtgccttcaactttgctatctctgatttatcatttgcagcaatcaacatatcatcgacataaagaagcaaatatatagctgaaccatcaacaactttgagataaacatagctatcataattggatcttctaaacttctgagaaagcatgaaagagtcaaatctcttataccattatctaggtgactgcttcaacccataaagagattttctttaacctacaaactaggttctcttttccaggaacaacaaaaccttcaggttgctccatataaatgtcctcttctaactccccatgtaaaaatgcagtcttaacatccatttgctctagttcataatcatgcattgcaacaatactgagtaaagtgcgaattgaactatgcttcacaacaggggaaaagacatcattgaaattaatacctggaatctggctatagcctttagcaactaaccttgctttgtaccttgcctcatcacttggagacataccttcctttcttttgaagatccacttgcaacggatatgtttcttctcctttggcaacttcaccaattcccaagtatgattcttttcaagttcttctaccacactcaaagcataagcaactatgttcgcttcttcaatatctttgaggaggtttactatttcttttgggcttatcttttgcaatagaacgttttggagactgctgaacagtagaagaatctgaatcttcaataacaggtgcatcttggttaatagcaacatcttctttttctggtgcatgccctgaattgatcaagtgctccacctgcacacttgctttctcctgactctcaacaggaacattagtagaaggtttgtcatgtaacataattgattcatggaagacaacatttctactaatcacaacctttttggtttcaggacaccataacttatagcctttcacactagacggataaccaagaaaaatgcacttaatagctctaggctccaatttaccattatcaacatgagcataagcagtacaaccaaatacttttaagtctgaataatttgctggggaaccagaccatacctcaattggagtcttcttattggcataactgggtgatcgattgataagataacaagcagtagaaacggcttccgcccaaaactgtttaggcaaacctgcattagacaacatacaacgggcctttgatataattatcctgttcatacgctcagctacgccgttttgttgaggtgtgtgaggaacggtgtagtgacgcacaatgccttcagacttgcaatatgatttaaatatcttagaacagaactccatcccattgtcagtacgaaggattttcaccttcctttcagtttgtctttcaaccatagttttccactctttaaacacattaaaagcttgatatttgtgcttcaagaaataaggccaaacttttcgcgaataatcatcaacgatggtcatcatgtaacgagcacctccaaaagatgtcttacgagcaggcccccataaatcagaatgcacataatcaagaataccttcagtagtatgtgtagatgtgttgaacttcaccctcttatgcttgccaaagatgcaatgctcacaaaatttgagcttactgatgctttgtccatctagcaatcctcgcttgctcaattctgccaaaccaatttcactcatatgaccaagacgcatatgccaaagattagtagcatcggaattagataatgaatcagaaactgttgcaacattacctaatatagttgtaccttgtagatggtacaggttggcagatttaatactagctttcatcacaacaagagagcctttagttaccttcaaaattccgtctccaccggaatatttgtaccctttgcgatcaagagtacataaagagatgagacttctcttcaaattcggaatatgccgcacatctgacaatgttctgatacaaccatcaaacatcttgatctgaactgttccaatacctgcaacctcgcatggtgtatcatcacccatcaaaacagtaccaccttgaacaacttcataagtggcaaaccaatccctattcgggcacatgtgataggtgcatgcagtatcaagaatccactggtcactagtttgtgcacaaccagcataagcaacaagcaattctgcatcagacttctcatcagtaacaactgcggctttaccttcctcttctttcttaccttttggtatatattttccggttctcttgtctttatcctgtagcttccaacacttagagatatcatgtccatctctcttgcagtatttgcatgacttatacctgcctctggactttgatctcccacggtagctacttgagcttttatctcttgatttgttgtttgtgttcttctcctgttggctaccccgaacaaccaagccttctgcttgtgaatttgaaccttcagagggtaccatcttcttcatcttttctttggcatgcaaagcatcataaacttctttcaaagttagagtatcacggctataaagtatagtatccctgaagtttgcatatgagctaggcaatgaacacaatagaataagggctaaatctttttcatcatactttacctccatagactcaaggtcagcaacaatttccttgaaagcggagagatggtccatcacagacccatcatcttgcaacttgtgcaaaaataatttttgcttcaggtgcatcttactggtcagatccttagtcatgcatatctgttccagcttcaaccacagcccagcggctgtctcctccttaagcacctcctgcaaaatattgttagatagatgaagatgaatatatgacatagccttacgatcccttttcttctcatcgttggaccaatcctgtgtcctcttgtcaaatccagaaagcgcatcatcgagttcttgttgtgcaagaacggctcgcatcttaacttgccaaagtgagaatcttgtgtctcggtccaggagcggtagatcatacttcaaactcgtcatgggaattaatcctgaaatttgctagtaagaaattagggtaaactagcaaaaacgcgaaacctggtacacttctcgtgtgcatgtagtgtagatctgaatcttcctggtagacaagcttgtgtgcgcgtagcaatttcaacgtgaataaaaattcacatgtacaggagcgctctgctcctatctcgatggctttctggcttctgccctacttttcctcggtgaacgtgcactgcagatggaagggttttctctctgcttgcttttcctctcctgacgcgtgcgctgctgctgctctgattcttgcgcggtaggaaggacgaagtcaactccgctttggattggatttcgccgaacagaatttcgacggaacgacgaacacgactatgtgtgccgccgattagatcgatttctatgatcgggaaaaatcgccggtggccaggactgcagtagatcgatctccaatgctctgatactacttgttataaaaatagatgtacaacggagacacgaattttacgtggaaaacccttgcgggaaaaaaccacgggcgccgacaggcaatgatcactatagaggagatgattataaacgtaggggaatcgtaatgggaacgtcaccccttcccgtacggcttacaagagtatatataggggataaaagaaagacacctaataggacttctactaggaaactaatccgataatattgtgggcccaaaattcggatcacatatttaacacaaagggtgtaatttatctatttggagcaaaggaagaagaacaaatcttcgtatataagagctaaaagtgtggaattgtataacttattatcgactatgagggtaaacaactgtatttttcaagcatatcataagtacggcaacaaaataaacgactatacgttgtttgcgtgttgtatcctaaactaaacaacctacaattcgatgcagacgtcgattaaaattagaaactcagctaaacaaatagagattttaatgcggatagtgtctaaatctaataggccggttcgagttaacaacgtaaagacgtttatactccgtacgtttttttgagacttctatcaacacgggacaaaacgaaccggcctatcagaagattggacactcgagaatggaatgctcatgtcgcaaatagagacatctatccctcatgtcgcaaccgctcgagaatggaatgctcacttcgcatggattccgtttgtgcaaaaacccgacaaaacgaaattactacgaaagtgtctgacgggaagattgacgtaatgagggaaaactgaacacgggacgacacgccccggagtcctggacgttgggactcggtggaggtggtcgagttaactctcgactccctctttcttgcgcagggagtaagaaacaaacgtgtcttttcctttatgcttcctttcttgcgcagggagacaaacgtgttttttaactttctgaactcgaagtttttctatctccaacagaaccatcacagactcaggcctgttcttttctcgtaaacatatggagtagattttacctcagttttgttagcacgtttttcagttttgttagcatgtttttcaaactaaatgatatgtttagtacgaaaactttttatatagaagttatattaaaatatcaaatatattcatttgtcaagcttataataattaaaacttaattaattatatgctaatagctttttcgttttacatacgctaacttaatattcatcttcgtgagtttcacacacaccttaagtacataacccgattgaaactaccacggcaacagatctactagggggcctctgttcggcggtgggagtttgtgagttggtttgtttcgttttccgcgcgcacgcttcccgaactactaaatggtatattttttaaaaaaaattctataggaaagttattttaaaaaaatcatatgaatctatttttaaaatttaaaatagttagtactgaattaatcatgtgttaatagctcacctcgctcgctttgtgtattttctcaatcttctcttctcatctcatctcaaacacagccagtactagtctgcttttagcagctgtccagaatattgagctcctcaaactgtttaaattattaaacatcaaataatcaaataatttatagttataaaatctagaaaataaactacaagttgaaagctaaatgatctaactttttcatattcttagaaactaactaacaatcagttgcttctgactcagaatcttaagctcccaaacggaatttgaaatttgagatttgacttcatcctcacaaaacttgtaaccttacaaatttgaaatttgactaacacgaacttgcaaagtaaaaacaaaacggaaacccgataacaacggttcaattttcgagggtcccaacagtaacaactacatacacaaattgaactcaactcaaattatgtgaaataatgctgccaacaaatgggctcacaaacggataaatcctagaccaaagtgatgactgacgtaagatcaaactaaatcaagactaaaatcatcactcgatacaacaatgcaatctaaaattcaacaaatcataatctaataggaaaatataacaactcaaattggtttggtaatgaattcaatttgttcctggttataggtcgatacaacactagtataaaggagaaaagaattacctaaggggtaaactgtgctctaataccacctggtgtgaataggtgtttgatcttccgataggttcgatttggaggcttctggtcggccgatcgtcacctcgcaactattatatctgcatttagtcattattgaccactctctcaagtaattgaccttatcacgaaggttatgtttctgcaaatataattgaagaaattcacaaaaacaaggataatgaatgattggcacacaaaggtgaggttgtttaaatcgatctaccggtgaaactgcatgattgtaaaataataatataagtaaaactctcactctaagcgatgacgactactgaatgtatacgattagaggtgtcctagagttagccctagagcgcacacctctttggcttagcccacaacacggtcacaaggcccaaggcccaaatctaatttggactagatgatgtgcataacttatttggatgattacgtacatcttagaaaaaattttgaaatgagaccaaaatcaacaaaaagtagacttcataagcttttcaacaaatactcatgagcttcgcgagtctttattgataaacaactagatccgtttgaaatagtgttgccgaaaggcctaaatctgagtccaaaatatgtagaattttatcgcttgccttatgtggctcaataatgacgtggttgtgttgaaataggtttggggaaggccatagtttaatctccaatctttttttaaacaaccaatacaagcactcaagtaaataataatacgtaaaacctatgttttagtgtaatttgtttgaatatgtagaaggtaaatatgtaccctttagcttattattgatgtatagaagtatatatgatcatacctgagccgacaattccatatcagaatttaaagcatgtctcttaattaaaaaaaatgcaccaaatctgatgcaaaataaatcatctataaataagtataccagaaatcttagcccaaacgaactctatccaagtcaagagtgccaagtctcctccatagacaatcccgttccgttcgtcttgccttttggctgttgcaatctgttgagcacacaccaaaaaccgcctacgccgagccaaaacccccaaccccgatcagtccgatggcgtccgacgaggcctccccggcggcggcggcggcggcggcggagaggattcgcgtggtcggggcgtgggccggctccctggaggtggagctgggcggctggacggtgccgatgctgcgggcggaggtggcgcggcgcgcgggcggcgtggagcccgaccgcatcaacctcatcttcggcggccgcgtgctcaaggacgatccgcccgcgtcgctccagcaggccggcctcaagggcaacgccaaggtgctctccaccctcctcgcccccgatcgcggcaaggccatcgccgcccaggccgccgcggcggcggccgaggaggagcataataataggctcgtcaggctctggtaaggaggtctccgttcctcttcgatcaaattctagaggatcgatgggggattttgaggattccgctcccatgtttccagtcaaaattccagtcatattgggcaggatttgcagcctgaaattaggaaccacgattcacttattactctttagttgcatactcaaccgcaccactgaacatagaatccatcgtgccccttggtttgggtactgattactgaatgtggtatcaagtcgttagtcatctttacaaaaggattactctatgccaattctgggatgttctaatgaatatgcaaagactattgatttggtggttgtttgtaaccataccccatggttacttgtatgttttgttttgtgtgaagtagtaagaagcacaaaaaaaggtattgagtaccattgtttctgagtaattgatcacgaagcatgcgggtgcagagcctggaatagctcctactgaatctgaaagaaggctgagagtctgcacaaattgtgtgcccctattgaacagtgaaatgatgtataatgtattaggattaccacataattttgttggtttgctagaaactcacacacttcttttggtcgatggatgacacaataatttttgtaggaatgctgcagaagcactatgtcaaaggcatactgatggctcctttcatgaagaagatttcaacttagatcttgaggatcagagtggccagaaagtgatgtttggatctgtagatgatctcaagtaagagattgaatcgtctaaacagttttctcatactatgatttattattattttataatataacatcatcatctgttatctctagggcggtaaagatggctttgatgcttcatcaaaaagccaaaacatttatcaagagggacatgcacaaggaggcacttgatgtcttagcaatggctgaggtatgtatgtttgcttgatcctaccatgcttgtttgactgtttgtttccttccaatatcagtaagcatgtgcagctttttaattggtctgctttatatgcaaccaaatatttgtatatttcctgacccttttgttgtgtgaacaacaggaagctttctctctttgtgaccctaaactcattgaggtaaattgaattgcaagaagaacattttttacatgtatcatagagtgctgcaaatattttacctacactccatgtatattctgcagagggttgataatgtgccgatgcttcagctagatatagtttggtgctatttcgtgcttcgtgatgtatcacgcttagaagttgcaggaactcgcttagaaagggctcgctcaggatttgaacgttctcatggtaaagactctgctcgtttcagattactccaagctggccgtcatgcagatcttgcaatgtgagcacttactatcaattctcccttctttttaccatattagagtctgaattttcattgagaagtgagaactgttccttacctatgaactgatgaaagcattcattctctaattttatatatgaaaagcaatgttacaattgtataactttttatagtggtgtttatcaaggttcaatcttacacattctagttttgacttatgctgttttccaatgcatgaaaaattgccatgtgttttagatatgtaaggctggagcttttggaaggagtggtagcatatcacaatgngaaatactgtgacaaggcgctgtgaatcctcttactntctgcccaagctaaaatacatgctaggtattttcagttgttaattttgtctgctgcgttttctattattattttgcattggaatattttagtaccatagcttctagtaacttcttgactttatatttcctaactgcatgcgatatttagcttcaagtaccagatgaagctatatcaatcttaatgagcatgggctatggagcacaagctgcaaaaagagcattaaagatgactggctatgatatccaatcctcagttgatctcttatgtgaagagcgtgaaaagaaaattcgtagagtacaggaagatatggagatgcaaaaagagatcatgtgagcttctcatcaaggggtttctcttctattctcatttgcttttcctttttgctgaatagtgtgaacttccttggtgatgtcctagggaacaaaagaaatatggtaaaactcccatgaacaaggcagtgaatatgcagaagttgaaaggcttggttgcaattgggtaagaatgttggtcttattacattaatcctgaagttctagatgttgattttgtcatgatgatctaatatagcattttgttaccagccatgaagactagatctgttgagaactttagggcacctattgcttggcagtccatacattatcttctagaaatattcttgtctgttattgtcttattgactaatgtattgtaggatcattgtattataagtcatgatggaaatcttagtcttatgacactcaatataatctggataccaggcataccatcttgaaatgcttgaaagttctctctttgcccttttccttttagcaatagcttttacagtctacatgcattgtgaaagaaacaaagggacaaaatatatattgactacccagttgcactttaaattatggatagtgagtgctgatgtaatataaagcaaaataaattgcactcagttgtttgtggtagcgctctttttacaattccacatatttatgctgtcgtacttcctatttgtgactaatcagttgtttgtatctttaaggtttgagaagaaacttgctgctgaagcactccgcataaatgaaaatgatgctgacaaagcactagatctcttgacagatcctgagcaaaattgcatcctacaagtaattctttgcaccgttttggaactcatattgagatactctgcagttgttaactctatttctgtctctttcactttcagcacaaaatcatgtcaaaggcgaagcgattatctcgcggtatggatcataatacattcatgattgctctgtaaaatcagaaggtctcagatgaaaacgaatttatgcccctttctgttctcgttgttcttgctaggctcgggctcagggtcatcaagctccagggctgctgctgccacgactgcttcaggggtaaacaattcacaggctccggttgacacttcagctaatgttccagatggaagcgctatggaggagagtcatgtgttgcctgtgatcaatgaagaagctgcaaacaacgtagaggctgtgaacgatgacgaaactgtgaaccatgaggaggaagatatgagcgaggagtcagctgagggtgaagaagaagcaaatcctcctccagtcagggatgtggcgatggaaaacgagcttgcccatgaaatgacgggggatgccttggatgactatgatattgatgttagcaacgaagggcaggctatatcagagtacctgagcttactggattctgctgcttaggcttgatgtgcaaacatattactcacctggtctagatagtttttatcaaacctcagaaagaaatatagtcagcctcaatccgagagagtttgcttaatagggtcgatttgtacatgagtttacctttctgccacctggaaacttattaccgtgtgcttaagtaatttctcatggatagcaatctcagctttagaagttactccttgtgctatcaactgtatcttaatatgtgtagtacgtatgtagttcctatagttcctatagggtaactagataagctcgcgagtatagcacaaaacattgcaaacaagagttacatctgggaattaaattaaatagttttacaatacatgcatacagtacaattgatgacaatttccggagccactacatgtacaaattaacattgcaaaacaagaaaagcaaatccaataaaaaagaagttcactgaataattgaacatcccagaagcgagtggcttcatcacccgaccgatttgaccaaattaacgaccgaccttaatttgattgaagctaaactgtgtactcgagagagaataatgaatgcgtgcatggcttgggacgtgacgtgcatggtttgggacgtgacgtgcatgaggatggcttaggcgcaggtgtagccaggcgggacgtcgcagccgcagttgacgaggagcttgagcgcgatggggatgtagatgctgatgtcgagcaccttggccttgatggcggtgcagaggcaggcggcggcggacaggccggcgatgtccttcaccagcgggcagcacgtcacgtgggcgtcgccgatgtgcacctcgttgccgaggaggtccacgcacacgccgagcttgagcgcgtcgatggggcacgtgtccgaggacgacggcgtcggggtggacggcgtcggcgtcggcgatggcgggcacgccttcctcccgccgtgtcgcttcggcgggctcgggctcgggctgtagccgccgccgccgctgccgccgccgatgattcctccgacaaccggggcgatgcctccgacgacgccaccgacaaccggggcgacacttccgacgaccggggcgacgccaccgacgactccaccgacgaccggggcgacacctccgacgacaccgccgacgacgggagggactttcccgacgattccaccgacgaccggagctactcccccgacaactcctcctacaaccggaggaactttcccgacgattccaccgacgaccggagctactcccccgacaactcctcctacgacaggaggaactttgccgacgattcctccgacgacgggagcgacacccccgacgattcctccgacgactcctccgataccaccaccaccacccgagggcgcgctgccgccgccgcccgacggtgcactgccgctaccgccggagccgcacgagccgcacgcgagggcgagcggggaggaggagagcgcgagcatggcgagcaggagcatcgccgagaccttggtggactccattgtaatcaaagaatcaaatggagctcgcttattcgctgctacgaactgcgaggtgtggcgggaggcgaaggccgtggcgcgcgcgctcttttataggcggggaaggcgagcggtccgggaaagtattttcatcacttgcttcttgcatttcgggtttgtttactttaatgtcatttttaaccttactaaattttagtaaaattactaaaaaaaatagctatatttagtttgctgtcaaattttgttaattatataagaaatcctgctaaattttttggtaactattgccaaaatttggtaagttttttttttgacatcaaaatgaacaggcccttcatcgtctaaatagttatataaaattagagataaattaatataaaatatacttcctccgtttcacaatgtaagtcattatagcattttaacatcaatatgaatgtgagaaatgctagaacgacttacattgtgaaacggaggaattatcactctataaacacatgtagcttcgaattcaacttttataagttgtaacgaaaataacaagtagaattatgaattaatgtatgttaccctctccgtctcaaattataaggcgtcctctttttaagaaaaattaaactcgataacttttgactaataatcatattaaccatatatatgctaactattatgcatgctatattactagatttatattttaaaggcttttcatgtgatgttaattttatatttgttggtaactaaacatgaaataaattaatggtcaaagtatatcaatgaagaccatttaaaaaatataggcattataatttgggacatatggagtaattatttttagtttaatttgttcttttatgacaatttatagaagctgaatttagttttgcatatttgtatattctatattaatctatgatgttattttaataatgattatttagatacggaagaaacgaaatgatgatgccctgtcgagaaatgaaaaaccatctctgagcaatcgagcggccaggaatggtcgagagctttgcgcgcgcatgccatgccactgagcgacgggggcgtgggttggcgcgcgcgggaacgaacgaaccggccacgtgaagccagtgggattgccagtgttgggaggcttggcccgttgccaagccgccaaaaaaacaggcgcagcggcgtgtgacactcgcttgtccgcgcccgtcgccatgagcgtgcatgattgcaacgcactgcttacttcccttgctctctgtctaatctcacagctcacggcgagagcgaggccgtagcgcgtgctgtacatgcatgaaccgatgaacctatcagagaagtttttttttattacagtttaattaattcgttccagagttcaaatgggattcatggattcctctctgatccattaataatgttgcttaactctgttcagagatgtggtactgctactccattgtattttcatataatccatatgcagtactgctcttcaatctgaatcatcatgtagtgttgttcagttggagcgggcatgtatatatccatgatttttttttgatgaaaatatatatccatgattgattcagagaaatatgcacgcgctcaatatttttagaatttctgaaccatctcgctataagagaacttttatggtgcttgcattccaaaaaaaaaagtaaaaatccaacgctcctcaataacaggtaccatatgaaaagtatttaaagtatttaagtattagtattggtacttagatactaagggtaaaaatacaaatatattagttgagagaaatggtagaattgtccctaaatttttatcggtaccgcataggtaccagttaagtgatttgcccagtactagctgtcctcattttcatgattttctatagatttatgttgtgttctttgagattctcatttgcatgattttctttatatttacgttttgttccgaagaaaatgttattggagtaaaagttttcatttgcgttcatttctatagatttacattatgttctcaagaagacgtcaaaacccctctgtttaattcttttgagatttatatcttttttactagaagagatttgtattgtgtttcataaacatgattggttaaaatatcaccgaaggtttgcgtcgatttaaattatataatattttataaatttatccctagtaaagatgaaacttcttcctcgactacataaataactaattaactgtgtaaataagtcatggatatctttgaaggtagagaagaaaggagatatgatctttgatttttttttctctccgatacatattgaatcaatcgctaaattaacggggtagccatgatttacgtttttatttctctacaatggtatcgatatgtacaacgataccggtcaatagaaccaggtattcaattcacattaaatacctataatttactagttaatactgccatcatgttataataattttattccgtaccttatccctcttttgatcaacggttcacattaatccaccttttaagtacctcacaaacaccgtaaaaatctaattgatggcacttacattatggtaagaactattaacaagttcagtgcacctgacaaagatattcagatgcccattgtactttcctctagtagtattatctaaagggtgaccatcaatgccagcacattgctgaaggagtattagccatattggtatactggtctgccagcactagattttgatttggtcgaatggtggtgataggaattcagtattctcatgctatcaaatgtttagagaactttctgcagcgattacatcaaaagttcttgactagaatgcgagacatatcgttacaccgcatagcaaactgatgaaggcctgctcactgtacttagtttgcttggttttgcttgcaccaagctaacccagatcgatacgcagatctggttgtgggtcgaactattactaaggcagtcaagtatcgatctgcctcgtctacatgcccccagatgttcagccatactgccataccctcatcctaatcgctgagaccagcgcatagagtagccccatactgacgagttgttcagaagcgaaatgcacatcatcatgtgacgaggacgtgcgccatgcaggttttaagatcttaattattgaccaacaatatcagtgacagttcttattaattattgaccaacaatgtcagtgatagttaagctcgattggacgtgcgtcgcgtcacatgcattttctgattataagtgttgcaagatcgagatgccgtcgacatagttcagaattctcatatcatggatgcaaactctatcaccatcgtagcctcaatcaagttcttttttttgttttgttcttttgttcagatgaactcgaagcacagtagcgaacgcagtaagtgactgcatttttatggataatgcaaaagcttgtacaagggtaagcaaaagaattacaatgctgcttcactttggacactaaacgaaattataaaatgcagagcaattttacgttccttgaggaggtatcacaaggtaccattttttctattgtaaatttagtatcttatggtacctaggtactatgaggtatcataagatactaaattttacactaaattttttgtatctcatgataccttctcaaagaccgtagaattactctaaaatgcagatctaatcagacacatttgaagccgtcagggagctccgtcttgcaggtgctgacgaggacgctgacgccgacggtccactccgtggggatcccgagcacgctctccttgatggtggtgcagaagcacgccgccgcctcggccgcggcgagcccgtcgacgagcgcgcagcacttgctcccgaggtgggcgccagcctgcacgcccacgacgcccagcacgccggcgcacgcgccgaacttgacggcgtcccacgggcagaacgggttcaccggcatgtccttcccccacagccccctgcgcggcgacgcgccggccgccgccgccgcgcgtcgacgccatggtgagcatgatggccagcgcgagcgccgcgacgtcgcggcggctggccattatcctttgcttgtgccgtgtcctcgttctcgccgcgtacatttttatactgcataactacgtatgccactactacgtatacgtacgatacgacgtaaatacgtatgtactgaaaaaaaggttacgtactttttttgcatgtacggtgtagttatattcgttctagttttacatggaactacatactattgtggtaacatagtaaggtacactagaagaatctagaaatcgctcgtgtgttcgacagtgcactaggctctgcatcaacgacgtgacgatatttccgcttgcgtagcattataacgatggtgatggcaccggaagattgcaaattcaggtggtccatttgccatggtcccgtcgcaaaacacaaggtacgcgatcaccactctcaccagcagcgtacgcgagcgcgcgcagtagctcggtcatgtgaggaggaaatggcttcttcgatggagcaa

SEQ ID NO: 50639 - DNA, 10252 bp, Oryza sativa
ctcaacgcagcagcaacagcagcatatgccagcatccacacaaatttttcgtaaccagcagaagagagatcaagaacatcaagaacaaggttacgaaaaatgccggtccatgcgtgcatgcatgacagattcgacagaaagctaatcaaactgttttgtgtgtgtgtgtgcgcgcgcgcgcagttggcttccggctcgccaccggcagccgcgcgcggtcgtacgccatgcgcgcccgcgtgcgccgcgcgcgacgccggcgaccgaacggctcgcgtgcgcgcggatggaaaacgtcgggagcgcgcccgggcgccccgcccgtgacgctgaggattgagatccatccgtggcattggaccaagtagaacatattgcatccaactccaagtacatagtacatgcgagtgtagaggaattcaacctcgatcccaagtggacaaatcttcgtgagttgtgattagctagcatgcgaaacaggacatgaatcaaccgaaaatactgatatcatcagaagttcaaagaaattactgccagttctcctgcaggtagtattttaaaatttaaggggtcgttaaaattgatgacatttcaaaccatatcactttttttaaaaaatattaaatagtgtattcatttagtttattgtcaaactctagtaaagacataagaaatcctaccaaaattttagcaatatcgctaaattgctaaaatttggtaaagtttattttggagtgaagtacatgggtggtctctaaacttgtgtaggtgtgttatctagatccctaaacttccaaaatgtatttttagatccctaaacttgtcatgtgtgtcatataggtcctaaccggttcaaaccggctccatgcgctgacgtggcattgccatggtggcacctacgtgtcattgaaatccacatgtcaagcatatataaaaaataaaattaaaaaccatattttctcctcttaggtaaacataaaaaagacaaaaaatctaatataaaaaataaaattaaaaaccatattttctcctcttaggtaaacataaaaaagacaaaaaatctaaggtagagaggagaaaatatgcttttttaattttattttttctatgtgcctgacacgtggtacgtaggtgctatcatggcatgccacatcagcgcatggagcgggttagagctcctctggacctagatgacacctcaagacaagtttgaggactcgaaaatgcattttgagattttagggacctagatgacacgcccgcacaagtttagggaccgctcatgcacttcactctttattttggctacaatcttaacatgccctaaactatatcctggtctttatttcgaagaaacttcattcacttattacaatattttcttaaagagaacaaacactcatgcaacagtataaactgaataataaaaccaataaataaggagaaaacaactactgatcatctatttgtgaatctccatccgtagttggcgaaaatctataactgtaacttctaagtttcgacatatagaatatatgagcttcttattctcttcacacttttgaagttatgcccagcaatcgagccaacgtgttaccttgaaaagtgtgtgtgtatatataatgtttatttcaagatttatttaaaactatatcatttctacttaattatagagccaaacacaaagcaaaggctccaacaaatatgagattcttagttttcgcagctagtttacacggccatagtatatatatttgctagcttcctccgttgttcgtgaggtcaagaagaggtccactaccgagccatggaagccgtctgccggcgaaagaggcggtggacaagggcaacgacaccggcgagcaggcgaggcggtgtttactagtttcgagagtgaatggaccacacattttttatcaaacgggtgagatatgtcctcactcaatttcgttaggttttcatattgccccctcattcaaatcgctctggtagacacatggatatattccgaaataaaaatactatagaactggtatatcgttccaataaaatagctaacatcattatggtaggtagcagatctagtatctactaggtattatgtttggtacaggagatactaaatccagttcctcggtattatgctaacgtcagcatgatgcctattgtaccagatctgatatctaccagatatcatgtttgctatctccgatactagatttgatatttacagtaccatgctgacacctagttataagatctcataactacgagggtatcatgtttgatatcagagatatcagatctgataactaagatatcgtgctgcaaatattagctatttcgttggaacagtattccgttaatgtcgtctcccaaattctgaaaaccccctacaacacagttttgcaaaaccgcggccaacgcaggtacgtggtctcgcttgctgcatccgctactgtcgctggccctagccgccgtgcgacaatggtgatacgccggcaagccggagctgtcgatgctgctgcgtgggctcgcggctcctctaggaggcggcaagcaatctcgacatggcgacccccttcctgaaggatcagggaatcttgactggcagaaatggacccccttcctgaagccgccaatctccgacgatcaggcaggagtcgggatcagggaatcttataccggcagaaacggagctggaacattcgatcctggcttgctgtgcgcgtaacagatgctcatgcatctccgcttggactatcaatgagtcctcctctgccttctgcttgcttagaggatttggtgtatgaggacacatgattgtttaagtcaaatttaatttaaaaactactacatgattatatgcctgaattcagagcatcaatacgaaatgtggagcatgcctgcagcttgaatatatgaagtcctaccatttaagggatgacccattgacccacacattaacgagagaaaaagtggattggattgatccaccagttaacctgaatcttagggaaatatttcctatcatggtccatctcttattctctttccacctattcccaaaccaaatatcctgaaaaaaaaagttcaacccaacccgatccatccaaaccttaaggattgatgccttatgatgatctcctaaaagttttaagtatgtatttggacagctgggaaaaatggctcagtgatgtttttttattaaggctggagtggagtacaagtgtacaacttcgcatcgccagaaaatgtcacaggaattatcttattgtcgagtgtgcaaagcaagtagacaacaacgaaattgggggaatgggggataatgaaaatgcggttgtacatacatttatacatatttacccatgatatttatatccaagtgaccaagtgcatatatacacactgcatttatacaggaacgtaacatcctaaacgaccagatcttgtgaatatgtaaaaccaagaggaaactcaactaagaacagttctataatttcttgaacttacccatcccttcctgatattgattttgccgtcggctgtttgcatgttagaggcatatttaggcatatcttgtaacttatagtcaaacttttacctgtgacttgtacaggaaaaaaagtatagtgccaaactctacaagaaggatcttagggccgtcacaaccttctctggcctgcataacatgacaagtgagatgcgttaaggatcgcacaagtatatgaattggccaaaaggtaaaggttgaaggttacacgtcaaagcaggcaagcaccgatggaactatgagtacaaattttacaggacacagatcgacagaaaatactgagctagtaaaaaaacaattaccagtcctcttgaggcatatgaccagctccttctattggctccaattttatggctgcaggattacctttctggaactcctcagctatggggagtggcaagtacttatcagaaatcccccatgcaagcaatattggtttttcccagctgcaggaaataccagagagaagtttcagaactggaaaacattagtgataactgatacctgtctaatattgcttgcttgaattcagaatgaaccttttgacactgctgtgcatgcatacatatgtttatggacatagtagtaacttgcatgttatacggcataatctatctgtttttaattatatcagaagctaataaatatgtttgtttgtttaagttatctgtttttagttagaacagaagcaataacatgcaataaatatgagtgattgtttgtttgtttaacttacctgttggatgcaaacccggctgaaattctacttaatacatctcggaagttagctttcctggcagcttcaagcaatgctaaaaaaaagaaaagcgagatgtaactaaggttgtcaaataatctcagatggtaatgacagttctaggtaaaaagtagacaaaagaatataaaaaaaaatctaaacatcatttttcttaaagtacaaggaatacaacataagttgcagaagaagtaatagttgttcgatgctattggcataaggcgtagcataaactagatgatacttcacgctttgctgcgggatatatgttagacaatggaaaaatgatgaaacgatttggattgaaatattataaaaatgatttgaaaatgatgatttagcatgtgtgtgtttagttttagaatgaaataaattgtagatataattattatatgcttgcatgttgagtttcctgtgtttaatgggttgatgtggcatgcttgcgtgtaggttttaggagtgctaataaatattatgcttgcatgttgagctttaggtatttagtgggcattagctttatataaagaatggacgaacaaaacaacagtttttatatagatgatgtaatacttaatagcttaaacagatgccttcaacaagtataatccttccctccgaagtccaaggttcaaccaatataattgtcatggtagcctggcaggtacaacattaaccatgcaggctaaggtacagatacaaattgttggcccaaacatgcaagcaaatatcctataataaactaaacatggtacttttcagtaatcatcatatgtgtaactagtagggttctaaaaattgcagttttgctttatgaaggctaaagcaatataatcaagatcctttgctgaaaacacttatgtggacccagtgccatttcttcataagataacttccaaaatagctaggcattgagtgaaaatatgtaaacataaacttcgagtatttcccatggacagtaattaggattagctagaaggaaatagtttcccctgtggaattttcgtttcctttattatgaatatagcccagccccaagcccaggcaaaggaggaggttgtgacaagcttggcaagccaatgtgaaaaacccaatcattgcgatggagggtaagctagatggaaatggctgtgcaagcagaatttgcatttccttcattaggagagatggattctataaattgataaaacatagtcatatagctgacaatttatttaggtacgtttcatggctgagaacaatacaactttaatgtaaagacatgttgggggcatgtgattcaggtgtacagactaaccaaatccaggtgcaccacttgatagatatggtaatctgtatacatcagccttctccgactttagcacatagctgtgaagcaagtggacacaatataagcaaatatgagaataaacaacatgccacagatatggacaggactgatatagaacaacataatatgaagaataaaccaaactttttccttattttgagcatatcagtaagaagaataatgataacatatctgaagaggagaatgaagaatttctgtgacaatgatagatacgtacgggctacctgcttcaatgaatctctcagccaaaacagcattttggcaggtaaattcaccaaaaagtggcaacctgcattgaaatgtgacttgaatttacttccatgatacaaatattaagggcaaaaaaggcaagatggcatcaactgcagcattagtgaaaaatattgagcagtaagcaggttaaagataaattctatttgcacatgtatcaaatactcatactctttttaggaccagcttgtataaagtccaaataaaagttaatagcgaaaaaccatactacgctattaaggcggatgaaagcattaacataccaccctcaaggcattttctatataataagtccacaataacatccgataaaactgaagaaggaaaacaatgtgaaaaagaatatgcacaatgttcatttttcgggtagatctggacgtcaaattgctcatgcataaatttatgtcacactttcaggtcaagctttgcgctttcagacttctgctcaggctgggttcgggcgggcctgagaaattgtagaaatgccaaggaaatggagctggaacattcagatgtgcagtgactagtaaagcagtgactgatgcatctttgctcagattcttgcattatcaatgtatagcggatttggttgatatgttggtgtacgcagacatatggcttgtttttaagttaaattttgttgaaaagctaaagaactatatgcctgaacttgtagcacaatgtaaaatgctgagcatgcacttcaattaagatgcaaagcaagagaaacagaaagactgaccttagctggttaaacaatccaggcactggagaagaaacagtgagtggactgttaagaattgctaccttcagaactttgcttgagttctttagtgcccatgttagcccatatgaacctacaagaaatccctagaatgaaaatgaaagaaacgattcagaaaatatatatgagaattattatgaaaatgcaggttcctaatgttttgggcatgtacctggacaactaagaagaatggctcagtgatatttaaagtactaagaagctcatcgagtgacttgtggaactcctcttctgcacatgatacaatataaatgagagtttagtaagattcattaattttgtcaacatttgccacacggccacacctgtgtagtcgaatccatatccgggctgtggcatatcactgaacccaaatcctatccaatcaggagcaaagcagtggtagccagcatctgccatctagtagcaatttcaatagctgcttagtgggtaaaatgatcgatagaaacaaatcgttagtacgatttataaatttatatttaacatgaggatccctatttattaagcttccagtataatgtcataaatatgctccatattcaaactatgtttttcttttaaattttaatagtctctggaaggtcacccatctgtctcggaatcataatcaacaggacatacacatgctgcagctgttagatgtctaaagtcaccacttaaatggtgcatggagctaaactttgcagcgaaagaaaacatattttagaaagaaccacatactaatttaagccagaaccactgatattttctgtctggtaatgcaaatcaagaacaacaaattgtttcataaattaagtttagtccaacaagctgcaagataaatgagtctgacctgagacataaccatacgatagctaaatgactgagatggagcaccgtgaataaacacgacagtcccacgtcgtgcaccagcggaacctacaattgtatcaccatatttatgaagcaattacatggggctttttatttgacagagacaattgcaagatggctctgtttgcaagaacacctggtgagcccttcttttcatggttcagcaatgacaactatacaaggacaaggtacaagacaaacaaacaaaaaaaggtacattttccttaagttttatagaggcagaattatagcaaattgggacaggttttgtttcctttaaaagctttgcagaaggagatgaacttatgtactactgtaggagaaatcaatattactgaaatacacaaaggtctgacaaaatccactatcttagtgaaagtatcattcgtttttattcttaaatactaaatttgtattcacaatgcaatactgcttcgtcgtcagtacacaccccatttcactggatcaacgtgcatacaacgttttactaacgttcagtgatcactgcaataagatcatctttcatctaaccaacacagaaatgaagaaacagtacctgtttccctcacaaaccaccgcagctttcctgatttcactcttgagccgaactccctccccttgtcctcgatcctctgcacgcgtcgagattactttacagcatactagaaatggtcaacaatgatacgagttcggaatcaaggaggtgtggcgaagtgggcattacgtagagcatctggccgacattgccgtcctgggcgggcgactccggcagctggatggcgccgcggctcgacgggttgtccgtcacgaacccgaacgggttgaactccgactcctcctcctgctttttcccctccgccgtctcatccttgctgccgctcgccgcgactaccaaactccgcttcgctcctcctccacgcgccctccaagcggcggcgttggcgctgctgccgccgccgccggaccacctgcctctgcaagcggggcgtggcagggagagaggagacgaggtggtggtggtgcaggggcagcaggacatggcggcggcgttcgggtgggtgtgcgcgcgcgcgctccggcgagacgtggcggcgcggcgagacgctttcggttggcgcagccgcgtcgaacggtcgggaagaaagaagattctccgcgaattgcggtggggccgacaagatcacttctcatgtggctcccgtgcacaaccgcaggtgagccactctctcactctactctagtctagtggccacaattgaatcactctggaaatccatgaattttctaacaacaaaacttcacaattcagcaacacaagatggctatgtactgtacaacttattggtaaattcgccataaaggcaacatcatctagagaaagtttgaggagctctttgttgtccaccaaatggaggagttgttctatgtttttttttctctagttgttcagaatgcaattgggaatgggtataatctgtgcaaccaatcatgcagaatgttatccttgagcttggtgttgtggcctgcaacctcctggtccatttccatagctggggttatggtagcctggtttgttgccagagcctgatggaccatttgatcttccaggatgtccgtagtgatggtgatggtgttcttgccctggatgcagaactggacgccaagggccagggggagcaaaattgctaggtggcctcacgtgtcctgaagttgcaggaagattggccattaaatcgaatgttgttcatcaggaaaagtaccatttttgtttccatggtttcacggggaatgaaaattacctggagtaaatggaggacaaggatgtggaggagcatgacgaggaaatgggccttgatttgcatggaacggaggacgccaaggatataagtcttgacctgcaaatggaggacaacgccgaggaaagaagccttgatttggtagtacaggtggaggatgccgaggaacgaagccttgaccagctaatgcaggaggaggacaccgaggagcaaggccttgatcttctagtacaggaggaggaagccgaggaacataaccttgatctgctagtacaggaggatgccgagctgctaaccgttgatccccttgtgcaggtggaggatgccgaggaaacgagacttgatctcttggtatgttcagacatccagatggcatatttggatcatgaccagaagagatgtcttctacttcaagtggagtataagatttctgagtaattggaggaaacacttgtgatggtgctttagaccctgtggagttcttcaaagatggtgatgtatgtttacttgaaccgctttgatgcagtttctcattatccaacccctggaagtgacactctggcatgtcttcagcatcaatgtcatctttgctcttgaagttctctatttctgccttgcgatgagatacttgattcgttatctcccttgaaatcatgtctgtgacattttctttcacctcaaccttttcatgattcttgatgccttcaacttgaaatgatggttgcgatgattgctggaatggactgtttgacttcttatcagataacctagggcaaatcagcacatcagaagttattgtagtttccctgttgattggatgcacatcaaatttcaa

SEQ ID NO: 50640 - DNA, 17045 bp, Oryza sativa
gcatattcttgagttatgctgcctgagaaggcctccgccatatgattctacacaatttacaggataataccattcaacagattaacacttgcaaccaaatagaactgattgcacaagtaactagatgagcaggttaccttttgtgcagctaaatcatagtgggtagttctctgctgaacatgcaaggatttcagagacaatccttgagaatgtgaagtaggatgccacactccaaaagatccagaatgagaatctatgatggactgaacatgttgctgaatttctgggacttcatgcgatgccaattcgaacggtgaaacctgtgacaactggcatcctattagtgatggtgctttgaacggtggctgcggggttagctttgatgcaagtttgaatagagaatggggcactactttttctgtaggatctctttcaccagtactcttagcatgcccacactgagatagcaaacctggataagaagtaaacgtaaataattcagtaatcaccatgtacatgcgctaatcagtgaaagaagtttaccagttgccacaggatgcgttttcacagaattgctctgaatttcttgcatttgatcaatatcattctgaatattgcctgtgtttgttctagagtccatgccaggattgttggagcatgatgttgcctgatgtccatctgaaaatggcaacgaagttggatgccttgctccaacatgaggcacacaaggagatccctttccaatagtttcagacctgctatgatccacaatttttgacagtggatttcggcgccacacaatgcaccctatcaacgagtcttggtttgtatcagctgctgacatgcctttaaagaaaccacatttcgctaggattgtaattacagcatcacttctggggcagacatagagattggaaccatcacatacatctgcaaaaccaaccttctggctcgcttcaaagttctcggcaacctataccagtgtctcaaatgagttagatccaatgtccagaaaagtccgtagctgttatctcaaatgagttagatccaatgtccagaaaagtccatagctgttacagatcaaaatgtaattaagtgcttgtaatacctctttcattcccagtaagccagcttttgatgtcccaaacttccaacaaagagaaattacctatacatacaggtgttggaatattattagcaatgttacattaactggtacagttaccgtagaagacaaaatttacaaactctttctccattggttttaaattcataagcacacaaatgtaattaagcctaaaagaaagaacctcaaagcataattaagtgggatgaaccttttttagcgcaaaaggtagctaactgtgcatttgattagcaatgaacatagtggatatttacttcaagaatgaaaggaagataaattatcaaaggtttattaatatatcagcaaggattgatgagaaaacaagaaataatcttaccatcaaagatcgggtttgacatcgacggagttcctggacaaacttttcaaacacatctaatttcactctccctttgatttctatgattttcggccaagtaatgtcgtgatttttttctccgctaccaagaaaacaagcaaagacgtatttaacatgaaacaatgtataccctgtgaaaatattcatcattcacaaagataacttcgactcaagctaaatagagaaatataagaatgattattcataaaagtcagtcaactcagcacaagaactagcaacgtagttgaacaaaagtagcaactataatttctctagcaaaaaaatgatttatcaaccgcatagcatcagactagttgtgcttccaagcggcacaaacttagctctggcgtggttatcaagttttgtacaaaaacaatgagatacacaatttatatgcttccagaatccaataaaacttgttgaatatggtatttcagatttgtaaaaaatggatactcttactaactcctcaaagaggcacataagtcacagctaaataggaatttggtgaagttttctacctttttagtataaagtagcaagcaataatcaaatgtagattgtaaaaacgttcatggcttttgccaaggtaggatcagaaatcctatatttattagccttactatttgtctgaagctaagaataaaactaaatacgatcttactagggatgggatgatgtaataaaatgcaccatagagcacaaatatggacactatagaattatcattcttagtagacacgaaagtcaccttttgaagaaggcgatcacagacaccttgacagtgctactcaactggattgtaccatcacataggctttcataagcagaaggagatagcaggccaacaactgacatgatttcatcatccaaagaatgaggagacaatatactagaactatcatctgcttttgtagaaccttgtacatcatgtttagcttcatagcttgatatcccttgcttctgttgaattttttcaagggaactctgagaagggtgaaccatagctacaatactctgatcacccttttcacagctgaaaagtaacttatgagccacagctgtctggctctgatctgttgaatctgcatacttagcacaactattactagactctattttagtgtgcattagttgaaaagtaatatgtggatgcataggtttgcttggtgttgtatgatttgtacactccatcaatagagagaacgattgagtagtatcctgacagtttgatgtgccattatttgttgaaatggtgtgcagtatggtttcatttggtttgcatgaactagttgtacatctaatgccactcagttctgtggttcctgacagaatatcttgaggagcaaaaccctgtgagttactcaaaatagagctcaacccagctggaccatttagaaatgattcttcaccttgatgactatctttagcactagtgactaacccagatccatgagaaaaggccctattagattcactgtagtgaacagagttcaaaaattttctttttcttggcgtataaacctgaaaaatcatgtcgggggaattactttggcccgacatcctttcctctggaacagaaatattatatggttgtttgttccacgctgttgcgaaggcagaattaaaggaatgaaatcaactgtagatgcagcactgcttccaacaatagcagaatgccagaatatgaagcctgccaaaaacacagtgaataggaaggcccagtcactgaaattggtataagagtgtgagaaaaagtgacatctttacaagcaagctaatctacatgtaaaccattccctcgcagttgctctggaaattcagatggttctatagggaacatcagttcactactgacaatccatgcagtgacagaagagcgcaaacactgcaaaactccacaaaattgatctcctttgcgtgtaagctgccacccaaacaagtaactaaaaattgcccatccgcaaggcagcattaactgaaggaactactagcgcaccactgatttgcagcatccaccacaaaaaccgcagttagccaatgaattccaacatgactactgagccagcatgcagccccttttttacactccatcctatgatcgtccaattttggagggatcaaaggggaaaaaatcgggataagactgaacattgggggggggggagaggaatggtatctcgattgatggaaaaggttcctgcgccaagattacaccctaccagcggcgaaaagaggccgctgccaccgccgcctccggtggctaaggggatccacaagctgaagcatgtccgagaaaaactcgcggcggagggatttgtggaggaggaggaggaggaggaggaagcacgagttcacctgggagagatgaagttgcgagggttttgggcgtcggaactcggaactgtccgatcgacgcggcgtcgagcaggcgagcggccgcagcctacaggaagcaaccgtcggagtcggacgacgaaaacactagcgcacgcgttagttttcacggaggatgcacacggaacattcggaagggtaaagggcagaagaactgcaggtgggaccacccaactttcctctttttcctttggactaacacaagtcacaagggacacaatgtatcccaccttcctaggaggagccaccaaccaccagtgtcatcttttatttatgtgtgctatattaaaacccatatgtatccaagtgtaaagtgtctatcacatttacacacacataagtatggtttctcatctatttaagcaaataagggatagagatctcaaattaaaaatctaggatcgtgaatcagaagtatttagtatgaatttaggtttgagagctaacaacatcataccctatcgaaaacaccaaaatcaacatacatagtacaaagcaaaccacaaatcaaacggtgttaataacaaatctaaagtaaatcgcaaatcaagtggtattaacaaaagatgtaaaaggagataaagggatttgcttaaacggcgacaagaaaaagtgagcaacaattgagtgatgagatagggttggcgtgaccgtggagggggcacgacggtaagaagattgcagggatcgtgtataactagatctacataccttgggaaggaaacatatgaggcgcttagctctccacaagactaccatccatgggaagcggcggagaccggagatagaagggataagatgcaagagtgagtgagtgagcaaagccaataaatagggaaaagggaagcactgaaggtgtaccctagccgactagccctatgccacctaatacaatgtttgcctatatgggccttagtgcataacaagtaggttgggcttatgagagaagatcaaatcgattgtttcttctaggcccaactatagtcatagtcaaatgaaacttgtggattgggcatacattgtgtactattattgccatagaaagttacgacactactttaaaagaggcttcatagctagcccatcacgatcagttcataatggattctcgcctaaatcattatgaattggcaatgttattgagtatcaccaccgatatgctctagctttgaaactacagtcgtgcaactgattcccgaaccattgccaattcgtcggaacttcgaatacttaacgactcagctctagttgctaggccacccgaatattgcaatgggcctgatgatatgggccaccaacggtaagactatccagatcgtcaatgattcacccctacggccaccgctagagcaccatcaaaactctaccagtaactaaaaaagggtgagctaaaaacctgtcatgaaagtgtctcactatttcttttttctctcatccttttttatgaaactggagagctcctatgttagatttaatttggcactggcccatttaaatcaactaaatcaaataaatctcaagactcatggaatgctaggagttatggtgtttaattcatcatggataattaggaggaaggtgtaccttttctgagaattattccaagaaatgattaacaaattggcaacatacgtcaattgtatctaattgatggttagttgatggtggtgtagtggaggatggttgatgacaataagttactctattccttttcctatcacatgagtctctttctcttcattttccttctatcctataaaaggagaatggatctgatttcccatgcgcgatagagaacatatactttcatccattttcactttcgttgctgataaggtgatcccattctgacaagtgcgtacacatgcgtgggagagcatgcctctgaaacccccatctcctgatcttgcacaggaggaggcgaattaggtttttggtgagcacatcgcgtgactcctcgccggtgttcatgaatgactacatcgactagactacttccttttcatcatggctagtggcgagaatgtaaacggctacggttatccttccgctacaactattgttgaagcaccgcatgttattttcctcttctattcttttctgttagttccgtttatatgcgcaaacgagttagatatgtttgtttcgatggtctacactaatagcatgcctatttcgtgtattcttcttgttgagagtagttcatctatggataacgatttcattgtttacatttacatcgctatggtttactctgtttatttctaaattaagtattacgatgtctgacatcctgtattggaagctagtaaattaacgtgcaattacattctcatggctattagccatgcaattgtttgattttctagatccatattcaattgagttagactctcaaggataaaattagcctatgtatctgttaacagtaaaatttggtaatcggcaaagacgtcatcggcttagaatcattatcggctgcagcatctcggaatcagccgatgggagttatcaagtcgtcaatagtcgggttcctgctatatttgattaaggaaatcaatctactaaaggaagcttatccctaagtgactgagtttaaagaggatgcggcatggcaatttatctattaattaggaatagtttgttagtttccttttatctttaggttagtttctttcttatccgacaaggacttgtatcaacccatgggtataaatatgtacacccggggtctatgtaatctatcctcacaatcaatacaattcggcgcatcgccaccttttaccttttctactttattttatcgtccggcgagacttggcatctgacgcggtgctgcatcggtgttcgatctccggcgaaagggtaagtccaatgttccgtcggcccaggcaattgtatcgtttacgtcggcgtcgttcaaggctgcatcagtacattcaacctcttggatcgctctggtttggatgatatatttgcctacctatttatcatatgtctctattaatctagtcttagcatatcaatttagctctatcggctgcttctcgttttagggtttctgccgatatcggctaaatcgcgttgctagattagattagctcagacatctaccaccctaaaaatcagtcaacggcttgattgtctagatattatgtttcttttcatacttggtgctgcatcagttaagtttgatctactaagtcatgcttaaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaaccctatcggcatcggctgctatcagcatcggctattatcggcatcggctggaactactccatcggcttgtcagccgatcggttgttttgatctactatttgcatatcttgtcagttacaggatcaaactgactggcacgctcgtatctcaccaatctttagacctgcactggagttaagcagatctctcaggctggtgtgttcgatttttttcatcagtatctagcatcgatccacatcagggccatcctagttacatctacatgattcatttaataacctccttaattgatgctaccataatggttttattttggtactaatcaaaacacacttttgaacaaacttgagaggataagcgttggaatcggtacaatatttagagtatatttgccacagcttcagctctatcaaacggttatgcttcacttaaaaaggaagtggatgaactgattagagttctatcacaaaataaattaaagaaatgaagtaaagtttaagctacttcatagctctattctatactcaactcctgaagttaattaaatttataagagatggagttttaccgaacatgcagtactctcttagctagaaatatgtggcgtatccgcatagactgggctgggatagagaacaaggcctagttggttttgggctagaattttgacgagcctttttcacaaaaaagagaacttttgatggaccatcaggcatcagcccgagccccaaactgggccaggcaccatcagtcatcatctctctcggtctcggatagcggggatgcgctttgcgtaaccacgtaacgcgcgcacgtacacggcacggtacccccactccctggccaccactgcttcgcctcgacgagatccatacctcccgggctcccggacgcgcgcgtgctagctcgctcgccgatcgatccatcgtctccacgtacggccgcgcgaaggcacgtagtgaggtacgtgaggcagcagcagcagcaagcatggcgggtgcggcgtcgccggaccacctgttcggccttcgcaacagcttctacgtcggcgcgtaccaggccgtcatcaccggcgtccaggccatccccgcgcgcgctgccctctcccccgacgccctcgccgagcgcgactccctcctctaccgctcctacatcgccatcggctcccaccaggtacgtacgcatcgcgtgcacgtgtccatcgatcgattgatcacgccctgtgtgttggatgagaaaattggcgtaatatcatcgtcaaacagggtttcgctcaaatactactaagcagttggaattcgtcgctgaaacaccattttcttccaattctctctttcctcttattttttctgaccaaaatacccctagttgaattaattaattttactaggggtattttttttaagtaattatgagaggaaagagagaattcgaagaaaatgacatgagcgaagcccctcaattgataatggtatttcggcgaatctcaactgcatagtggtatttgggcgaaaatcctttttgacaatggtaaaatgacaattttctcgtgttggatgacctagctgatcgactcgtcgagcggttggtttctcgtgtgaaatgcagctggtgatcgacgagatcgggccgggcgcggccacgccgctccaggccgtcaggttgctcacggtgtatctctccggcggcgccggcggcaaggttactcctgttgttgtttcatccgcgcgtgcatttcaatttggatccaattaattaccgcgctatatatctcattgtgcgttttgtaatcaatctctgtgtaattaaggaatccgcgatcaggaagctgaacgagctcctggcagatgatgcggtggggagcaacccgattctccggctggttgcagggacggttctcatgcacgagcgggactatgccggagcactgaagcacacaaattctggtgggactatggaattgtaaggatcatccaaccttccatgtaacttttgatccattctgcacagtatcttatttttaccccatgtgttgttccatgattgatacgattgcctgctcgcataagaattatatatagctgaagatttccatgccatcagagaattactgcatgttatgttttaccattgggaagactgaagtcactgaaccgattcacgtctggtgtttttcaggcttgcgatgaatgttcagatatgcctccagatgcacaggtctgatcacgcagagaaacagctgaggataatgcagcaattggacgaagaccacacactgacgcagctcgcaaacgcatgggtagaccttgtcatggtaggaatactatgggttgttacttgagagttgtttatgatgataaatcaaagaggcaggagagaaatctgagttctactgcttcccattgcttctgattctataccagggcgggtccaagatccaagaagcgcacctcatcttccaggacttgtcagagaagtacccagcaacttgcttaattcttaatggtaaagcactgtgcctgatgcacatgggtaactttgaagatgcagagggattgctgctggaatcactgaacaaggtcagttctaatgatgtttttagatcaaaagttctaatgatgttaacctgtccatctgagcatttgctctagataatctacttctcaaacagagtgttagtgcttaacaaaaaatggtcaaactgttcaggatgccaaggatgcagaaactctagccaacctcgttgtgtgcagtctgaacctaggaaagtctgcatcccgctacctgaagtaagtgggttctacactgttatattttcattttgaaggccatttcctaatgccttgtcttatttctgcctgataagtcaagatgtcaaggctctaataattgttatatttctgtacaatttgagcgcttaatctgaactgtaattctgataaccgttgcagccaactgaagctggcacacccagaccatatgctggttaagcgaatgtcctctgctgaagacagtttcgacagagcctgccaagcgatatcatgatttctgcagtgctgttacttactttgctgttagataaaccaaaagcaatgcaacactctgatcttgtcatgacctagacaagctaatttttgttcattagcagttcatgaacaatcaacagaagtactacactttgtcaataaattggtacgagtacatcagtatctttactgaataaaattacggagtacggagtactatctcttgatgcattggcagctgttgttaaactaaatgaattggcagctgttgttaaacaacaatttcggaaataaatgcagacgtagtacaaatacatgctgttttccggacaagacagcatgtgagctctgaatctaacatgtgagagtgccaccataccaacaaaccacgattattatataggactaggagtactaaatttaatttcttagcaagagtcagatgtatctgccagcaaaacaatggataagaggagtacgaaatctagtgacgtgttacttaaaaggacacctaatcataaggatcaacgacagagacagaggttagtggtggaagaaagaatccgagagaggaagagacaagagtccagcttacactccatcgaccaccgtagctcagatctattccaaacagcgatcgacacagtcagtgcaaaacttttgctaaacttaaaaaaaaagagaatattttaaaaaaattgagagagaaaatttgctaacgctggaggaagttcttgtcaagaggcgtttcagttcagctcttcttcggagcggcgtgctgccatctccctaccgtttctgaactcaacttcccaaacggcccagcgcctgctatcgcagtcacatacatgtggggcccattttcgcttgggcccagtggcagtgacccgcagataaaaatctcgcgatccattccacccggaattttatgacgttaaaccccacgtccccaccaaaccaccaccactctcctcggcttgtgtcgcgtgtgtggcgcggcggcggcggcggcggcggagctgagcggccgcggcgatggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggccgctcccagtccaacaccacctcccaggtggccctcgtcggcgtcggcgtgtgccccatcgagagcctcgactacgagtacggcgcccccctcacttttcccttcccaattcgaggcgcgcgattcgctcgctcggttttccatttgcgatttgactccatggaaaacgcggtgttcgtgggggtgctgcaggttgatcgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcaggtaagcagcggttgcagagtggtttctacttcagagttcagactaggttggattcagtttgagtaactgatggactttacttctcgtgttgtctgtgttgactcaaaattgatttgatcagatacgggacagcgtttgcggtgttcctggtttcgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaaggtagactactgttatatctctttcattcaagttatttcatcacagagtactggtaattcttgacacttattagttgtccctgtgatttttttttccaagaagaagttgtctctgtgattgatttgtggcaaacatatatctagtcttttgttccattctgtttttgttcaacatcattggagacgatttaaataagttgaaaatgttggtctgttagacatgatcaggtttgtatgggctaagaaatcatgtatatataactacgaataatatgcatggaagagttaggaaatacacattgtttggtctctggcaggacatcagtgtctgtgtctgtggtacaacttgtttgttattcattttggagcagctctattgactgttggacatgtatatatagtttgcgatgtaactctatgttcacttcaaaagcagaatttagaacctggcaattagtattgagttctgtgtcatctggagattttccccgttccttctctcttgaccaattgtcatctcggtgaagcatgactctttgtttgctttctttagttttccatctcagacaaatgcagggcaatctttttcattttaatttctgatgtttttaagggaaacaaagaatgcatttagaagaattggggtatgaaaccttttagtttttggattagttctgatgtattgacataacctttgcataagaaagatcatgcctatcttattctgcttgaatgtcggggttcaatttggagatgctaaaacgattctgaatgattggttttactcaaagtgaacatgactgcccaaccactctagggcaatggtagctagaaaatatgttctctgacttatacataagtgataaattgttatgcaagaaaaacaccattgttcccttccgttgatatatctggatttcatatatactgttttttggacagattgtgggttgcattgctgcagtatcatcatcattgcatgtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggtggagtcctgtttgctcttgaagcagtgtcttcatggtaacaactttgaatatgcatgtgaaaactccttgttcttttctgttactaattaaaatgtgaaccacacaatttctgcaagacgataccattcatatacagtgttttgtttacaataccattagctccttttttgctttctttgcaggtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaaggttcttcgtctctacaattttattaacgagtatgtactgctgttggcttaatgttaatgatcttcacttctgtaattttaaactgcaggcgtttcatatttccatttcccaaagctttagctgacatgcacacattacttccctgtactttattaaaactgtttttaaaaaatggcaaagtacacctactggcatattgcagttatctgttagacttgcgcatcctttttgaagtgaaatatatccctaaaataacttgccatgtaacctcttcagcttactttcaggaaagggcaaaagtacaagctgctcctggctgcagtagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaagatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaaggttagtgatactattcacaaatatatttttttgtcggattcttcttcattctactttttatttcctttgctttgtctagataggtctagctattttgcaatcgtcagtgtctattaccttttagaaatgcctttttagaaccaaagggtgataggctgatagcattggcacccctgtttcacttttatattggcaaatgttgcttccaagttccaaccatgaccgttgctaagacaaaccaagatgattagtggcaaaaatctctaaatagccatacatattcttcttggttactagcagcattatcgctttcattgctcatgacagtatttgaaattataaaactttctaataattaacagtgataaatctttgactggttaattcctatcaatgcagagagcgcctgttgtaggcatactgacaaggcacgacttcatgcctgagcatatattgggtcttcatcctttcctcttcaagactagatggaagaaggtgcggtttggcaagtcagcattcaccaacctcgtcttctgacgctcgctagtaactgatgagtttgctcaaggatgcactgctgctgtaaattccatcttgatgctgggagctgcacagtataatcttatatgatgaagaccacaaaaaaatgtagtagattctccagcctgggaatctagcagctaattgtactgcattttcttttcttttctttttttgttacgattgtaccgagtggtaccatattcagaatgttcaagctacaatggacagtgcaagtaggaaatctttttttgtaaatgtaaatcttgtttggaacgtacaaattttgttagtcgaaatgagtttaatcgaaactataaagatgcatgatatataagaataatcatcattccataacttctcgtaactgcatcacaaactttcgttttggcgttgggctatcgctgggtggggtcgacgagtccgaaaaggctaggggcgtcgggaagaggcggcggcgtcgggcccatgaccgaatgggccagctgaaatttataccgggcttttttgttgggctttcgggccggctattcacatcggcccacaagcagccgcggcgtcggtgggagcctacaagtactccctcctaacatgtgaattcgtctaggacagtgacacggtctccaaaatataattttaacttcttatttctataaaaatatttattgaaaagtgatatatgtatacttttatgaaagtatttttcaagacaaatatattcatataatttttacattttcaaactcaataacttgagagttatttatgatttatattctcaaggtttgacttaaatattattctaaacgactttttttttttttgagtatagagggagtacaagcctactgtatgaccatgtccagttgattacgcgaaattaattactcgtatttcaccggcgtgtttgtaaagtgattacggcagcttttatgagaaaaaccagcaatttgcaattagatataacgaatacgtattaaaataagttcacaaaaacaaaacaaaaaattccactcaccggccgaatcgtgtggtataggtgcagccaacgtgtgcccggagcataaaacgcacggctcgaatgggaaccgattcg

SEQ ID NO: 50641 - DNA, 17997 bp, Oryza sativa
acaactggtcgcttttgtcgagatctcttcctcccccgttccgttttttttctctctcttttcaaactccgccccctcctctcctctttctctcccacatcagcagcagcggcggcggcggcggcagagcgaagagctccacttgtacgcacgggaatccaatccgctcgaagccctcgcgccgtggagtgcgtgccggccgggcaggggcagtgcggaggcccgcgcgcgggtagctggcgcctggcgctgcggcttttagcatctggtgctttgcgcgttcgctggaagctttgcggccaccgcggccagatgcggttgattgtgttgtagtggttgggtttttttgggttggaacgccgagtcgccgaggaggaggaggaggaggaggggaaggggaatggggttcctggtggggttggtgctggggatcgcggcgggcgtggctctcatagtgggcttcgcccgcgccgagaactcccgcgccgcccgccgccggcagctggtaagttatactactaattgcctagcccctctctttctccgtaataaatttgatttgtgtgatgtttagattggagcggtagcttcgaagttgataggagattaattgcgttgtttgtgaatcgagtggaaggcgaatcgcttaccttctaccgattgattgcgttgagctggatggtccctgcgttaggtagaggcgctgcactccccatgtcgactgcttttccattggagcgtatgactagtcaaaatggaaacatgttttgggcttattgagctttcaatttacgaacatgatgatgcggtttgctacaaacaaagtttgttggagttggaaagcactcatgttagggggctcaagttgcagcggaggcctcaaattgtgggggcaagtgcaagcgcttctaataaacaacctagcatgcatagtgcaatgttgggctagaaggccggtgttcatttgatccgtgttgccactattctatttgatgcctattcttgtgccatggctgctggcatgctaaaattcatggctgctccctgctactgactcactgcgcttatggcattttgtttaggccagttgtccatatatgattgcttgcatgctactctgtaaatttagatagctttgatctctgatctttttcctcctgattaataaatgaaactaaaaggggattctccttgtttgtttggacaggctgccacaattgctagtttctccaagatgactattgaagattcacggaagttactcccagctgacctgtacccttcctgggttgttttctcaacacagcaaaaggtatttgacagtatttagttagctctcaattttcatgcttacacactagatgtgaatgagagtatatgctaatgggggcaattttgcagttaaaatggctcaatcaagagctgataaaaatatggccatttgtgaacgcggtatgcattcctttccatgggagactagaattaggatttgacttcttttacaaatatgcttttcttcaatgtcttcttctcttgtcaattgttgtcgcaggcagcatcagaactgatcaaaacctccgtggagcctgttcttgaacaatatcgaccaataatcttagcttctctcaagttctcaaaactcactcttggtactgttgcaccacagtttactggtaagaagctattatatatcattgactgtttctcattatattcttgacagcactgagctatattgttctgctttctctactgtatttttgttagacaaagtaaatcaacttaattttgcatgcattaaccaagagtacaatgactgaatagctgacaataaccaccgctgtctggtgtcagcagcttgtggatattagattgtacatggtgtttgatgaaatgttcagaatcatgaaaacttaaaagggttttgatttttgtggttgcaagcgtgagccctgtgtttagatgaataatagtgtgtaattcattattaagaattgcatcctttggaaaatgatgccgtgtatgtattctttaaacaatactaatttatgctaatgtacttattttatgaggagtttaatgcgctcgcttcattatgttgtttgttttttttagaatggttttaattctttttcttttctacctaatgacaccaaatatttggtatacattttatattttgctaccatattagatttttctgttggttttggtgcaggtgtttcgatcattgagaatgacgaatcaggcattgtcatggaactagagatgaattgggatgccaatccaagtatcatactagacgtaaaaactagacttggcgtgtcacttccaatacaggtgatttatttcatgttgcttgttgtcctgtgttatgaatactgacgaggaggcactgaggcatttacatagtgaactagacctagttcacaaggtttgacagtaggctttgtctattggaacactgaattggtgttcttgataactaatgattaagtggacagttctggcaaaaaagaacatgaattcaagttgcaactaactttggtgcagttgatcttagttaataatccaattttgtgggggtatgtaattcttcatgcagtttttatgtgacatcatgagtagtgtgatggtctgattggatagtgatactgtagatattatctttttattataattgtgctatgtatttcatacacttaaattaattattctttctataataatcttgtgagtgccttttgccatataggtgaaagatattggctttacaggagttttccgcttgatcttcaagccacttgttgatcagttgccctgctttggagcagtttgcttttctctacgaaagaaggttccttttcttggtcgtgttttttattaaaaaaaaatctggttgaaggtattttctcattaatctgatatttttttctcaaatcacttcagaaaaagctggatttcagactgaaggtcattggtggtgaaatttctgctatacctgggatttcggatgctcttgaggtttgaccatacttctctgttttgttgctataaaagtttagtttgcatttcctacagtcaagatggtgactggaacatctcgtgttacaggacacaataaaaaatgctatagaagactcaataacatggcctgtaaggaaagtcattcctataatacctggggactacaggtaattactggtgatttctggggacatactagttttattctcttgactgaataatatcattgtcattacttactatatcaacatatgaatacaaaaatggataaatcccataaattattgtgtgcaacagtgatttggaactaaagcctgttggtacattggaagtcaagctagtacaagcgagggatttgacgaacaaagatctgataggaaaatctgacccttttgcaattgtgtatgtacgacccttgccagataaaatgaagagaagtaaaacaattgtaagtatcagctactctattccctgtttatgtgctccaatagatatgtatattttttaatgcatactgacagctgtttatgtgcttcaaatttacagaacaacgacttgaaccctatctggaatgaacactttgagtttattgttgaagatgcagatactcagactgtgacagtgaagatttatgatgatgatggtattcaggaatctgaattgattggctgtgctcaagttactctgaaggatctacagccaggcaaagtgaaggatgtctggttgaagcttgtaaaagacttggagattcaaagggaccggaaagatcggggtcaggtgagccctgttttcttggcagtgccactctccattttctgtttctctaacacagtaaaatagctcgatcttcttatattgttattcatccagggttgtaaatacatagtatttctcttgtttgaatatcacctcaacaggtgcatcttgagctactctactgcccatttgacatgaaggaggagactccaaatccttttagacagcagttttctatgacatccttggagaggacaatgacgagcatggaaaatgggtcagggagcaatggttttaacaggttgtcttccaggaagaaaaaagaaatcattatgcggggagttttgtcagtaactgtgatatctggggaagatctgccagcaatggatatgaatggaaagtctgacccatatgttgtactttcactcaagaaatcaaaaaccaagtacaagacaagggtaatttattcatcatatatggacaaactactggtcacaaataaccattacatactcctaacagttattagtattacgctatatttaacataattgctcctatcatgtgtctgaccgcaggttgtgagcgaaagcttgaatccagtttggaaccaaacttttgattttgttgtcgaagatggtttacatgatatgcttatgttggaagtatatgatcatgatacttttagtagagtaagttcaattgaagtttttatctcattactggacgagtggcttgttcaactgcagacgtttgtgataacgactgacaccaaggcactgaatatgtttctgtaggattacatgggacggtgcatcctaacattaacgaaggtcttgatcgaagaagattacaaggacagcttcaaactggagggagcaaagtccgggaaactgaacttgcatctgaagtggtcgccgcaaccaatcttccgtgattcgcgagaagaggacagcttaagattcagatgagttttgtatgcgcggagagtcatagatgcgtgtgggcatctggtttctgcgggccggatgtgatgagggtttcctcctgaaaacctgatgagttcagtcatctcttttttgcggtgcaatttgatcatccgctgcacatatacatggaagaagagttatggtgttgatcagctagcttataatgtaattgtcaaacaacatttatgtgtttacttgcaatgtatgctcaaagcacatttatgtacatgtgaaaaatatataatttgagctgttggagtgagctgttgaagacaattgaaggtgtcatattttttagtgtaaaacttgttatcttcatatactagttacctctaaattttttatagattaaaatacatggccggtccttaaacttgtggagcgatctcactcagatccgtaaacttaaaaaatacacgtttaggtccatgatctcgttttaatgtaccatcctaggtccaatccgcgcgtgacagcgtctgaccgccaacgtggcgtgccacgcaggcagtatatttgcattctcccccctccgcaaaatgtaggcattaatatcatccctaaacaccaccatgtgacgaaacgatccataacaaagtagtcttcaaatgtgaaatatgcagtaccattgtgtggaattacagatagcgcagtagcaaactagcagcctcggaggcttgatttaaaatgcagcaaagaatgttgatcgaagatagctcaagtgcctttgattaaaacaacatgacagactacattgttgatttagtagttgctcacacttctgtagaacattctgtagaacaaaaccaactcggaatttcaataagaaaccaaaaaacaagacgattcatattgctttgctgtcttacagggtctgtgtcaggttccagaaatcatctctcttaggccaggaataagaatagtatcaaacagtgatgttattagatgacatttcaagcctggcaagcacattttttgacagaaacaaacacagtccatggttcaaattcagtacatgacaaacacagccccgtcgacgcgcctcgcggagcccagcgccacgccgccacgaaccagagccctgccgcccccgccgcgccgacgcccctcgcggaggcgcgcggcgcgccgcctatcccggagccccgccgcccccgccgcgtcgacgcccctcgtggagcccagctccgcgccgcctctcccggagtcgtcgaggtcgccctctctccctgggaagtggacagagggcatttaggtttggggatttttggggatttaggtttgcgacagagggatttaggaggggggagaatgcaaatgtactgcagtcagacctggtcaagcgcggattgaacctgagatggtacattaaaacgagatcgtggatctaaacatgcattctctaagtttacagatataagtaagaccgctctacatgtactttcttttaggatcgtaaaatttctgaagaaatagcatacaggaaatctgtgaatgctgtcgtcagacgtaagaactaacgacataagacgaacccattgtgtacgccgcctcatcgtgttactcccgtcatgccgattcggcatgaaaaaaatctgcagcatagatccgtgcctccaacgagaatcatgcacgaaacatgaaaatctccaacgaagacatcgttgtagtaccaagcatggagtattctgtaacatttctgaaactctgaaagctacggctgatataaaatatgcaggagtaaagatttctaggtcaggacacgagccgcacgagcatcccggggtttcctaccttgggcagattcgcttcaggtttggacgataccaacagagcatcatcgtgtgcttcatccagcgcccaataaaaccaagctccgagccccacgggtagaggcacgctcctcccggctaaaaaaatcaggcacaaaacatatgcttctttcttttttgttttgttaatcacgcagatgattctcttcacctggctttgttaattgatcagtaatgcgcacgacgtcgcaatctggtaaagctttgacagcattcatgatcccagccagctttaacaatggcacataatggaaaagacgtgcttcttaagggaatcgaattacagaattaataccatcagatttagatacccaaattaaggtggtccttttcttatattttacctcaggctagctatttgctagctatgcctaaatgtactaacttattatttttatgcgtcaaatctgattttgtcatgatgcaagcgacatcgttatgtttcttgcttttaataacatctgaatcgacgggctttgtatttttcttatgaatcacagcttgttaaacagtataatgtggtactctagtgtcacgccgattgaaccagcacatctgcctgccccgtactaatatgacatatcggcatgcgtacatacatgctatacagactgttcatcgtctgtcaattgcttgcaccctttagagatagatagcagtagcaggtgtatttttgtttcgaagtctacaagctgccacacgtattagtgaagcagtttccggcacaaaaacaacttttagcttgtgtctatatgtgtttaactttaacccatcaatctactggactcttcctggctttgttgtcatctactccaaccggagtgacaccttgctggtagtacacaaatcgcagtactgacaatgtgatactagctagcttgaggtgtccagaaatattccagactgcgtatatgcgtgtaggaaaccaaaactgtactgcgtctcgatctcaggctcatgcagtccacgttttcaatccatccaggtatgttcacgctaaaattaaaagtttggttcaaattgaaacgatgtgatggaaaagttaggagtttgtgtgtgtaaaaaagttttgatgtgatggaaaagttaaaaatttaaagaaaaattttggatccaaactcggcccaacttaccatcaggcaagtccttcggtaattgatttccaaggagaaatcgcccgaaggtctcaagagctagagaggacaatttcacgatggacgtcagtcagttaaccatcgacaacgcaccacattctctgaacatggcaagcaattttacgccctactgaaattccactgaggtaccaacgggggtaggatctctgacttcttctcatgttcacctccgtccatgtcccaatcgggtctgaatgatttctccaggctaataattaacctcaccatggatatcctatcaccaaactgaattatcacgttagctaagaaacctactatgaccaagagaacgtgctccgaatcacaaaagaactctacacaaaccatataaccgtcctaaaatatagcactatattatcaatattttttaatgtagattcgtagtgctatactgcgttaaactctggttttatattgttacattttgttgctagacgcactgacaaacagaaggagagaatagtggccagaagcgtcagagctaggcgcctcggatcggccggtgaatcgaacagctccggccctggcttagccgtgagccatctggccttccctcctctcctgccgctgcaggagacagacagagagagagagagagagaggtgagccctcgcgtcacgtaccccacagccgcgcttgtcgccgtgctccgctctctcgtgaccgtcgaatggtagccgctactgcaatgcaacctgtgcagcagcctgtatcacacagcttttcttttgttgtcattagtcattaccaagccagagttttctttctgtacttggggtggagtaagctgagccgttgattgagccgtgcaggacaccggaaagcgtgatacgtagcgtgttggtttggaccccacctgtccgcgacacgaaacgtggggccccgtgcggcggacgctatcggtggtgaggcaggagaacgagaggccgggatcgcacgaaaatccgtgggtttcagatgagcgccctcgcacgccgcacatcctatatcctctccctctcctccccaaccccaacctcgcgcttcactttccaacgagcgaagccgtcgtcgaggcgtccgtctcctcctcctccttctcctactgctgctgctgctgcttaaacccctcagggctccgggccgacgctccatttgtggctgttgggtttggagcttcaggcgcaatggcccccaagggcgccagccgtggcaagggcaggggcggcggcggcggcggcaaaggcgacaagaggaagaaggaagagaaaggtattgtgtagtacatgttgctggaagctcgataccgcttgagctctgcaaaggcatagagttcacttcatggcatgaagctgtgtagctgttgcagtgtgaggagctttgttcttgcgaacattgaattcgctgctgctgctgctgcagctgtaatctgtgtgtgtatgctgttcaggacatgggttcttttgcatgggtaaagggtgaaaaaaagacgatggtctctctgctattagtagcggtaatcttttctttattccttcttttgcttttgtttctcttccttttttcttgcctattcgtactcctgatttcggtgattatattgctgtttaagcgcttttttcttggtgtttagcttcgtgttctgtgctcatgattattactactagtcttttgtcttttttttttttgcaccttctcttgttccattaatccttttcgttcgcttccaagcaacatggcccgattctttccttggtgtaacgcacaccgtcgtgcggttgagtcatgcgttctgcgagctctagatgaatactctgttttcactttcacctcgacatgatgtcgccgtctccgtttttaaggtttttttctgcagctgttggtatgatgctgggttcttcttgtttttgcagttgtgccgagtgccatagacgtcacggttgtcactccctatgaatcccaggttacactcaaggtatgtgtggctgcattagctggctggtacttgctgcacacatgaacacacaaaatacctgaaaggacaatggacaggacaagcaaaagtgaacagaaactggtatctttgggaaaagggggcctaattctgataactgaaatgtctgcagctatttgcaatgagctgcaaagccagttattacttactccacactgcatgctcacaatgagtccgggaaattgagcctttgaaatggaacagtgaacctgagtgaaaagattaatcttgtttttgttctgtgtgtgttcaggggatatctacggaccgtgttctggacgtgaggaagctgctgggctcgaatgtggagacgtgccacctgacaaactactcgctctcgcacgtggtaatgcttgcttcttgtctgctaattcaatcaattgcagtgcttgcagtatctactgataattcaattgcagtgctagtactagcatctatcattccactcttaagtcaaagtgttaattactacttaattatctgccacttctttgctactcttctggaattcacccgggattaatttgaggacagtaacttttaatgtatgtgtgctgcaatgctgttaattctgtaactaattctgtataagctgtgttcggtgaagtctgaatttgtgaagcgtgtgatgtatgacgcagacgcgagggcagcggctggaggacggcgtggaaatcgtgtcgctgaaaccatgctctctcaccatcgtggaaggtacggtccatggtgaaagaatccgcacgctagctgctcttcacttgttcttccttgctcgttttgtttctttctcctttctttttttttcgcttggcaacatggaatgcttcacataacatgatcgaggtggggtagctggcattaggacacataattagttggatgcttaagtagacgaagcaacctgacgagaggacaaaattaagcttgagcttgtggtgtaccgtgtggcacaatctgttagcatgacagtgttatgctacagtccaagtgtccaaacagtctgccatcaatgattaatcaaccaacggtccggatttttccactgaaagctctaaagtctgacgctaatattgctaatattagggaagaacctaatatcaaataattagaaggggtgaggcttcaaatctaggtcgtctagtccaccatcttgtggagctagctggaagacccctaagtgtttctcataagctctaaagtctgaacatgcgtttgccgttgtccgatggtgaagctagtggtttttgttaatgttgactcaccggtagatcatatcaaacctaacttcaaaaatcataatctattcaaattgggacggcacaatgcacatagatgcagccttgtttgtcgacgcacagcattgaatcgaagagcatggaccgcgccggcctttcggctgaataaacttcagaagaaaaaaacacacacatatgactagatcactagattcgcatgctaaggtgcaacctcccacgactccttgtaaatgcagtcatgcgcctccatcacgccccaatactggcacaccagtgagttagataggagcacagagtacaatctagttcattatacttcataattcttgccacttagacagcgagacgtgcaggcaggcagcagcagcagctttgcatagtgcctccagtttcagacattagaagcagcgcatcctgtttcagacacttagcataaaattgtttagaccaaaaaaaatgtgatttacatctcgggtctctaccgttatcctcagatactagcagcaaatggtagccggtttcagtgccgcatctgtagccgatgggagatatagatcgtggccgtgacgtcgtcgcgcgatctgcctctccgcggttggttggggcggggcggctaaggtgttttttccacacacacacacatgtcccgtctctttcgctgccgatgtcgcatttgccgtcgccgcgcgaacgtttcacggcggctttgccagtttccgggaggaaggaggcggcggttgaaccgaacctggacgcccccgcgcgcacgccggctaataagctgaggccctgtttagatgggactaaaacacttttaaaaacacttttaagttcctatcacatcggatgtgtactaattataaatattaaatgtaactattaataaaatctatccataatcttggactaattcgcgagacgaatctatttgagcctaattaatccatgattagcctatgtgatgctacagtaaatattctctaattatggattaattaggcttaaaaaatttgtctcgcgaattagctttcatttatgtaattagttttgtaagtagtctatatttaatactctaaattagtgtctaaagatcagatatggactaaagttaagtccctggatccaaacactcgctgacggatgccggtgatgtttcgtatggttttttttcaacgaaacgtgtggcagcgatggtcgtggcatgcgaccatgtgtctgtgtcgacgacgaaaacgagcatagaacttaacgattgattagtgcgtaagactgtacgaggaaggggatgactgaccgattggtctgacacgcgctcgtagtcaaatgcacttgcttttactgctaccgtagtccatcattttaaaaaaaaaaacctgaaattcaagtgcaaagtggcatttggacaaactggaagggcattttcactcgttgatagcgcttgattagttgcctaggcgaagtccgtcttgtgcacttctctagtgggtcagagcctcttgttctgctttgggaaatacatgctcgttaattaactgaacatagtgctccacctgctgtctgtctcatatggtatttagaactgaaagctatactagtgtacaattaattactgcagaattatgcgattttgtagttgttgtatgctccaaggtctgagctaatggctcaccggttgttgtcctgtcctaaacgccggtacgggacaaaaggacgcctcttggaatcagcgttgggcgttagctcaagtgcctaacttattttactcgccactcttctgacgaatcgacgggtttgtgaattgtgattgtacatttgtttgtagtattggtgtttaggtggtcactgactcatactggtcagtacagtacgtgctagacctgctaccggtcgtaccgatgccatgagtcaaaatcacgttgttggccatgtgtttctaactcgctgacaccgctgggaacgtgatagaatagcgacatagcggtgatagtacttactactatgacacgagtatcaaaacttcagccacgttcctgtggatgaacatcagtcttaagccattttttttttatttttacatttgaattcgatttattctattttgatttgattcgacgacttttgttcaatatgatgcagcagctgctaaaaaaacaaaagaaattgcttcgcttatttgttccagaattgatgggcctgttcatttataaagggaagcccagcacttggcctattgggcctgaattttggtagagctaatcgagcccatgggcctttttgtgcagaggagtacgcgacggaggcggcggcggcggcgcaagtccggcggctgctggacatcgtcgcctgcaccaccgcgttcgtgaacaagccccgcgacggcgccaagcacaagtcgtccaagcacgcgcgcccggcgacgccgccgtcaccgcccgcgctcgccgcctcccccgacgcccatggcgccggcgccgcccaggcgccgccgatatcggaggcgcacgacatggcggccatccgtccgccgcccaggctgggcgagttctacgacttcctctccttcgcccacctcaccccgcccgtccactgtaaggccgaatgctgcatcgcgtttccccctttttgcgaggcgtggaactaggggttggactgacgcgtggttgcggtgtgcagttatcaggaggaaggagagcaatggcgcttctcaggaaggcgactacttcgaaatcgaggtgtgatgcgatgtctctcagaacgctagagagttcgtctgatctgcagtagccaactccgcgatgagtctatgactacgcacttcactgacgggagttgatgtgtggccaggtgaaagtttgcaatgggaagctcctgcacatcgttgcttccgtcaagggcttctattcggcagggaagccgcacaccgtgagccactccttggtggatctgttgcaacagctcagcagtgcatttgccaatgtgagtaaccatgaatcctgaacatgtataatgtataacgcgttgctcgatttactttctgctcctgtttgtttttggctaactatacagccgaccttatctgacagtgatgtcttctaattcattttgcacaggcatatgatgcactgatgaaagcttttctggatcacaacaaggtggttatagtaaatgctgtttcctttttttttttcccccttataccgtagatttagtcaagtaaaatgctaaatttgacaaggatacttctttgcatctccagtttgggaatctaccatacggatttcgtgcaaacacatggcttattcctcctatatacttggattctgctacaaagtgcccagcattaccagttgaggatgagaattggggtggaaacgggggtggcaatgggcgagatggaaagtatgacagaagacgatgggcaaaagaattttctactttggctagaatgccatgcaaaactgaggaagggagggtgatcagagaccggaaggcttttcttttacacaatctctttgtagatacagcaatttttagagctgcatcaacaatacagagactcattgatctgtctgggaactcaactagtcaacaagctggcctagatggttctttagcaatcgaggaacgtgttggtgacttgcttataactgtaaagagggatcaggctgatgctagtttaaagctggaggataaagttgatggagttgcactctatcaaaccggttctatggatatatcacaaagaaatcttctaaaaggtttaacttctgatgaaagtgtcgttgttaaggtggtggcatactactttcatatctctttttttttcaaattattttttgtccttaatattaattaccgatttccaccaacatgattaccattcaggacacctcaatactcggagtggttattgttaaacattgtggatatacagcaacagtgaaggtttcagggcgcacaaaggacggaaatggtggcaaacaaaccagtgatatctgtgatcatctcgatggaatttcgaatgttgatgtagatgatttgccagatggaggttctaatgccttgaacattaacaggtttgatatatgttcccatgtaaacttattcacatgcttgctcatcagtagagaaaataatgttcactggtaactagtttttcttacatttggcacacaataatgttccattaacacaactctctctctctctctctctctgtatatgtgtgtttcagtctaagaatatcactgccaaaaattgtcaactcagacatcgctagtactcagtgtcctactccgcagtctcatgttgataatcatgcaaggaaactagtgcgcaaaatacttgaagatagcttgatgaagctggagaacatgcctgccaataatcctagaaccatcagatgggaacttgggtcatcctggctgcaaaacttgcagaaaaaggattcgccggcatctgaggacaagaaaaatgcaggacatgttgaaaaagagacaactatcaaaggtcttggtaagcactttgaacagctaaagaaaattaaaaagaaagaatgccatgttgaaggtgctatgtctgagaaggaagactctgacagtaactgctctgtcataaatggcatggaagaatctgaaaacaccaaggagactgatattagcaagctgatgtcagaggatgatttctgtcgccttaaggatctgggagctggacttcatcaaaaggtaatttatagctatacagttcatcaatcaatatggtctgaacaatttagttttatgtccggtaagctcatacatgctattttgcttgggattaaagttctaatctgttaaaattttcaccagaagccttgtgttaagctgaatatgatgtagtagcagaagcgcagcattgtatttttccagtaatcaggaatatattggttattttgctgtttaatacttaactttgttatttcttgaactagtcccttgaagagctcactatgatggcccataaattctatgatgatactgcgcttccaaagctggtaagccttgccttgtttatttggagatccttatgtaaattctcgaacattttaatcggcactctcttctctgaaaacaaagtagtcgctttttgctggcattggtattgtttattgtttattgttgtagtaagtagtttagttatggtactaatgttcagttagttcatttgtaattttgaggaagtagtcaatccacattaacaattcgcaccacaaagtccaaaagaattacagttcttgaaaatttttgcgtgtaaagaagaaaaaaaaaacaatgttttttttatgttgtcttaaactttcttaattattatttgatgcccataatagatagttaattttttcttggaataaaataatgacaggtggctgattttgcttcccttgaactttctcctgtggatggaagaaccatgaccgatttcatgcacacaaggggtcttaatatgtgctccttaggccgtgtggtgagtttaaatttattctgaattacttttgcttctatggttggatggaatttccagaataaccttttttttatatataaattaaacaggtagagctcgcggagaagcttccacatatccagtcaatttgcatccatgaaatggtcattaggtcctttaagcacattgttcgagctgttattgcagctgttgatgacatgcaaaatatgtctgcagctattgctgagactttaaacattttacttggatgcccaagacttgaaagtggcactgaaacagatgcacatagtgaacataatttgagatttagatgggtagagaggttcctttctaaaaggtacaattggaaattgaaagatgaatttgcacacttgcggaaatttatcattctgagaggtctttgcagtaaggtacaatccaaagtgtgttccaaaacattcatagagtacagtttctgaacatgcataattaatatgtttatttctcaggttggacttgagttggttgcgagagattatgatatgaatagcccaaatccatttgacaaatctgacatagttaacattattcctgtatgcaaggtaggacactatcagaaaacttaccactgtactttccccaccacctgaattaataattatattgatttgatctgctttggccttgcgcttcttacagcatgtggtgtactcttctattgatggtcgaaacttattagaatcatcaaagatggctttggataaaggaaaacttgatgatgccgtcaacttcggaacaaaggtatgcaataatcagttcttttttctgtacgttgtttaacagctatgctaaaatatttctcttcctgctttggttgggtgaagttaccattctaaattctttcattaactatttttttttcttttcttgaaggcgttgtccaaaattgtagcagtttgtggtccataccatcggctgactgctaatgcgtacagtcttcttgctgtagttctttaccatactggagattttaatcaggtatttcaatgaatttggtgggctgtattctatctgctgcatagtgatgtgtttttggcacaatgtttggcaactgcatttttcactagacttctgttctttctctgtaggcaactatatatcagcagaaggcacttgatatcaatgaaagagagctaggtcttgaccacccagaaactatgaagagttacggggatttatctgtcttctactaccgtctccagcacatcgaaatggctctaaagtaagtgctgctattaggtgttttgttgtggaaacacaaaagctagtttcatgacttggcttgtagctggtattactatcatgcacaatgtcgttacgctggttcatttctagccattacatgcattaaatatattgcctgtagaatggatactactgcatttgtacggcactatggctgtattaatttgtagacttgaactgtgc

SEQ ID NO: 50642 - DNA, 10512 bp, Oryza sativa
cattgctgtccctcaaaggccatgagcaattgtttaagtttctttcaatttcctatccaacttgtttattgcatatccaatttcaaaactagcatcttgtttcagtagtacccgcgccaccatgacttgtatcttttaaggaaaggtttattttgatgtctagacccacagaaacagtcttttctgtatatttcaatccgtttgacataatgcatgtaactacggacaacttcaatggcgtatttgttatgcatatgatcccgtgattcagttaacatgaattttcatgcatttctttgaacaacagactgctgcgagctatcatgccatagccatagccctctcaatgatggatgcatactccttgagtgttcagcatgaacagaccaccttacagatacttcaggagaaactaggacaagatgaccttcgaactcaggttttttttcccttcaaaatatgcaatgacgagtccaaatactgctatgttctcttggactattagacatgataattttcctgctgcaggatgctgctgcatggcttgagtattttgagtcaaaagcattagaacaacaagaggccgcccgaaggggcatcccaaaacctgactcatctattgcaagcaaaggacatcttaggtatgaatacactgtgcattatcagtcgcaaactgtgatgatctggattgaaacatttatctttccagtgtatcagatctacttgactacataagcccggatcaggaaagaaaagagagggatacacaaagaaagggcaggcgtgcaaaggtgattataacatgcctactttttcaaaattattgttgttaaaatgtagtcagaagagataagtgcacactggacagtggagacaattccatcagtattcatgaaaagtctagatgagaataggattggcacaataacttccatataggatgtctggtatatgaactgatgaacatatgctggcagcaaatcagcaatcctatccagttcatgaaactagtaaaaggttatgaaccatcatcactgacataataaccatgacagttatccccaccagtcattgttggagcatgaactatgagaattgaaaagatattcccgcatccacagctagtccattgataccaggcatttatccagatgattccagttcaacccattaacttagcaatgaattgacaacacaatttcttcttagttgggaatttaactccctttacatatggatatttaatcctttgttttctaatatgcttcatgaattgggaatcacaatatacatattttggaagtccattgatgtcatggtttcaattgttgcctaaacattatgcaagcttttattttacccttactaccctttgctttccttttcaccttgtatagtattaaatgcagaataatatcagagcccatcaaggtgaattagttgaagaaaaggagagctttgagcacgacataggatctcctcatgaagcaaacaaagaggagtttcaacaagtaaaatcgaaggcacaccctccagcaatatcagaagaaaattatgctatccatgatgagctgaagcaagttgatcctttatcacctgaagaatattctgatgaagggtggcaagcagctaatttgcgtggacgatctgcaaatgtacggaagaaaagcagtcgcagaaggcccgctctcactaaattaatggttgatcgcttggaagatggccgcacaggttctgcttatagggctggtgtacaacaacacatgaaaggagataaagaagatgttataaactcttctagccagctctcctttggcagctttctaaaaactgacaaggtgaatgggaattccagcaatattgaaaataaggttttcaatgctatatctaaaccagaacgaggcataaagctttcaggaattaacagacctgctactatagcttccaagttggtatcatacaaagatgtagcagtgtcaccccctggcacagtcttgaaaccgattttggagcagaaggaagcaaaggagaaggataatgcacaaaatactgatctaatagtgtcatctgaggaggaagataagaagttaacagatgaagatgaagaaaaggaaaagccaagtcatgacagcagcaaagaggttctttcaagtgaaccagaggaaatcggcaatgatgaaaaagctccggacagcaacagtgatgaaagcccaactgaatctaagaaaaaaggtggaagcaagctttcagcttcagcgcctccattcaatcctggatcactcttatcgatgtcgcacccttacagtacagtggcaatatatgatgctagcgtcgttcttcagccaataccaagtcaaccaatggagattctccctcacgccattgatactagggtaccccgtggtcctcggtccacattgtactaccgtactgggcataccttccaaagaaaacagggttacgcacacagccagagcaccattctgaggggtagcaactcccccccaaccatgaatcctcatgctgccgagtttgtgcctggaaaaacttcgcaacaacctgatgtggctaacagagagcctagtgcagatgtttctgtaactgattcagcagatcaactgttggcaccacagacatcagatgaagtaaaggctggtatgcctgcagcagaacaagcaattcaaggtgagagcaccagcccatgcaaaggaaaggaaaacagagcgaaagatgccttgagaaactcatgcaaaacagagctggcaaggcagattttgttcagtttcatcgtcaagtcagtacatgatagcttaggttccactggagctgaatcggacagaaaaccaagtggaccagacgaatctggtaatgcacagagcagcaacaacataaacaagagtccgtcaggtcgcaaagagcttgacaaacagcagaaggccaccgtggtacctaagagtgagaaggatacagaaggatttacagtagtttcaaaacgtagaagaagcaagcagcactttgtgcatcccatacatggtctctattcccagcagtcaatttgcacttctgtcagctaaaggtcccggtagatctctttttgggagtcgccatattttggaagaaaggtatcgcttaattacttagcttagacgcttggtagcaaaagtcttaccctatccagatgatcgagagcatgtagtgaaactgtacaaagctttccgcaatgtcttttgtgtaataaattttgtaattttggggtagcagccgcatcagcgctgaataaaatatatttgtgtcatgtgtagttatatctgtgacagaatcatataggatatagcagcagatgtttcagtgtagagctcctttttattactctatccgtttcaaaatatagtgatttttagagtagacccggattttaggaaagtatatgaaattaaatgagaaaaaattgaacctgcaatattttgagataaattttaaatattataagtggctatattttttagatttagggagtagccgctattctttatgatgtgcactagccgaattgtctgccataaggacttgatgactgcaattactagtactaggagtaaactcaaagctgactcgagtcattttctatattgactttctctgcttaaactatgatcagctcagtgtggtgtggtctttggatgctttttcacagttaatttagcttccacggagcagagacggagcagagtcagcagcagaccagacgtgaattggtttacagttagtaagctgtagcaattgcacctgtaccactaccatactctcattctctttaactctcgttacgaggtcaactcggcagctagatggcagcagcagcatatgcatccattcacctcctggccaatagctagctcagccattagtccataaccccattacattactactctcctcctgcttcccttgcgtaccacggcccatgccgtgccatgcatggcacattatgcagcatgcgacgcattcatatcctcccgtcttgctcgcttcatccacctctgaatttctgcatcgtggatgcagcagaatcagagatacccccctgcatgctgccccttgctatgctacgcatgatgctgtattgctgtgccatgctagctataccagctgcaagcctgcactacagcttgcagagactttttatttatggcgttggagtcagattcagaagaggatcagaggacggcatggcattggcatggcatggtgcagcatgaacgtgtgtctgaagtctgaactcctaattaatagttgtagctagcatttcggagctgtgtagttaatttcatctactatagctatagctaagtcacgggattccggttgggacgacgacgcaacgcaagcaacgagagagatacatatacacactcctgtcctgaagccggccgggtctctgtactgattgatccatcagaagtgtgacaagaaatgtggtatttattgcaggttgtgcatgcacatcagagctagctttgggctctgcttcgcttgcctcccatggcggccccgccggtgtgtgtacgtgtgcacgcgtgggctcggacttacgcctgcttacgtgcgagatcagatacggatcagcttattcattcaaactggtctcctgattgtatgcgtttttcctgaataatggaaagtataacttccagcttttgtgttagtaagtagttaaccgttaatttttaactcttggatgctcctattacacatcgacttttgagagagaaaagttagggttttaatcctagttcgtgagttgagagaggagtgctttaggtgcactttgtaaacacatattgatacaataaagttgatataagtttcgtcgatacgtgttttctagatcccgacggattgatcgatagcaaggcggcggtctaaccagtgggagtacgacggtctaaccgaaggcagcgcggcggtatgactggacaggctacggcagttggatcggtggtgacaggacaacgtcaagatctccatcaatttgagggtaacttttttgggtttttggttttccctaccattcaccccctctatggtaggcttggttacttgtgttcgattctacatgtatcagcatcccctccatcccgcaatatatcactcaattttagctattagttgaagaattagtgataatggtaggtcgtaagagatattaatagtagtgttatacatccgactgaatcgccgaaccaatcatcacatagttcataagcatttatgtggacccagtcaaaacaagttaaaacctagtattatgtaaagtcgtatgtaggtcggacaggtgcagtcgtatatatagtcattccgagatattaaaggagtaatttttttaatttataaatcaagagtaggtaatgtagaaacgatttcttttcaataaagtttgagagttagaaataaagtctttctaggagggagtacgtgtatatatactaaccaagcccggcgaagaaaaatattttttttagataatggaataaaacatcccggcctttgctcatcagagttacagccaattattacaaaagtaacacccaaacactgagtgtagttcaaatgaattaaacacacccaacaaaataaaagatcaaactaaaataaggagagcacatttattcaagtctatttctgaatctccatccatagtttgcaaggagttgcatgaccgttgtctcaagcctacgacatgcaaccttcataagctctcgatcatcttcacacatttgcagctgtgcccaaaatcggagccaatatgttgccctgaaaattacctgcatatatgagatagatggtgatttgtaaaaaaccatatcattcctagtcaaccacagagcccaacatatggcagaagctcctacaagtatgagtttacccttcttcttgtctacccccaagagccaaccatcaaacatattatatatagtagtaggaaggtataaaccaagagagaactgtacatatgctgacaaataagcgagcactcttaaatcagaagtttgacaagtgtgattggttaacctggatggaccggtgactagtttgtggcttttttaatttgaaacactcagtacaatattttcatatatatttggtttaattcttttgaaattcctccctcgaaaggatacctaaaatgcaactaactcaatgatatgttggtatagcagtatagactacaatggattttaggccaactagtaatcattggatgtgtttagttcatgctaaaattgaaagtttaattgaaattggaatgacgtgatggaaaagttggaagtttgtgtgtgtaggaaagttttgatgtgatgaaaaagttagaaatttgaagaaaaagttgagaattaaacaagccattatccttaaatatacacttcaacatggtaaaagtattctctgttttttgtcacacaaaaccctaatcaatgcatcacgcatccgaaaccgtttattgttcatctgcagagcagcggcgtggcacccgtgactaaatatctttgcgttttttttcacatattttaattttatttgaatgttttatatgtgttccttgacaatttcatgggtccccacatgctagtgaccgcaaggtacgttacgtgtgtagcacatacacgttgctgtcgctgagaggagaatataaacttgacgttggcatccgattcccatccaactttttgtgaccaaacatgatcgcaagatcgcctgagtacgtttgatatgctcgaaacttacgctgaaactgcttgatttgaacagcatgatctgaataactattttctttctttttaaaagatgggcatgtgaaaagtacccaacttgtgtagctctcgcgagttgactagctcattacatgacaagatcgtgcagagaagaaagcattaactgctgttcatgaattgaagaacctcttcattctggctatgattcgcaacatgcatgttttgaagcttccatggaaacctagacaggttcacaggagtagcttgtactactacttttgattgaattgaaattaattaatgtagagatatgcagagagttgattaactgatcaagacctaatcataaccagcaatggatgttgcatggattgatatattgatcatctaattgattaatacagatagatagcttggtgctacaaaggattaattaagcatggcatcgccgggattaacaagataattaaggctgattaattaataaattaagatctggcaaaggaggagctcctgggggagtggacggggaacagcggcagcagcttgggcctctcgccgtcgccggcgccgccgctcctcggcgacgagtgcaggtagaaccccttggaggcgatggccttctcctccctctcctcctcctccttggttatcaccaccaccccgcacgacgacgacgacgccggcggcgacggcgacagcgaggacgacgacgacggcagcgaggacgacgacgacgaggaggaggaggccatcacgtaggcgtagtccatgggcgacaccggcgagtgcatcagcctgtggtggtggtggctgtagtacagcggctgcggccgcgcgagctccagcctcgccggcgccgcgcgccgcctctcctgcagcttcggcctcctcatcaccggcgccgccggcgccggcttgctgccgccgctccccggcgcgcccgtcagcttctgcacgagcgcccggaacgtcgccgggtcggcctgcacgaacgtcgtgttcgtgtccaccacgcagccggccgtggcaatcgccgccgcaggcgacgacgaactcaccaccaccgacctcggcgcatgagacgccgccgccatggccgcgccgtcgagctagctatcaaccaaccaaactctctacgaatcgagagagatgtatcaagctatcaacgagaggaagctagctctagctaagctctaggagtacacgcactacatgtgatggtgtgaagagaatggaagtagaatgggcgagcgaggtaagctttttaagggacagaaagggtggcattaaagcttcaaaacctttgcatctctttatcgatcgcatccatctatcactgctagctaacagtgtttgcatacatactcacgtacatgcatgctgctatggtcgacgtcgactactcacaaactcaactagcaacatgtacacacatccattcacatccatccatctatatctatctggcccagctacgtacggtacatgcaatgcaaagccatgaagcatcttttctccctgatcgatcgtccactggtccatcaggtattcaggtgaattgcaggtatatacttatgaacacacgatacggccgacgggttgctacggtgtcccttctttccatctcttcagggttcagactacttcagaaattagctcttcaggtttttaagcagctgggacgtcgtcagtactgcagtacagtgacaatgtgtacagattggttggtcgatcacttaattggttgcttagcttaaatgatgtgctcagatcatcagcaggggtactgtacaattgcatatcgccttgcagaaggaaataaattagtaaacgtcaagatgcattaatatataccttgatatcagcatatatatttattatgtcatgttagtgtcaatcagcgagtaattaacgcgttaagcgtacaatactggtgtacatggcgtgtgcgatagcacacatacgtagccatcaaactcactcaccattaagagtaatcgagcagtagtaattacaagtatacgtactgctaattaatcgctcagagcaggcaaacgatgttgatacgtgtggccgccggccgacgcgtttgcagaagatccggggcggatcagacgcttgcgtgggggaaacaagaaggtgttttgcttgcttggggttcggatcatctgcgccgcgtcgaacgccggacgcgccgtgcggccacacgcggcggcggctgtcgtcgccgtcgccggggtgtgcgtgtctggtgttccgtgggtgtgattgcatgggagctgacctgtcagggacgacgttgtccacgtcgaatggggccccgtacgtgggccggtgtggcccagttgtcacgtaacgtcgccgtccccccgtgttcacgggggtggccgtgtggggcccgcatgtcagaggctggggccagaggcgtttgtccgcttgatgggtgtgtgtcgagttgtctgtctgtcgaccattctgcatgtacgtagctttaggttgtgctttcagttcttcagtgtcgtcggatgggatcgtctccggccggccggtgtatgtcttcgttgttaggttgctcattattgtcgatggtatgcatggtcaactggctaggtcgtcagttcgtcacggcggctccggttacgtgcatactgttggtgtcatttgcacatgttcattcattcattcagttaggatgtatgagtggctgttaattttcttgggacaaatatttaaggctctaagatgggtatatcatgtatgcatgcatctctgttgtggacttttggtgtttttgttgttgtgtatggcggattggctaatggatagctccgtttgacagttccttagcagcatgtggcacagtggcagtagtcactagtcgtatacaggtgaactgtacagtaggcgtatagctgcaagcaagcatgtgggtagtgtcgaaagtgtcggcgacacgctccagtgcctacccgacggacgtgctcccaggaggcaagtaggcaacgtcagagaatccaagcagagagagacacgccgccccgtccggtctttgcaacggggccgctccgtcgtgggctctagtactacctgttggcggctactgtccgcgaagatgaaagtacaagtactccactcgcagtcccaggcctcggcccaaccagagatgctgcggccaaggccgtgcaaaaaggccggtggtttcggtgggccgcctacccatcgtcgccgtcgcgtttgccatccgcagcggccgcgcggtgatgtgcgtgcggcgtgtggccctcgcggcgtcgacactcgaaaccgcacgcacaccggcggcgtacgtgcaatcgtgcaccaccttggaaaccaagctcatgcgcgcgcgcgcgcggcccggtgagaagagaaggcaagcgagcgcgcggcggatggataccggatggctgcactgcacgtacgacttgggcgcaaggccgcgacgtggtcggcttcgtttcttgtggggagcggcacgagtacgcgcgtatgttttgccttggtgtgaccttgtttcacaagcgatttcaggttttcttcttgggtatccgagcattcctagcagcagttggtttatcctgtgggtcgagccgtcgaggggctgatcagctgctcagccgctcagacatgagaagcttctatggaaaaccagcggaccaggcgaggcggcgtccaccgtacctgccccaagcccccaactgcccaatggtgtact

SEQ ID NO: 50643 - DNA, 23974 bp, Oryza sativa
  unsure (1)..(23974): unsure at all n locations
cccatctaattaagattagaagaagcatatgaaggttagaatgccatggagatgatggaggtggtagccaccgagattatggacgccgcgctgcacgtagccgtggccgggcgcacgctggccgtggctgagcgcgacggcacgcacgacccggccacggggcgcgcgctcaccggctcatggctctgggactcctccctcgtcctcgcctcccacctcgcgtcctgcgtccaccaccaccacctccgtggcgccaccgtcctcgagctcggcgccggcacgggcctcccgggcatcgccgccgtcgcctgcctcggcgccgcgcgctgcgtgctcaccgacgtgcgcccgctcctccccggcctcagggccaacgccgacgccaacgggctcaccgccgagcaggcggacgtgcgtgagctccggtggggtgggcacctcgagcccgaggtccaggtggacgtggtgctcatgtccgacgtgttctacgacccggacgacatgccggcgatggcggacacgctgcatgggctatggcgagacggcgacagcgacagcgacggcggcggcacggtggggtgggcggcgagcgaggcgcgcgacggcgtgcaggactgtatcgacgtgctgcgagagcaaggcttcgaggtggtcgaggtagacagggtcactaggccgctgctgcgcgaccccgagcaggccgccgacttcgccgtctatcgtctttttcgccggacaacttcgccgtccatcgtctccaatccaacgccgataactacagccgggtgttgactttcactctgtaacagtaaagccaagcttgtaacggcaccagaatcacctttgaccttttattttccaaaaggccattttgtacgtactttcttctcggttgcaggacttgtaaatgttccacaatgagtcaaggggacaaagacatagcaattaatatatgcaagtctactgtaggaagctacagtagtatacattgagaaggattttatagcaaaagaatttacagttgcaagggttgctacagcataaagtttcttcaagtcactcttttctatttcaccgccacaaaaattttccattcctgtgtgtaaagggccaagagaaaaaaaaaactacagtaacattttcgcaatcttatgaaacaagggtatttgtctaacgatccacacagatgtacactctaataaaacctggttgatttcgtgacactagagccctagaaaacgtgaaaagcgatccgcaagatttgcaatgacaaacccagaaaatacctgcaaagcacaagtaagcagggtaaagcaaatgactagttcaagcaggattgatctaagaacaaataaagtatcaaagaactaatcagtcagattttcatagttataaagaatggctatattattataagaacagaaaattttgatttactttcacctaattgtaaaatggttaataacagcatttacataacttaaaaaaaatacaatcctaagctgaggacatcagttacctggacagaaccaaagatatagaccgctgaataacgacgaccatgaatgatcatatcagccaccattgctagtggaattgtgagtgacatgcccaaggtggccaccaaaggagtagtccaaacaacagaaagagccctgaccagaagctccatgtcaaaaatagcacaactaggcaacaatataataaaaatgttatccttggtcagtgcgtaccagaagtagtctgacaatacacttccaataaggccatttgccaacaccacttcatccactttggctgagtggggtattgtaaactttggttcaatgcctaatgcggtcaatggccagactgaaaataaaagagagaaatttagcatatctggatcaaagaaccaatcatggaatacatgaatgatatatgtgcttgaaccaaactacaaaagaacatggtcacaaaggtttgtgttctacgcagtagactagaatacctgaacaaaaagaattattggcatgcgtggtgctgaagaaagagaatttcagactacgaacaatagagacagattctctagcagcacatgagatgcccatacatgacatcctttgcgattccattttatgtaccaaatactaattaaaaattgaatgctaattagtcttttagacttttcattgaatcaatttttatagttaacaaggaaaatcttaccaagccaccagagaagaacaagactgaaaagtccgaggtagccaaacagtttttggacatcaaccttttctccttcctctccagcaaacttttttagaagcactaaaataatgttgaaacaattagcagttgaatcaagacagatcaactaaaggaagcaaagaactaaccagtgaataaaccatatgacatagctgacagaagaccaaacatgtcacctagaagagttctctgagtggcactgcattcataaagtttacagattagctgcagaacttgtggccaacaaagtgagtgctgtctcaaagttacaaaatcatcttcaacatgatcttcagttacaaggccatcttaaaaatggaataaatagcgcttttatgtttttttatgcacttatatttatatgaaaagcaattcagttgcagcaaccaatctactacaagcaagcaaatgcaagggctttatgagcatagcaaattaatcacaaacaattttatatgtcctgaggcatcagtgcagaactgtgatgtttatttaagggtaaaacgcactaacccagaattgctgatttctgattcatctgatgcccaagtctgccccatggttgtcattaccacaccagccatgctaataaaaacagcaataacttttgcagcatttatagaatcttggccaagtagcacaccaatgaaaagagtgaagagtcctgacgttgaagatagtacagtagtactagcaacactagttcttgcaagtgccgcatttgacaagtactgcatccattaaacagaagagaagaatgagtaacatttagcaatcaaactactgcttgtatggttgaaatcaaatgatccctatgaattttaatgaacaggtaaatattaggaaattacctccgtcacaaaccatatgggacaaagatacaacccatacattgcaatctccttagtggaaagttcttgctccttcaaaacgtcatcgaattcagtgattccacatataagaggttttgtctcttctattacaggaatatccacatcagtatagtttatgactatagttttttgagattccatttccaacatcttctggaattcaccattcttcagaggagcacaaccaccgaaagaagatttgttggtaacttttgaaactctactacttgaagaagaccttctcaacaaattacatataaaatcctttaaaaatgaaagaggtatatagatgatcataagggaggcccccaggtaagtaattgcaaagggttgcttgtatttagtgaatatcccctgcacacataatgaaataaaattatattcatcgcataacatcaaatttatcaaaactataagaaacaaaaacatattatgttttaagacataaatcatacgtcttaacggtgggctactataactgacatgttcttgagagttaaatgcaagtaccaaaccaatatcttgttttcttcagaatagaattttaaaaattgaacacgggtagggggaacatctttttcgataataaaagggaaaaacatcttgatttgcaaaaaaactagaataatactttcccatataatatttaatcacgcattacaggtgagcaaggatgtcataaccacctccaattaaccaggtattgatgatgcgaattgtcacaaccacctcaagcaaattagggtttgacaccagccacacgaggaaagacaggagaataatcaatggagcatgtacatcaattctctagagaaattccatgagcacacaatttgacatatggaaaaaagtaactggttgcaaaagacatcaaagctcgtaagacaaaagaattgaagaatctataactcaagtcagattctaacgttgcctggacaatttttaattactggaaagaatgcatgaacagattaaacaaatcagcgaagaggaatgttccaagattcctgattaaataataaaattaatctgctgtcaaccaagcatgcatccccggccaagatctaagaacccagaaaacaaataatcacaaaagataaaaggaaaacccgaagaaatcttgtcacctgcgtgacctccgcggaggtgacccatatgagcaccacggcgacgatgaggacgaggccagcacggtacttgagattggaacccatatcaatccaaccctctcctcttgccccgcctggtggtggagtgagtgcgggtgcggggcgcggcgagcaatttaaccgcgcgggcagcggcggggctagcacccctcctcaccgagaggcagcatgcttgcggcgcggctctcggtgggtgagctccgcggcgcccctcctcgcctcatcgcccgcccgcccgtccccccccccccccccctcttccctgctcacgaaaagagagaggggatgctcttccctgctcacgaaaagagagaggggatgcgaggcgaggaggagggggacgaggcgaggtgggtggggtaaagcgggcgtgacctaccggtggaagtttctaattttcgtcccacgccgcaccgaggcgggcagcgcggcggaggcggaacggaacgacgggcgcggggcgggacggcgggattgcgagtttttggcgtgcgattcggggtgttttgggcgtgtggcgtgtgggtggtgggattggcggtgtgccgcactgccggtgtcggtgggagtgggacgggggcggccgttgctgttgtcgacttgtggatgcgggacgcggccgcgcggggagcccggcgtgcgtcgccttcggtgttgtgctgcggcggaagcgagattgatggggccttgtgtacctgtgctggactggcccatgaatattttttttccttgtaaaaaacaattagatataagagcaggtacaatagcaggctattagtcagctataaacatattttaatgagataaatgatgagagaaaaaaacagcgggctacagatatctagccagctgtagcgcggactccaagacacaatgtatgacaggtggaccatatattaatagtatagtaagcaactattatatgaattgactattagatttgctataaatgaattggagttagtagtgggctgtactattagacttgctctaaatgaactgcctatccatttgtcggatggttttttaaaaatcaccaagacaacatagtttccggtaatttctcaacagccatgcagaaaacctgatcggtaacggacgacgacgcacgcagagtcctcagtttgggcccaactgttgttcctcagttcacatgtccaggatggcaggcactaggcccacgttgcttcattcaagcccaggccattactattccaattcgtttgcaccaaaacagctacaggcacgctccactgacgagagccactttgagcggctaaaataatatcccgggacatctataaatacctaatctatatctatatatctcttctctactattataaaaattaaagaatctatatctatatatctcttctctactattataaaaattgaagatgttttttatcgagattttgataagtcattcgtgtttgagtcggtttttaagttgattaaccatatatcctctctattctcttctccgtctactattataaaagttaaaaatgtttttgtcttggtatgtcgtccgaattcgtgagcaaatcgtaggaagtttgactcccgcccgcgtccgattccctgcctgtgtccgattcccgcgtgacggccgttgaggcagcacaataatgtccacgtgaccgcatccgcctccgctctatctgtttccatgtttccatgtgtggtcgggatcccaagcccacgggcatatattactgttgcacaagtccttcacgttgacggataaagcaaacatgcaccgatgcacgcataaatcaatgtacaaattgcactgatatatggttctggcaagaagcactgcttgatctgtatgcacaagaaggcaaccactgaaaggaggaagaaccatgcatcattcaaatttcgttgtcgctgctcatcaaaatagagatcaattcaatgaaatgactgatgaaaacacgttcctgagattcgtgcaactacaaagcaacattacatgcaactcaaatcgttcatgcaggtgtttccgattcggtgttcgtttgtcgaccacgtgttcccatctgtgaaggtctcatgaccaaaacgagccagtcccaacgtcccaaccatgactacttcgtcaagccactccaaaactagataatgcggtgatgttagacctaccatatagcagatcagtgcagatttcaccttgattttcatgggtctttattttcttcaacatcaccataaagaagatggtgaaatttgtattttaattaattgcataatgtaaatcttgatttccttcaaatctagcgtactgagcccagtcgggaatgttctcgtcctccgcttcatcttcttccatttcaaccccttgctcaccgtaggatgtccaacaattatagcttgacatgaaccccgactcaaacaagtggaaatgaatagtcctggatgtagaatactccttctggttcttacacttattgcatggacaacgaataaaaccgttacgcttgttagcttcggccactctcaaaaaaaataatacacgccctcgataaactctctggaccaccggtcagcgtacatccattaccgatccatctacatgaaatgaaaaaaaatcgtacataaataaatttttgtacaataatgacagtcaaacaataatgataaaataattaaaaactctttcgataagtatacaataatgacatatcattactcatataattaataattataaaataattcaacaaacaattcttatttttaacaatttttgaagttctaaactaataaactaatattaatgttgtacttctcttaattttcaatttagcttgttttctattttgtaagattaattttcatcatattttaaactatgagaataaaattcttttaagtaaacaataaaatttctatatattcttcttcccccacacaaattttctctatcatcaacttacaataaagttttagagaaaaaaaatgtgtgaaacatagctccaaaagtaatataacaagttactaacattttagacacctccgatttgtatataatcactaaaaaaaatttcacaagaaattttggcataacctcctttctttctttaagaaattttgaagtttgctcaggctctttaagaaattttgaagcttgctcaggctggaggaggaagaagacatatataaatgggggatttttaagtcccggttggtaagatcccggagggcctaacaacgtctaactaaaaatgatctttagtccggttgataatagtctcggttttaaatggatccgggactattgtgaatttcgaccgaccgaccaaagatgatttctccaccagtggatccgaacaacttttagctatgagagagatgaggcacttcaaaatttaagaatttgaattccttaaatattctgattggaagcggtaaaactagggaaaaaaataaacgaaattgaaggagaaaaaagaaggcctaaagcaaacaagaaggtcaaaaggatccaggatgaggaaaattagcagcaaacctaaatcaaaacgcaagaccaccgctccaccgctcagctcatcctacttcttcgtggaacgagaacaatgcgggatgacgtctcgaacgctgatggatcatgccccgacacaaggaggtacgaggaagaaaaatctgagaagggcaagctttagggatggggaatgcaccgaggtcactgccgatctgccgcaatggacgagctgctccctccctgctcactgtcgttgcgcctgagagcatggatccggaggagcgccaccgccgtcgcgctgaggccgctgctcaccggagtcgccgccgcctgtgccgaggccattgcctctcccgctcgacgaggccgaggtcgctactcgtcggggctgctgctcgcaccggtgctgaggctgtcgcctctcccgctgctcgacgaggctgagggcgctgctctccgggtggtgtcactgccgcggctcgcaggggacgaggccaaggttgcgctgctccctccatgggcagctgcaaaaggggaaaaggaagtggctagatgcagtgcactggtggggactggggaggaagaatcgagattggtcttatcctatcccctctgcagctttaatttttttctctcctatataactcaagtgtcaagagcgtttgagaaaaaaaaataaaggaatataatcactgctgctttcttttttacctcttgtccaccatgtgttttattcttattctgtctttattttcctctctttctgctttgcttttatatttttattgtctatttttaaatatttaacctcaaatgcataagctgaaaacaatactcacttaaaaaaacatagattttcactatttagatgtgacgtcagcttttgcacgtcgtgatttagacgtgtcatcaattcaacttcatgcattttcttcacatatcaatgcacgtatatattcccacagttaaattacatagagtgctctacacaaaagcaatctcatcgttcatctgatcattccaacaatcgaagccacatgtcaaaaaggtatgcacatgataaattgttcataaattgcaggctagcggcttgatgcgatgcttgggcatggaggtggcggtggggttggccgcgacaccgggtgacaggtccgcagcgaccaggagcaatgacaaggatgtcgcggaggatgccgacacggccaccacaacaccgatgaagggtcgttctccaacgtcatcccccagcctgaccaggcaacgggtaccgcacctgggcatgtaggcggcggtgggggcagctgtggcattgggtgatgggttcgcagcgaccgggagcgacgacgagtagggcgctgttggtatttcttacaatcacagataaaatccacaagcgcacgaatataccgatgtagcacttcccctacggagtattccaaaggtatcgaatccaagagaacgtgtataatccgatcttcctccggtttatgcaaggatatcaagcaaatgctgcaagttgagagcgtctcgtcctttggaaatgagtctgttggcaaccgaaacaacccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattgacaggcaaattctccctgtcatggtagtcctctggtgcagggagagccagtatctcctgctcaggagattggcttgagctgcagagctcatctcttgcagaagtgaactcgtcgtcgacgggggagtagccgtcgtcttctgaatgttcatcgtcccctggtgcaggaagcgccagcgtcacctggctgggtggaactggcttgctcagcttctgactcagggaaatcctggcaagctgaagtgcctgaagaacactctctatgtccatgttgcttgttggctgttgatctggccctgcatcgacctggttgtcgccatggtcatggaagcttgatgagctccagtcagagaccttgctgttcagggtggcatcactcattgacgggcttccatctgatggcgctttgatgtcacagtagcttgaacatccatccggattctcgtttccttgttcttgattcttccctgtcattgtgccggcgacattagagcttccttgagactgtgcatgacagtggtcgtgatgctcctcgtgcgcgtcacgttggtcggcagcagcttcttgtcctgatgcgtgtgattcaggaagggaatcattcaacagaaggccagcagagcggttgttgctggcgctggggtgatttttaacgcctggttttgcctcttcgttgcaatgtaccgcttgatccgcgagcctagcatgctccttgctctgctcccaaccattttctatctggcacgccttattctctgcctcaacatgaacctgagctccaaagacaaaagtatgggtaaaatgtcaaattttgaaccaaaacaaccaggtttcactcatgatactaactaacctgtgggttgcactctgcagtgcattttgttattaaaaaaaacattttgagagagcaaattatttatacttatcaagttggtagtacacatttttgtactgcatgtgcactaaatttggtagcatgtggaagtcaaggggaagttgactctctctctggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctctccatctcgccgtccttctcgtacctgatcacatactgaccaccagtatcctcgccgtccatgtccgcctggccgtcgtcggtgcaatccgatccatcttgctgccccttctgactccaggcgagttcctcgacgtcgccgcgctgctcttccggcgccgtctacttgccattgctgatgagcagagccgtgtgatgttagaattcgacaaacaatggcgtgtgccagcgtcaatggcgggacggagctcacctgagctccttgcgcttgttcttgcggcaggactgccccatccggtacttgggctaggggtcggaggagaggaggtagaagtagctcctccggtgcttctgcttgagttgcctcgccttgcgcgggctcacgctgcggcctttccacgacagcccgccgccgggctcggccgtcccggacagcgcgtcctccgccgcttcgcactgcgccggcggctgctcctccccgcgggagcctgccgtgtcgccgtcgctcctcccgtcgcgtgggtcgtcatcctcctcgccatcgtgttcggagcccgagtcgagcacgtctgagaggttgccgccgaagccatgtgactccagaatacccagcacctccgtcgccgcccgctccgcctgccgcctctgcgccgtcaccgcctggacctgctcctccagctccgcaacctaaaaccaagtgacccaacacatgcaatcaatggcgcgaacgacagcgagaggagaaggacacggcgagtgggctgcgcctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgcgcgcgctgtgttgctggcgctcacgcactccccgagcccgagccgcgagtgacgctgctgcgtacgtatgcggcgcgcgcactgtcacatgccggcggtgtggcttgaccggcgcgggtattaaaaacggcttggtttcccgtgagccgcgcacggcgcacacgcagcgcgcgtcgtagtcgcggccgcgggcgcacggcgcaccgacagccaaggccagggagtacgctacctacgcgcgacacaagcgccccgctgcagcacgagggccatgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatcagagtttgggtttatggtgtactgtgtacatgaactccagtagcacttgtttatggggtaaattcgtcgaggacaagagtagtgaacgtggtacagctttgccatgttcgagcaacgcgacgaagccagcaaaactacactcgtcttctcttgtgctaccgcctactgctactggtgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattagcatcgagtaacagatgtttccattaaacaactttagaatacacacatgcagggtgttgaggccgatgatcaagcaatgaccatgcggcagattaatgcagaccgtaaccacaatctcaggtacttaaataacgtcatacccggtaggcaggtttacaaaacgttttcgtaaacgtttttagccgaaatttcgctcaagaaacatcatgtctgcttagtttgacatattcaaacaagataatgacgatatctcaatcaccgctggcacagcctctgcatccacagtgaacacattctataaccttctcctctctgagatgcttggggacccggcagacacatgtagttgcaaagttgtggtctcgtgtctgtatgcatcgaagacagcaaaggcgctcatagcctggctgaaaacacacaaaaagaagcaatgatacatttgatataagaatgcctgacaaactcttgtgacaaaaaagcatcttcagcatttgcatctaaaaagtgactgaaaactttgacagttgaattcgtcacgtacatgtctcacagtattcttagggcaatttaggcccctcgttatcaatgttcagacaagtatataaagtagtaatatggaacataagtattgcatccctcccaaatctgccaacttttatcagatgtccaggaaaaaatatatataccattgggtgttagaagtctatccatgatttgatttctggttacatcagctgctagtgtggcaataaaaatacatagcagaaaatacataaacatctttagtcaactgccttttctttttgctcccaaaatcttatttttcatggtacacccatataagaaagtatatagtccataaatccccacaagtcactcatgctgcattatttcactatttcctgtggttcattgcatgaaatccaataaggcactactcaactttgacatacagctattaatcgcaggttcatacatatagattatattctaaacaagatttatgatgtgtcatgtcaaactggatcagtatgtgatagcttaacccaatataatggatttactgcaagaaatggtaggatgcggttagtttaatgttttatttttcatagtacaagtacaaaaagtatggtcagttaagttacattctaagcatgggaaaaaaagtgagaaacttaacagtgtatccagggtctatggcttcatctgaattatctttgtacacaagttaattaaagtcttaaagattatacaaggtggataaggcatcttactaaacttgcacagagtataaggaatgatgggcactcgcaaatcatgggtcaaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgcgtgtcattttcagctgcatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctctcaatgaacgtcgaggggctaaagcttgcaaagaaaccctgaggacatagagtaggtgtaagattcacaatgcaaaacatttacacggtcaggctcttccatcgaactcaagagattataagaacataatggacactacacactattacatagaatttatccccgcattgaagccttacatcagatatgctatatattccttactataaaagaactgtgttgaacacaaataacacaatttaaacaggtattttgcatcttcaggctaacagtcttgtcgaatcatgatttaaccctattttgcaagtacaaaatatgtgcacctcgaatcggtgaatggacggtctaatacataaagaactaatcgacacgatgataaaaatcgcggaaaaggttccccaaaccctaggctactcggaagaatttttttttgagggaatactcggaagaatttcgtcccaataaccacatacgagagaatttcgtcccaaggaggagacgaattgaacgaatccaataaacagcgaggtagaaactactaaaatatccagcgaagcgaatcatcttcaggcaaagaaaaaaaaaacaaaatcagaatcatggaacggaagacgaataataacctcttggcttgggcggccttgcagtcgccggatggaagctgtggcgcgcgggggagcggcgatccagagggggcgcgcgtcgtccgcgccgctggtctgcgctgcgctgcgctccgctccggtcgagcaaagacggccgggtttggagtttggaccggagctatcagctatatgtcgtgattctttttcccctcctttttgttttttgagaggagctatgccggtttcacggttttctcctctggtaggagtagtatttgctacatgggcctcaagaatcaaaacgggacaccaactgtgctgaaatccaattgggcaaacgagggttggtttggtttgtagctcaactttgctaagggtgtgtttagttcacgctaaaattaaaagtttggttaaaattagaacgatgtgatggaaaagttggaaagttatgtgtgcaggaaagttttgatgtgatagaaaagttaaaagtttgaagaaaaaatttggaactaaactcggcctaagtcaatatttatgcaatgttaaacaatagtctatatgtttagattaatgccaagtgtcacagtatgtcctttagaaaattttgtggaataaaaattacttataagaatatatcttgataaaaagatattttgtgtgactatgggtagtttgtggtctagattcttcttaagaaatttatgtgagtttggatgagtacaaattatgtgagcttacatttttcgttctaagggtgtttggatgagattcagtaaccaaattacatatgctaaaaacggaaatcaaaattaacaacttgaaagtaggtggagctgggcagaggcagatctaaccctgtttcggttgaacccccaaactttttgagggataacgcagaatacctgatgaggtgtgggtagggagggatgctcaccggcgagcgacgatgcggtggaagaaggaggacgccgggcgccacctctgctcgcaggatggggatcggcgcaagcggcgggcgaggagacgaaattcgaggccgaggccggatgggatggattaggatgctcaccggtgagcgaatgaggcgggagcaggaggacgccggcgccacctctgctagcaggatggagatcggcgccagcggcaggcgaggagacgggagtcgagggcggcgggcgaggagacgggacggattggggaggcggaggttatgcacgcggtgtcgcctgcctatgggtcatatgcacaggcccatgaggctggagttttttcatctcccaaaaaagttcatctaaggtcccttatcttatcttgtcgttgagttttaaacgactttgaacccctaatcttgcaaaatggattacggatcacttttaatccagtattgctttccggttttgttgacatggtggctgagtcagtgtagaggccacgtggaccccacaagctaaccaacaatcttcttccacctcactcccctctactcccatctcaacccaaacctccagggcattcgccaatgggtggggagaagggtgtcggtcggcggggaaaagttcgacggcggaggccgccagctaacgtggctcccaatgaccggaagcgctcacgtcatggacttgcgcacgtgcggggtgtggcgcgggtcccaactacaactgcaatgttgtcttcaccggcacgcgtgaaggctggggcttccgcctcatcacgctggccaagctcctatcccgggcttccgcctcgtcatgatggccagctcctatcccccaagctcatagtcgcccccatcgagcggctcaaaagccgatgtgttcaggtgtccccgagcttcgcctctccttcgcagaggcgaacgcgcggctccgccgcatcgtcttcgaggtcaactccatctactccacgttgcggtcgcatcgtcctcgatgcatgcgcccttttccccaacgcttgccaccgccaagcttcttgttcgctgccagccttctccccacccatcgccaggtgccgtcgtcgggcttctacctaccaccgccgcccaacaaccaccacccttctccctgctggtcaccggtcaccacacacctctctcgcgattcagcgtctggcgtcctcttcgcttgcatgcacgagcactcatgcagtcagtggtgctcgcgagtatgcttaggcgtcgcaacgtactccatctcccaactcttggagatcctctcgccaatcccgacagtgtggatgacatgcgaccatgatgtggagcaataaagtacctcgtattttaccttcagcttctggctgtctcgcaataccttctacagcttgtcctgcagcagtaccttgaccaactccaggcccaatagaagcaagccctacggccaatccagcagcaattagtggaatgcctagtttgactagttggttcagtagcagaaacaacttatttccccgaaaaagacctagcttcttggacagctcaatccggtgcggcaggaacgaatgaaacgactagtggtcctcggaaccctacccgagcttatattccttgcttcaacgcccgcgccttccgtggaaaagtactagtgcttcttatggagcaagaaaacggatgcgcgcgctaacgctttcgcgctagtgcactcaccccgttgcttgttgggcactgaacacttttcaagatccggttttggtaggacgaagatttttcactttcgtgaaggtcattctgaggtggaatcgaaccactatgttaggatttagagtccaacgcgcaaagctaaagaggatttcaagtcccccgcccgccagaacctaaagattgctttatttttatacgatttattgagttaactaaaaagctggttcgttccatagagaccagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatctcgaggctattatgcgcaagcttggtttccaccaggtggaaaaggtgatgaaatgtgtgacgtcggtctctttttcggtgcttttcaatggtggccaactggagaagtttaagccaacgagaggcatccgtcaaggtgaccctatctccccatagtaagccagccaatagtaccctaacttaagaagttctcttagctagcgcatgtccattaatgtgaccaccgcatgctcctgcatgagtttcatgaatggtttgtttttgaatccattcttttttaggtatactatcttgcaagaaaggagctcgcaacaaaacgagagctttttgatagcccgttcactcgactaccacgcttagtaagtctatctgcagggatgggaatggcgtagtctgtctgcccttcttcgtaagcaactggaactatcaaaagtcaatgtcaattggccttctaaaggctatagccctgtttcttttgaaaaaacgaatttcgagtttcgaagaagacatgcctccaagaaagccactccgcctaaagagtcctaattcctatccggtctacattcactattcttcataggcactgcgctgggtcggtaggttgctgttttgacttttttcttcttgctttaatccagtcgctcgataggacttcccgtaacccgaaaaggttggttcttcccctacaacccctacccctccaaggctcatcggcaaatccgaatgtctcgatccgagttgagacccacctacagaaattgatccatcaacggcttttttctatagtggcaggaagtctccaactcttcgatatgcgctagctaggtaatccctttacttaatctgatatgggatctcttgctaccagaaaggaactgaactggcttgcccggaaagaatggattgctacccttggagagctaatggtactggactgatagcgcactgattgaaccgaccccggacgtaccactggggaacctgtggctggagagaatctctcgcgatggaaagaaataaatcgaatctagaaagacacgttctacctatgactgccatttgttcacttttatctatcgtattggatagaattcaagtcccttaccgtattcatctattccctctcctttcagtcgagttgacctcggattctaaagcaacccacgggcataagcaaagaagttatcaagcttttgggatagcaagttatttctagggtaaaggaaaacaagctaacagtctaaggctaagtccctagagttccagttttaatagtcccattcctcctgccttccgccgacctgcggccttatcatagtagcccttctttcttgccagtgagatagttactacgaagtctgcatcgggagaatgggaataacgatcttttatatgatacggaaagcgaagagaatagactgctacatactaagttggttattcgtagatttttaccttcttggaaaataggaatggggattggcagggcatctactatcaactagttacttgggcaccggtgatacaccccaggataccttacctatttagacatttatgcctcgctgcgcgccttcccaacgagccaaaactatgcctaggcctcgggcttaggaactatactacaactagttttgtatagaaaacccagaaatacccatattcctttaaccttcacgaagaagttcgttagctccccctatgtcatactcctaaagaagttgtaataaaatgtgctgatccagatagatcaaatcctgattacgacttcttcattcggtttgtagccataccgtatagagttccaaatgcctttttttggaagtaactagattcaagcaagcatcctagcaaaacgatcttttgacaatgggctctacccaacactaggactgactgactttatacagagatagaaaaggcagcaatccaagctctttttgaatcggatattggataggctaagctaggtgtagcccgctttctctacagttttgctgaacttgtcaagcccggggggcctttagggaattttggagaatgatagattctaggataacactttctaaggttgaaagggatggcatgggttaagcatctgactttggaccttcgagctaagttatttaataaggtcctactaattaattggaaatcctttttacaaatctcctcctcagagcgccctgtaaccttaccttttctgaatggtacaccttatttaagacattcagaatagaagaagagcaatcgtcgattgattgaaagtggattgacggcattcatcagttgattgaaaatgaacttttcttttatgatcgagcgaggtcccttttgggcttaaaagtcctttgagccgtggaatcccttttgtcttgatttaggagaataggcacattgattaggttacgtggtttgagcaatctgcaggaagtttttttttctttattatatataccattcatatttattattctatataccattcatattaaagtaagacggatagggcatatttgactaggaagcaagcaaagctagtccctccataccagcaagcagtcttgtttagggagtctccttctttactgagtaaggttcccgggtgcctatgtgattattaaggcagggtgctactgtaccagtagtagagtggcttgaatcaaatcgtttgtctagagagggtgtagcgataaccaaagttgactgtactagaaactttagatcctgtataggcaactggccttagaatagtgtcttgaactacaggaacgacccataatcattgacgaagaaggcttggaaaaggataaaacatattgaagagaagctttcacaaaggccaatagccgatagctgatgtcactagccttaacttctttatctacttgaaagctgatgagagtacggctttcttaaaggaagtgtccgtccctatgatattatatcatagtaaagagcccttggattcgcctttttccgtaagcctaaaggcaagggaagctcttcgtcgagcttcttatccattgaaaaagacagacttcaactttaagactaaaacctgcccctttattattattagtaagtaagataggttgcttgagccaatccttaaatcgtgggaggaaaaggcaaaaaagtgagcccacccaactaaaggaacggagaaattctgaacttcaataatcgaagagtggtcgtaggtgagcccaccccaggcaaatccacttatcgttatcttgctcctggtcaagctcccgtacccgctcctttccgtgggctttctttctgctttgacttgttccttttcttgctttcaggaagtcgtccttgacgagggccccttgatagccggtcttcattgccaatgagaaagaaaggctcctgcttgtgtgcttagtctagccttgcaagcaacctcttcctaccagaggactaccatataccgatccttgctgttaccgcaaatcgatcaattcgttacttttcatcggaagaagtagcacgcaactcggaaagaaaaacctctgatgctccttttttcttaatgatgcaactaatgtaatgcctagaactgatctattgcaagcccggatattcgattcctaacagaacaactcatgtgtgaagtagatagataagtagagttgctttcgctttgttaacttacgtaaggttgcgtaagatatgtgaatgtagttacgtgagcttgcttgcctcactttcctaatatattgttgacaacacttgcaatagggcgtagtgttgcgctgggtcgtcttgttcggaagctgattgagaaaatatgcaggcacaaattggatgcgtaaaccttggactcatcaaagctatgctatggctatgtactagttgatgagcttgcctccagtacttgatagaagcccatgactctctatctgaaagtggtcttggccgtaagccaataggcgtagttgtagcgaagcggcgtatatcgtagttgttcggatagcaagctacctgacgtgataaggctactagtgccctccactcgtgcctactttcactaacctatagctattgcatgcaagctcaatcttctatctcgcattgctacatgctcgaaacagccaattcgctcgtatagctaacgcaacctatagagtttggggagtgctgctattctttccaaatggtctctgagtgcggtctgtcaattcctgttgtagacatctgaggagagggggaagaagagtagacttactacttttgcaaatcaaagaaagaatttaaacagacatcaatcatctaatctgaattctttgacaattaatagatacctatcatagaaaaacctttctccaaggaagcttgcttcttgttccagatttgatctgatcctaaaataggttactttgctttccgctctatcggaaaacgttctaacgtattgattccgtaattctatttcaaaaaagagtgagactcaatctccttatgccatcccacgctaccgaagtagactcgctccgtctatgtgtcctgaacccgaagatagagaccccagctagacctatttagtttagttgcctcgggtgagctgaactaccagaactagttctttacaactcgtgccccggagccctctatctagaatagctctctctagatttcccagaaatgttaccagaataagttacaactgactatatcttcttttcccagcgacgcgccctcccactaagctctcaaccaatccaaggttaagaaaagaaagaaccaatggaatagttgcgaatagatcagtcaaacctcatcaagtccaggttttgtaggcaggtatccggataggtttatggttggaagagatagacacgaacggatagccttgtatgtatcggtatgaacagtgttcaggtttaggaagagtaatttgaacagaagggctagctgtgcttattctgacaaggctgaacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttcaaacgcaaataaataaaaataaagaatttcagcacgcgcatccgttttcttgctcgaaaaaatgattcaatctgactttatcggtattctggattgagtaaaaaagggatatatgaagttcaaggccttgccaaaaccgtcatggccctattatgtataggccgtactaagccaatagtgaataacaaactctttcctgctccctcgaccctaattaactcccatcctgccaagcctcagctgccagcgcattgtatctaagcacactgcggcaaattgatacaagtagctaaagatctcgcatccgacatccccggccgaacggttaggcaacactagggcgcctgggtcccaattccgtttaccaaacaagatgtcgagaggcgaactctgtaattcccccccagcaaaagtgatagcagctgtagcatccgtgtggaagagggtaagctttcggcaacacctttttcagattggaaaggatgaatacttgtgttgggtcctgcagaccaggatagccttagatcaaaacctaaatgtgccaggggttgatcatagaagccagggcaataagtattcaggaatttgagcgcttatgtagctaataactctgccacctgaatacttgattcattaaggtcgtcacccaatacccggaagtctctatcgttttctttgtctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnga

SEQ ID NO: 50644 - DNA, 720 bp, Oryza sativa
gcgcatcggcctcggggccgcttgcgcgtgcccgaccgccttggcgcgtcgtcgcccgtccgacgccctcagaccgccgccgccgcacaaatcttgacgacgacaaagccaggacgacgacagccgcaagaaatcgccgctcgacgccatgcgcgcccgtccaaagccgccgcgaagtccgattttgattctacccatggtgaatcacgccaattcttgccgcacggttggattgaagatagacggtggtatcccctctcacaattcaaaccattcacccccgagtcggccgttttcaccctcgccgccactgcgcatcgcgcccggattggcgccaacacgtcgccagccgatttcgcacgcggtcaagccaatccttcgctggtaagtattcaaacgtggcctcccgccactcaaattgatcttgcccgtcctctcacagcctctgccgccccagccatatccaatccttgagctcatccatggcgatgacggtgtccgagctcatccgttcctcctagccctataaataggaccccaatcccttccttgtccatcatcgatcatcaacaaccatagccccacaaccccgagctttgattcaccaatcgcccgtcggtcgaacaccttgtgcgcgatcgactccacatccctccatccatcttccgccctaaataccccttagaacaccttatatcaactatgttatagtatattaga

SEQ ID NO: 50645 - DNA, 861 bp, Oryza sativa
ataattctagaatcttcctttcacaaaaacttagtaaatattgatttaagcatcaaagtgaacaacccccatagcttaacacttgtcaactttaccaaatgttttccctaagtagtattacttttccctccaacaactctcattcaaatttctccacactttaccccaacctacctcccacttttcaaatactcctcatttaattatggacataatagtcttttcctttttttttctttctctaaaacaacctaatccattatgcgatggaggtagtagccaaggactccaaaattctggttggactacctgcatatggcctgtggcccattttcaagcggcccaagtcatattagactcagttcacaatagtaaccagggataaaaacagagcagatatggacgaacaattatcataccatattcgctttcatattttttgccgggtgtaaaaacgaatacgaatggcttggatacagaaacaaatacaaattatctcaaatacgaataaggatcgaatataatcagatatgaatatggcaatatttttttatcaaaacacgaaaaccacctcaacttctaatagaaacgaatatcatcatatataattagctcgttttatataaaatatagtataatttataaacatatttaaaagtttaaataatattaatagtgttgactagtgttaagagatatgttactactaaattctaaaaatgtacattgaaagacatagagttataaagaaatgtggtatatcttatggctttagcggatatctaaatagcactgttcaccggatatccgtacccgtcggaaaccctgatatcatattcgtattcgtatttgggagaaaat

SEQ ID NO: 50646 - DNA, 747 bp, Oryza sativa
cctgcagccctgcaaagtacattatttcatatcgtaatttagttcacaatgacatgatcttgttcggtacacaatactacaatttaacaagccaagtatgtacattatttaagtagtgcaacaaatataagcagagcttgaaaaagagcaaagcacggtgatctgaccataggataggagagctgaggtgcttaagtcacaaaaggcaaaggtaagcctgaaaacataatgcatcatccagaacttcgtctgacgatctaaccatagtgccacaccatgatgagggagggaaagctcacagcgcagcaacaccatgctaccagacatcaagcatcagaatcccacaaacaatacctcttttgaggcctgcagaaagaagcaaaagctggctgcctgccttaccttccacacccacacaaagtcaatcaagtaacaatgatgataagggccttaccaaagaccatatatacacacattgatgccttcagattttatttatgtgtgagctttagtatcgccactgtaccagttgccagttctagttatccgaaacctccacgccaagtttcttcgcctccatcttgagaaacttcaggtatctaacagcttcttcaatgacagaggctgtatccaattggtctccaccagggattattccctaagaactgtgaccatatttctcatcctctcatgagtaacagtgtccatggatccatggaagactgaactctggctagaagaatgatg

SEQ ID NO: 50647 - DNA, 2230 bp, Oryza sativa
cagagctcgaggcccatcgtagggacctggcggagatcgccagggaggtggaggaggagcgggagactgccctcatcgccaccgccgtgttcaacgcggcgcgggacgacctccgcctccaatacgggagccgggcggcggagctagagaagaagctcgacgccgcccggggaatccttgatgctgccgctgcccgggaacggcgggcggcggagatcgaggcggcgtcccggcagcgtgaagaggcccttgaggctcgcgccacggtgctggaggagcgcgcccgcgcgaaggagagggacctggcggaccgcgaggccgccgtcgccgtccaggaggcaacactggcggcgcacgaggccgcctgcgctgaagaggagtccgcactccgcctccgcgaggacgcgctcaccgagcgggaacgagctctcgaggaggccgaggccgcggcgcagcggctggcggacagcctgttcctccgcgaggcagcgcgggaggagcaggcgtgccgcaatctggaaggcgcccgcgccgagagggccgcactggatcagcgggccgctgagcttgaggcgcgggtgaaggagctggacgcgagagcgcatagcggcggggcggccgcgggcaacggcgacctagccgcccgtctcgcagccgccgaacacaccatcgccgagctgcagggcgcgctggactcgtccgccggggaggtcgaggccctccgcttggcgggcgaggtagggcccggcatgcttcgggacgccgtctcccgtctagaccgcgccgggcggtaggcgggcctctggggtgggcggaccgcgaagtacgccgccaaccaggggggcctcgcccagcgcctctcagagatggccgggaccctccagcggctccccgaggagctcgaggagacgatcaagtcatcctcgagggacctcgcccggggggcggtggagctcgtactggccagctacaaggccagggaccctgacttctctccgtgggcagcgctggacgagttccctcccggaaccgaggacggcgcgcgcgcgcaggttcgggacgccgccaaccacatcgtccacaacttcgagggtacagcccctcggctcgcgttcgccctcgactccgacgaggagggcggtgacggtggtgcggacgacagcgaggacgaggccggcgacccgggcgcgtcggagtgagcccccaggcccccgccaatcttaaatagcttttccttcttcttccgaggccttcgggcccccttcttgtatagactgatttaatctgtaatcaaataaaaaggaaatttctatgttaattctatttgttgtgtgtatgagacggggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtggcctttgccgattcccccccggagttcaccacgccccggggcacggctcggttctgggcccttttgtcgattttagccggcccgggccaccgagggcaggatcgagcacgagcgtgctaattcaagccaagattcttcaaaaggaaacaatggcacagacacagtccttaggaaatcgacaatgcttttattgaaatacgtaagataaagaagataagtatatgcatgtggtagcccccggccaaccctgcacgcccggggggggggtgcggggttggcccgagcccgagacctgacacccgacccccattaggggtagaagcgacgaaggtgttcgatgttccacgggttaggcagctctgtgccgtcgcccgtggccagccgaacggagcccggccgggggacaccgatcactcgatacagaccctcccacattagtgagagcttgctcagtccagcacgtgtttggacacggcgtaggacgaggtcgtcgacgcagagtgatcgggcccggacgtggcgctgatggtagcgccacaggctctgctggtagcgtgcggctcggagggccgcgcgcctccttcgctcttccaagtagtcgaggtcatctctgcgaagctgatcttgatcagcctcgcagtacatggtggcccgaggggacctcagggtgagctcagatgggaggaccgcctccgcgccgtagacgaggaagaaaggcg

SEQ ID NO: 50648 - DNA, 1228 bp, Oryza sativa
ccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccagggcctgccgccgcactttctgccggactggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgacgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaa

SEQ ID NO: 50649 - DNA, 2048 bp, Oryza sativa
tatgtgccctggaagttcatggtgaactgctggcacaaatcctcccaagagtggaccgacgcgggtggcaagttcattagccaaccccgcgcctgacctttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaatgctcgacagccggcaccgccaaccggggacacggggggctggcccccgtgcccggaccaaagtggcgctccggacgaggaagcgccctctgttgcgtgggcagcacgacgaccattgcgccggcgctcgacattgaggcgggcatccggccccccacgcacgtcttcttgggttggaggcgttgacgagggaatggcggacgaacggcgggtaacggccgctgctcgccgcgctctccgcctcgacgatgcggagccggtggtagcagcgccagaggccttggtgacggaggaccgcctgccggcgcctaggcgctgctgtgctgtcatgaccaagtcggccacatcatccagccaacgtcgggctggagtctctggatcggggacgacgggcgggtgacgcaggaacgcgcccgcagcctggagcgcgccctggggcgtgctgccatcgccatagacgaggaggcgacgctccccgtctcgcagtccttctccatcgcccgcaagcggcgaagtcgcggatctttcgaccctctcgagcgcctcctcccgctcaagacttcggcgagagggggacggtggagtacgagcccgacggcgcgggttctgctccccgtcgtcaccgctagcactcggagagaggttatgcgccatcgcccgttcggccattgggctgagcgggtgaagcttggcgcacacgaaagaggacgagggcttagaaagacacacgcgccccctacctggcgcgccagatgatggagcgtggggctcctcaccgggaggccgcgcaggcccccctttgccggttcggccgggggcgctagtgaggttctttgccctcgatctgtggaatattcgcgagagagcaaatgcacaagacacgggcgatgtagacaggttcgggccgctgagaagcgtaataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcattaatgggtgaagatttgcaatggctgctgtccgaatgaccctccgatgggatgggtcatatctacctccactccgccggaagcagatgcaacgtgggagctcggttgtctgccgatgacgtgaccggcgtcagaccagtcacagaccggtcattcttgtccaccacgtgtcagtttagcacgccgcacgtctgcccttcttcatacaatgacttccttgcaatggttgcgatgaagcctggaatgtatctggccgggactgacgtgccaactccaggagttaacacgccggctccggctagggacgagagcatggaggctctcatcatttcgatgggacggggcgaggcgtgtgacaggccgcctgttgccacctaacccgcgatctgaccggtcacacactgcgaccggtcacggaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggt

SEQ ID NO: 50650 - DNA, 771 bp, Oryza sativa
atccaaaagtttataattgcagaaactttatacttacaaacattctgctttaaacactttatacttcgaaacattataaacacaagaaattagcaggggatggaaacaaaacatgttaattaaaaaaaaaacctatcgggcgattagtaagtttatacaccttgcttggtttaattgatccatggtatcggatagaataccagttaaagagaaacagggaaatagactagtaaaatcattatcacaaaaaaaagtataccttcattttgtttattgcagaatctgaagactgttgtacttcaactctgttactttcagattctgccgagctgttatctttgcctgcagagtgctcaccagtggcatccttgcttggaacataatttgaaattgaacaatttgccttgctacagtccgaatcttcacgagaactaataccatgttcctcaaaatcatccatactgcccgagtcacgtaatggaattttttatctgcgcaacagttacatagacaccttgagctcctgaccaactgatttattagaaatcattgatacaagcagatagtggcaaaggaaatcaaaaaggttatgcaaaaaagcgaaacaatggaattcagaaaagcgcaaaaaaaagatactattcatccaggagattttattctgtccaagatgtctgttctctatgtgatgaaggtactctctccaccccttggttttcagacacatgtatgaagcatttttggtgacttggtgtactgagaattttttat

SEQ ID NO: 50651 - DNA, 720 bp, Oryza sativa
gagaaaggggagaagtgggagtagcctataggggagcggggggtgggatccgatcgcagggcgatcagccctggcgatcgatcgatcgcgcattagccccccatgcggcatgggcttatatgactcgggaaaatatgtggaaccccccgtcacccggtgataccgctcagggcgtccgcagtatgactctaccgctctacgcggctgacgaaacagctcactccgcttcccgagtcacgagcacgccggatgggcggcgccgcggcctttctttgctccgccgcacgtgcgcgccgcgccggcgccgctgctccccctctctctccgcgcagagccgcaaacctggcgcgcgatggccgcacgcgctccggcccccggcttcccgttccacgcgtcgggtagccagtggacgcagccgcaaaggaggagcaaaagatcaagcgccgtccacgtgtaccccaccaactccatgaattcccagggcctccaggtcgtcaccgatccgacgtcgcttacagccgggcccggaatctaccggcccaaccttgccagtgactaaccagaacgacgagtacgattagtagcccgattagataaagtggggactaatcgccaatattaaacttaacaggtggactccgctggtggcatgatgagctacccatcctcgccgtccacgtgtacacctcggcccctgatgccccgcaccaaccgtcctcc

SEQ ID NO: 50652 - DNA, 1017 bp, Oryza sativa
  unsure (1)..(1017): unsure at all n locations
cgcgaagatggccaacgtcattaccgcgttgggcgtgaggtgcgccatctggagatcataaaactccagaatatccatgaagaaattagagaatggcgggaccagccctgccattgcgaaagaaaggaagaagaccggaccgcccgggtagtgtggcgccgggcgtccctcgccccgcgcaaccacctcccgccggtggcagattccggcatgaatcgcgcggcagcccggcctgcctctcgctcacgatgcgggaaggcggcagcacgctaccgtcgagcggagcggagccccgtgccatgacgccggcggaggaggagcttgagagcgagtgagtgcggcaagggtagggcgcangaaacgaagagttagagctcaagtggcgaaggcaaggggaagaatggcgagaggaaggaaacgaatctcttcctcggcgtctttatacccttgccaacgctattcccggctcctcgtttcccgcgcccactacctcgccccctcgtttcttgcgcccgcgcctccactaaccccacttgcccgtttgcggcgcgcgcggcagatgtgcggccgtggcggttgagatgggacagatcgagcgcgcgttaaatacgctcgccgaccgagaaaagcgccatcatcatgtctacaggcgaaatgaaccggctcgtcccgattcgcgcgctgctcgagtaatgtagcggtctcgaagaggccactcattattgtcagtcggttttcccttgccgatgcgcgcgatttgcgaccgctgggtttctgcccgcctgtagggaccggccccacctgtcaccgggcctaaggagtggcgtcacgcccgagcgcttccctcgaagggggcaatcgccctggcgtaacgccgggggctactgtcggtgacatggggccgagggtatcgtgactagaggcttgggtagccgcggtcacccacatggcctgaccccctcgggggggtcgggcccgagggtgacgtggccacccctccctctgtctccccgaggg

SEQ ID NO: 50653 - DNA, 1095 bp, Oryza sativa
caacaactacgtatttaacatggtataaaaatattttcaaacataaagttgatatatactatatcataacagtaagtatatttatttaattcaaattattaattagttgacagccaaaagtagttttgtcgtgcacacacatgtccacgctttcctgcagtaaccctggccttggagccacagttcaagcggtcggtaaaattcgtgaagcgcgacgacgcagacatcgctgagaaggtagcggtttggggccgcctccatgaattcggtgatatggtatggttgccggggcagcggcaggtgatctaccgtgaggacaaccgtgtcaatatttcgacgcctggagatggtctcaacgactacttcggcttccgggcgcaaccgacgctaagcatggtcggcgcaagggtcataggtgattgaattctttatcatatctcaaaattttctgagatgagtagccagggtagaaacctctttttttttttttcaaaattttccgtgcccctttcatttcatattataagttgctatgtggtcggtagagaaatttactaacatctataactccaataatgttattacatgtaacattaaaaatatttcgataatatatttgttttcggtagaaaatattgctccaattttctataaatttagtcaaatgtaaaaaaagtttgatcaaaaaaaataaaaacacgttataatatgaaacagagggagtaactattttttttatttattttttttagagaagggtattttttatccggtctgggctctacatccaaccgaatatatgcagcctttttaaaattagaaacttagcctatcaaacaagatatacgtaactcttaaaataatctataatttaaaattcgctcctatgaagtaactatttgaacttatattggcgcagatgagtgtctagaagagaatccaatgtacactgacactgcccgatgcctagcatcccgtgctgtcaccaagatgttcgacctcctggcgtacggcttcaccaacgacggcgccaccttcaccgggtacccggtggtgggctaccagcaccgcatccagtcctccggctcgtgcatg

SEQ ID NO: 50654 - DNA, 784 bp, Oryza sativa
atatccgtctctctctctctctcaaactgctctctcctctctctctctagcgggtacgtggcggtgggcaccctacgcatcaaaagcggtgaggggtgacggctgcaacggcagtcctccctgcttggatcccatgaatctgctagcggtggcaggaggaggagcacggcggctgcggcagcggccctccctcgcccagatccggtggtgggaggagcttggcggtggcggccggctgcagcggccgatgactggcaggtgttttgcgatttttcctcagatttttgtattcgcgtacagacgatgtaagtacccatataaaaaaatagcaatttttgtatacccttcggagtagatgaatcagagatccacacgtgaaagtcacttttgccgtcctagaaaaatcgtttttatccggtgattgtaatctttaggacttggcgatgtgcgacggctgtctttgaggcatggaattgtcgtgcgctgagttggcttatttatggaccatttatatattcgccttatggtcgatgtacggcattgtttttatttggctaccgaagcaaattaatcggtacaacatcgaaaaagacagtcaaacataacaatataagtgcgacaaggtaaagttgaaatgacaggaacattatttttttcttagtagcaaaatattttgaaatatgacagcagcgtgtaagatcgaacatctcaagatcacaattacataacactgagccatattatttgttaacgaggcacaactttaaatgcatgaactactgta

SEQ ID NO: 50655 - DNA, 4818 bp, Oryza sativa
tgtggatttcttgctctgtcctgcaaaaggaccacatttatttcctccttcaatctatagcatcagttgcttgcttgcttggccaatgaaatgaggtgggttggtgatggggacattgagttttgttagtgcaatgtattatggggacatcagattggtgttgcaaagtagccctatcattcaaaaactaatatcgtatctgtagattgtttcttgttgtttctctagcgcataaaaaaataatctaacacatggtattgtactatcaggttgctgggctcaaacatatgcgaactttgatggagtggccaaaatgctttggtggctgttgggtactgtcatgtgcttttgaacaggttttaattatgttgtatgagatatgctaaaaaattatgttgtatgagatgtgaaggttgtaatgtgtttttataatatttatgtgctgatctataactattttgttactgatgatgagagaatgtcaactgatgatcagtaattaattttgctaaaattatggacgaaatatttgtatttgctaaatttagcagcagctgaatttttgttgggctaaaatctagctgtagcccaatttgagctgggctgaatgatgactaaaaggccgaaaaaacactaaaaaaaatcagcccaaaacaaaaaaaaaaccattaggtcataaatgggccgaaagctcttggaaaagaattgggccacaaaacacgtgggctaaatcctacatggcatcgatgacacatcagcgtccaccttggcgaacacatggcacatacgtggtgattcaatttcgtgacggaaaaatatcctacgtggcagctaatctgtgacagagaaatatcctacgtggcagctatccgtgacggttatttttcatcacaggaaatgggcttggctggactaactagaccacgggcttcatcgtgacggtttaaaaccgtcaccgattctgttaatctgtgatggttttcgacaaaccgtcacacaggtcaatccatgacgctcaatccgtgatgatttctgaaaccatcacagatgttgtttggtgacggtttttcagtgatccgtgacggaaatttttcatcatggattaacaggattcttgtagtgtgtggacagagaaagctttagtgaaacttagatggaagccagcctgtctgttcatatcgttatcttgttagggttggttcagagcatcagatttttctctttgtagctgctaatgggtaaagcttaaacagccatagattcgtatgatctgttcgagaagattgctgttgtaagtaagctgtgaagatgacaactgcacaatccatttgtttgctggccatgcggcacatcggcccataaaacatgcatgatgcccgtgccaaacataactgtagaacttgttgcatttgtattgaagttattagttatttgtttgattgctgggtctatgtctatgtctaaaaatctaggttggcttcgtctctttaatttaagtggatcagaagattttggctgtttcgtgcaaaaaaaaaatttgttgagatgcactatctcttccaacattttgcaaaatatgtatgttccttattatcagaaggaaatattctagaagtgactatctttaaatatgcgtgcattgtactgaaatgtaaactcttgaaaaagcgccgctcggggatggtactacctccgttttttaatagatgacgccgttgactttttctcaaatatttgaccactcatcttattcaaaaattttatgcaaatatataagatataaatcacacttaaagtactataaatgataaaacaactcataacaaaataattataattacgtaaattttttgaataagacgaatagtcaaacatgtgagaaaaagtcaacggcattatctattaaaaaatggaggtagtactatttataaccgagttacgcaaatattgcataaataaataacgtgaattgaacaggaggagcacaacatatcagcatgtttgcacgtaaaatatttgtagtgagaaagacatggttgaggatagggaagacaacttactccctccatcacacaaaaaacaaacttagatctagatatgatatattctagtacaatgaatatagatagacccctttttcatattcatagtactggaatgtgtctcaacatataaaatcttttatttttgggacggatgtagtagtacactactacaagttcatgcctccgctagtttgggtatgttgtcttattacattgtggctatgagaagttcttctcatgtttcatattaattactacacctgtttttgatattgagacggtaagagaatctcctttgtcatgacacattgtggtgctactgtgctaattgctataccaacgacaaaaatgaatatatagagcaactcgtatatatgtacactagtaggtcctccatagaaaacagttggctgcaggtagttgagaagtgttcaataacaatgagagatgttaggtatgtctgcttggtactatatatgcatatgtagaatgcaaacaattatgcatggacagtgcgtgcagcagcacatgttttccttgtaagagtagctaggaatgaagattggaggggatatatatcaatgagaaattgcatgcttgttctgtgcagatgacatatgctagcgatttcttggaatgtggggcgttaggaattctaattgcagcgtctacagctttagctgggttactcaagaacagaacttcatagattgcgctgagacttggcaccaagaatgcaaggggtctaaagacgtgaaagctttgagacgtcgaacctgagagataattagtcagactctgtgaagccgatcagttgatacgaaggagattacggcaagactattcagcagaacacaaagagattattgggctgcatttttgcagagtattgggcttcatttttgcattcttgttgggtagtattgtacagcgcttatttgtaggccgatagtgaggttctgtaattgtatggctgatcgattaaaaatggcatgtttaggtttgaataaacatattgactgcccaattcggttgcttctttgattcatcctgttggtactcaacctgtggtttcaaatataaaatctcccaccatatgtcatcagcttggcaagttggcagcggcattgtcacgctgttcatgtttctttctgattgctttgatgtatacagagaggactaaatgttgaatgacattaggaaaaactatatttctgttttttatccacttgtataaatggacatacgattagcggccagaaatattcattttacaaaagagtttcctagaagttccacgaagctctggcttcttgctctcgttgttacacgctggaacacgagagcaagcagtcaaacaaaaaaccttgaaagatcgtactactaaaatagagcaattctacggtacttgagaaggtaccataagataccaaaaatttagcgtaaaatttggtacttcatggtatcttatagtacctaggtacaaagaggtactaaatttacaatagaaaaaatggtacctcgtggtacctcctcaaggaccataaagttgctcactaaaatatacctgggaagttgatgggtggttgcctagttcgtgtgcggtttatggctgatatggctggttactaagcttttttgtataaatgccatgcccttgtttctatttgagaaatattgatcaatgaaagaccacacatgatttttttcttgtgaaattattggaattacaattttgctttttcactactgctagtctcaaacagttgtggatccttggaatggaaagcactaggaatttctgctgttccatggaatctatataatgtgggaatgtaacatcagctagaacgtattttttcccacacctataggattgatggagtcgtggtaaaagttacaggccttttgcgactacgcagacagaaatcttgagagaaatttaaattattttggatagaaggtgcctgccggttagctcatgtcatctattatatattaaaattttactaaacatgtcacaaatgctcttaagctaccatacaacgctttacaaatgctcctatgttaccacatgatgctctaataaattcgaaaaaaatagaaaatatgataattttaactattagatgatccaataaatagatgatcctttaaatagatgatccagtaattttaacaattagattaaaaaaacacccatatgccgccacccccaccataccatatgtacgcatgcacgtatactccctccaccctctgactctcctctcctctcctctcttattttctaagaaaacttctcctattttctagctaacaataaaaaaataataatcagatagttaaatgatcacaactcctgagttacatgtcgttttctcaatttgtttgaattgttgtgttatatataactaaatacataattcaagatacatattgcccatatttacaatatataaaatagacaataccataattctaactacaaatatttgggcaaaatttgcatttcagaagtgatgaatgaatcatcacgaattcaagtatatgggtccacaatccaggttcaaccaccaccaagcactactacagaaatgattttcctggacagggaccattttagattgcatgtgggcggtaactcgatccgcatgggaaaattggctcattttcctgtgcggtttatataagaggaccacacggaaaaattaattttcgcagacggacgtattaagtgaaccgcacgcaaaaatgagactgttttcgcagg

SEQ ID NO: 50656 - DNA, 900 bp, Oryza sativa
tattcgctgccacttcgccgacgccgctcaatcctgctctgcgagacggtgccgcacgcgccaatgcgacgccgtcctccggtcgtccgcccgtccccgcgacctccgaccatccccgcggcggcgccacacgcacggccaggccagcaggcagcagcttgccatcgcacaagccgcctaggcgcctgcactaccccagtggcccagcctgtcggtggctagccggctaggcagccaacctcatcttcatcagttaggccatgaacgaatagaattgtctaagcctcctagattccttagaaaggctcagtgatttatcagcggtatgtcttctcatatatttattattatttaaagattttatccaccatgctttatgaattgactcatatttacaaattgacatgtttattgttatcttttggtgtataatgaattatgtatggcgcaattttttttgtctgcctgaatttattgattatactatttttttatacgattacaatataaatatggtatttgttgtgtttagttgtccttatgaagcgagcatttccgccccaactcttttttaatcctgcgtctgccactgaatagtgcacatgtggtttgtcacctgaaaccaacacgatgcaaagaaagataggaaaaacatgtctgcctcgttaggacaacaaatatcgtgggaaaagattcatcttctggcatgagatcctgtgggaaaattaaagttttactatgtttcatgcttcaactatttcatatggtactgtaggctgaatcgacaaaaaacccattttccttgcacttaagatttttctttttcttgtgttgaacatagatcttttttcaattgatccactcagatcttgtttttctagtagctcattttctagatag

SEQ ID NO: 50657 - DNA, 2911 bp, Oryza sativa
tcatggctttaagcttatctcctacgcgtcggaaatggatcagtcagaacatcactgccggcgtactgtcgtcaccgccgtctggtgtctcgcctacacggttggatggtcacatgactgttgatgggcgtctacgtcttcaccaccggcttgcctttgccgctgccactagtgtcctcgcctatacggtttggttgtcatatcaccgttgttgggcatcaacgtcttcaccgtcggcctgcctacttccgctgccgactggtgtccttgattacacggttggatggttacaccaccgttgttgggcgtctacatctttactgaccggttgccttcactgtcgccatctgctgtctccgcctctacaagttgttggtcacacaactgttgtttggcatctacatattcaccgaccggctgcctgcgccaccgctgattggtgtctccgtctatacggttggctggtcacaccgccattgatgggcatctacgtcttcaccaccggcttgcctccgctgccgtcgactggtgttttcacctacatggctggttgatcgcactgccgtcgatgggcgtcattgtattcaccgcaagcttgccttcgccaccgctccgccgatagcagctgcgtcgcctcccgcgccatcagcggcggcgcccgtggagccccgtgcgctcggtgaggagaggaggggaggagaggaaagaggccgctcagtgaggggaggaaagaggaagagagagaaaggagagagaggggaggggaggagagagggtgtgaaaaatttgaagtgcgtgagagggaaaataggaagggatattttatatggctgtgcggttcacttaaaaagcccacacgcgaaaatcgatttttctgtgcgatccacttaagtcaaccgcacgggataatgaggattatcctgtgcggttggattaagatgcccgcactggataatctattttcccgtgcgggcgtccgcccggcgccggttgccccattatctcatgcggtcccaatcatggtccgcctagaaacaacagggcccagcgtacaagaatatcatttatgtagtagtgtgatggattctacggtggtgcactggagtggagaccaaacttgaggaggagaggaaagagatatgttagggaagagaccaggacagcaggattataggggtgggcataaaaaattgacaaccgaaagccgaaccggaccgcaccgtaacagaaccaaactgtcggtttttcggtgatcggtcttttctttcggtttctgtttttattactagaaaaaatgcctgtgcattgcaatgggaaaaaacatgagaaatttaagaaaaggttgagaaatatttacattatgtaattaattaaaatataaaatcgcaactatagatgtatccgatgtttttttactggaatacatttatacgatgttgaagaaaagaaagggtcataaaagtcacggtaaatgtggaaatagaattttccaaataaactatggctggatttaatttttattaaattctccatgattaattacactatgtgaaaaattttcagtattttcagagctccattgctaattttaataatacaaacattattttagcatttatttaaatgaaaatctaaatgaaaaccctcttttctcctgggccattttgagcccattttttctttagcccatactcctcccttccacctcggcctgaaagcgcgcatctggcccatcaaacaaccagaaagtctaatcagaatcccttctcctctccctgtcacgtgggtcccaatgtcacgtgggtcccaatgccacagtgtcgtctcctacctctgtccgactccacagcttcccgacgccgctagaaaccaccgcctccttcgatgaaatccatccgcattcgcggagataatccgaaattgattgaggggttttgatccttatctccttctatttcccttttccaagaattagagcaaaatcgcatcgtatcgatctcggaatcaagccatatagcaaaccctagagttgtccgtttcacatactggagggaatcagactgcgcgacgtatgaaagtcttcggcaaaaatatcttaaaacttttataataggtgaagattcggtgttcggattcatgtgttttaatatgtggagaccgaagaaatcggaaaaccgatcaatgtaagtctcataattaaattcattatattttatctatagaaaaaaattcttacaattttaagagtaatgatatgtcagaattttatccattttgttacggctattagaaaaatgtgcacgaagtgtgttgggaaaacctatgtgtataagatattttcctcacttattagtagactgacatgattgtttgtgctaagataccagaaagcaagctggtcgttgagctattcgatggactctttggaatcttgttattgaggagtattaaacgtagattactaacaaaacctattttataagtcctaggctattttgtaagacgaatctaacgaggtatattaatccatgatttgctacaatgatgctacagtaatcatccactaattatggattaatatacctcgttagattcgtctcgcaaaataacctagaggttatggaatgagttttgttagtaatttacgtttaatactactaaatagcaagattctgtaaggatatttaatagcctgaagaatccaaacatgcccataatgtgactttgcttggcagctactggtactatatataaaagaaatgttaatcatggtaacttggtaagcgagcaattttttttttagctagggatggagacggattgtgaaatattaatcctttggctctgttgttgaattgattattagtggctgatgagtgatatttggtaggaggggtgaacaggtagctca

SEQ ID NO: 50658 - DNA, 1108 bp, Oryza sativa
gtactgtttcatattggtcgagtgttgtagcaggaggcatacaacattctcctattcaaccgaaatagtctcattcacttaccaaagaggcttttactcacagcaaatacttctcggcctaatgtgacaggaaaatactaaaagactgacgcacgcggtaagaagaccagtctagaaaggagtattttagactaccacaagagaaaaataccattcaactaggtagatgaagcctgaagttaaggtcgttgagagagtaatattccccaagaatatatagtggggagcattccaaccacccccaaagctagcacaaggtgtttcgagggaccacacacatgtgcaaccatacccctttggatttctaactttacatgggtattgtagtatcttcctgtgtatccttggggtaggattgtaatatcacatgttccttggaaggctatataagctggtctcaatataatcagacacgagatgagagatatcagaataccataagacacatgagactccatgtcgacaaatattggaccccatgtcgacaaacctgcaagcctcgtccatccgcacactactcggcccagcctgctgctcggcaggatgtgtaagcatggcgtctagagtggcgtggctaattcgcgtgcacgcgccagcaacgttgctggcgcgcgtgccaggtggcaggattgccccctccccgcctcgtgatttttttcgctttctcacgatttttttcgttcccttttacgattttttctgattatttttttaaatctccagtacacgtgttttcaaatattttgtgttgaaagtttttaaatcttaacttaaaaattttcaaatctggacttcaaagttttcgaatctcgagttgaaagttttcaaatctgagttgaaagattttaaatctcgagttgaaagtttttcaaatctcgagatggatgttttcaaatcgagttgaaagttttcaaaatttgtcttgcaaatttatattttgagttgaaaattaagttttcaaagtttgagttcaaaattttaaaaattgacttcaaagtttaaatcttaagtcgaaagttatcaaatataattttgatgaactactgta

SEQ ID NO: 50659 - DNA, 1148 bp, Oryza sativa
ccaaatcggaaggaccatacacgatcacacaagtcttgcggacaggcgcattcaaaattgcagacggtgacggtcgcgagttagcaaactctcggaacattgaccaactacgtaaattctatgtatgagtcaatagtatccatgcctgtaagacaccttacagcatcaataaagcctattttcaggcgcagattacaatcaaagtgttactgcccgatgaccccttacccagatgacacctagcgttgaaacctatgcttatgtccctttacgccggcttgacaaggcctccgaagaacctaagagaacttcggctggggacgcccagagccgataaggccttgtcggatcctgtagagacgaaagaccatgtaagacctggtcgtgtaagagttctagccgtgcgtattaaccaagccgcgtaatcggaaattaactttccaacttcacggctgggggctaggatcagtgcttgttcaaccgaggcaggtcataggtccaagagccttgtcccccgagaagaattcttcgacgaaaaggctggggctagggagagtgtacgactcaacgactgaccaaagtcgtgaactgagaaaacactcttacacactatatccagagtaagaagaattcatcaggatagatttcttttctatttcgcaaaatacttcttacaactttacacaagtccaaaaccatattacattttttctaagatatctatcacagggtacaaagactaccaagaaggccaacgccagtccatagactggaaaaccttttccgccagcggcgccatcgacttcgccaggtggtctatctccgccggagtcctccgagaacgagcgaacccttcatggagaaactcgaggtgcaattgcggatgatgatctcatatgcaagccaacacatgccctccagcatatcggctcgatcgacggcattcctgcttcagggcttcgtcaatgcgcaggccgacgccttcgagctgagtacaggccgacgccgccactgtcctcgcctcggcaatatcgcgacttatcccgcgagcgccagcttcgaggaggtgccccatcccgacttggagctccccccagctgaggacatcggcaggcgggccgcgaacaggcccaagatcaccagatagg

SEQ ID NO: 50660 - DNA, 1028 bp, Oryza sativa
tctctaaaaagatacagtatccccaactccaccgtataggggcacacacgtaagtacgtagtccctcaaccctccaactctcctcggagatcccactctcctctcctattttcgagccaacatttcctattttctaactaacacataatatatatatagatgataataatcagatagttaaatgatcatgactctcaaagttacatgcacttttctcaatttatttgcattttatcatgctatttatagttaaatacataattcaaaatccatttacccatatttcctatataaaatttagataatgtagttctttctgactacaaatatttgagtctaaattccagattcaatcagcaccaaagagcttggaaccatgatgcataccctggggcctgaacttaatggaggcggagttgcaagatattattaggttgtattcattagatgggtttgggagctaatctctcttacacacataaaacaaagcggctcattacattagagtattattaattaaggattagttattttttataaaatggattaatatattttttaaagcaatttttctatagcaaacttttagaaaaaacaccgtttagttgtttggaaagtgtgcgcacgaaaaacgagggagctaagtttggaaaggagggggaagaatacaaccttagcgaggtggacaccgatggaaacaccaacatcgactttccatgacttccagaagctcatagcacgctagatgattatatcaaggacaaagaactgagatgaggtggctagatgattatatcaaggacaaagaactgagatgaggtgcagagggagatgttccgcatcttcgacaaggactagaaaacaacttcatatctatcgctgaggagttcataattaaattcagaaaaaaaacaatttgattaaaatgcacattcaaaaatttagaaaacccattaaaactatacaaaatgtataataaaataactattaaaagatgagtccctatacaacacgatacgagattaagt

SEQ ID NO: 50661 - DNA, 4965 bp, Oryza sativa
tttgacatctccacgatgacacatattgtacaaagttgcaaggcacaacgctatgacaactcaagcttgaattttcttaaatgcatgagaagcgtccacgatgaacctaaatatgtacaactaatgtggtgattgaatctcatgaagataaagattaagtatattatgcaaatcgaggtagtaataacgtgtgattaattgagtttatattattacaaacttaaaaaatggattaatctgatattttagaacaattttcatatagaaatttttcgtacgaaagacaccgtgttcccagtaatagcaaaagtttatccaacttttgttggagattcgaaaagggcctaagttcccggcaatagcatatcacggttatcttcgttgtgtgagttgtgtcagcacattcttctcacaacacatggaccagcgtcttcattatgaatggctcagagcttgcaactcaagctttcgcgcgccccttgcacagttgcatattcacagtggcaaatctcaattcaagctatcatgttctgaaattcctaatgcccccattcgaacaagttcccagtgtcatctgcacatcagaagcaatttgtcattgggagctcctcagatatttcactccaagctagtcttacaagacaacatgtgactgatttcaactgcaccgctgcacacactgttcatacacaatgcttacttttctgaagggtaccaagccaagcagatattataagctatctagtaagtttatcatttttattgaacacatctcgaccaccagcgtgtgttttgctgttgatgacctaccatggcatacatataccagttaatttatatattcattttaatgttttttttaacattcattttaatgttggtgatacggtagcactgtactgcgtaatagcacctgatcaggttatcttactacggtgacaacaagtgttgtactttttaatattgaccaacgccggattagttcaaacacagaaacaatcaggaaagccagcagccacacatcttcaacatgacattccctgtggcatggcccactagtgcagatctggtcatctgtgttaggggaaccttcatttgtgtcggcgaacggtttggtcatggattattggtcaatgatatgaaaactcatatgtgttaggccgggagccaccaccgattgcggtcatctttgtcaggcccaaataaaagaccatcgctaatgactctcatctgtgacgggtggtagttatgatccatcacggataagagtcatccgtgacggtttgtaattacaaacattcatggatgagaatttactttttttgaattttaaatgcatcaaaaaaccttaaaaatattcaaaatattattatgatattccaagtttccaaccatgctcacacatcactagctagaaattcatgaactttcaagtgatatgtgtatgcatatgatacgtgcgattcaaacctaaaacctttgaacacatgcaaatcaatcttactatctcacatatagatcacaggacaatcggtcatcagatattattcttttaacttttcctctccaaatataaaacacaaatttgaaactccagatttttcatatgagaacgtaactacaaagttgcagatctcatcgatttctacaactttagtgtagggtatatctctatgcagggttgtttgagaaattcagaaatattttagaattagatcacatcacatataacacatattcgggtatttcaaatttttgattttttttctcatccgtgacggttcgtaactaccacccttcacggataacgttatccgtgaagggtggtaattaagacccgtcacggcttagtgctatcatctttgacgggtcatctcattacatccgtcacaagtgatttgttagctttgacggggtattgttgtgaccctttatagtttatctgtgacgtgttagaactacgacccgataaagatgaacttatatcggtaatgggtcattcccggtagttatattttaaaagggaaacttattgagccattagagatgagtcatccgagcgagtttgctacatctcagagcaagatgtgggagtctgggtgcagccggcttgccccgccagcccgctgtgcttgcccctgaaccccgggtggatcatgagctcacgtggcgacttggcaaactggttgcaagttcataaaaacatgggaatctaggagaactaggaaaaatattatgacatgtgtctgatcaggaatctactgtaacttcaacaccgacttcaagtaggtggcagcggttgttcatggttagggcctcggtttttttctgatgggtattgtatatatgtatggcgagatataattaatcaatgtttaattattgactgtttcgggaacaatcctgtgtgatggttaagaatggtaattcctccgtttcatattataagactttctagcattgtccatattcatattgatgttaataaatctagccacatatatatgtctagattaattaacatacatatgaatgtgggcaatgctagaaagtcttataatatgaaacagatggagtatgtaggtttctttttcggtggcaacgttaattttgatagcactattctaaaattttagtcctctttgaatcgataagcaatgagaaaaaataaacatgaatagtgtaacagtgcccccctgccaacttgcgcaagttgaaagagggagattttatatttgaaagcacatgctaattaccaacatgatgaatcaaatcagcaacggaacttggctgtcactatgtttattattcaaatcggaacatgcatttcttcatggacaagccaaaaaaaaaaatcttactatcagcctgcaactaattaatcctcttcgtatagtcgaacaacttgggtcttaggtccagcggctcaaagctttcgcgtctttaaaccgcttgcattcatagcgccaaaaacgattcaaatcctgccattagaatttctaatgcccctcattccaacaagctgccagcatcatcatctgcgcagcacacccaattgctcactggtatcccccttcaatctttattcctagctactgttacaagaaaaaagatttgactgactccaaaagcactagctagccgctgcacacacgcgatggccgacgcacactggggtttgtttttttacttatacatagtaccaagcaagcagacacttaataactctcattgttcttgaacacatctcaaccaccagacagctgtttttgctacggagggcctaccatggtataacaattagcatagtagcaccatacatactgcgtgaagattgtgttacatatctcaatataaaaaacaagtgtaactaactaatgtgaaacatgagaacaacttctcacagccacagtgtaatcagagaaccggcccaaacaagctgtgtaggatcgaaacacaagaactaagccatcaagagagaggtaaatggttggtatagctaaaaacccaaactttcagcggaaataaaagttaccctcaaattcgatggatcgcggtctgaccgaaagtgtcgcgtcggtctgaccgtctggaagccgtcgttctgaccggaattgatcgctcggtccaaccacctaaagatcgcctctgcctcctgtcatcctcgtaggtctgaccgcaggtctgccactggtctgaccgccgcctagcgccggtctgaccatcggtgagttgccggttagaccgccgaacccgacgaaacacaaatcgaagaactctcaaagtagatgataactttattacttctctctatgtttacaaagtataacaacatcactccctataaaaatctcgactaaactagaaaccataactaaactatcaactcaatttctcttaaaagcgataccgcgaagcctcacgctccctctctatttatatatgaggtaggcagcctaaagccacgaaccaaactcatactagaagtcctaatccacctaggaaaccttcccgtacaagaaacaaactttacaaactccgatcataccaaatttggactccttccaaattcgaatccgcatcccatacgcacataatacctccatcgtataccatatggaatcttcaccaaccacgtgcactgaactctacccttagtatcccgcatgatatctgaccgtcacggacatcgtcttatctccaagctgactcccgatccatcaccggcagtactctcccgaggcatgaagtcacctacacatgaatcaaacaaataaactatattccgagaccaagctatctccaacttgactcattagtagcaaacaacagtattacatacacatagtatccatctagaagctataaatataaaacaatcatagatatccaaacaaacaacccgaaaccgaaactgacacagaatcggccggtcagacctcgggctgggccggtttgactgcgcgatacacgccggtctgaccggcagcacatgcccggtctgactggaccaaatcaacagcagtagttcctattcacctgcaaattccaatcatctctaaaaccacttcgtaaataaattccaaatatcaaaaccaataatcttatatgccaattgttcatcacagaataataatccaaaacacctttggttttacaacaagctgaggcatgaacatgtagctgagtacttagctggtttcaacaccggccacttgtccatggtggatgtgtcaatgagggcgactttatatgaatttcttaattcttcagtgatggtctcatgtaaaaataaataaatttctacataattgatttttggaatattttttgacgaaaagaaataagcataattagattgtgcaaaatttttatatttcgtttctatgagaatgtatttagctagtgattgatgaaattcttcatcctttgaataaaaatgtgaaaattagggaacatctaagt

SEQ ID NO: 50662 - DNA, 965 bp, Oryza sativa
caattttgtcttgcttcttcagcagagcgaagaaggggtgtcctcgttctcccatcctagcgacgaacctgcttagtgctgccatgcatctggttagcttttgtacttccttgagtcttgtgggcgacttcatattctcgattgccttgatcttctcgggatttgcttctattcctctgccagagatgaggaaaccgagcagcttgcccgacggtactccgaacgtgtacttctctggattaagaatgaggcgatatcgtcggaggttgtcggatgtttcccgcagatcgtcaatcaatgagttgcttgtcttggttttgacagcaatgtcgtcgacgtatgcctcgacattgttgccgagctggtcactaagtgcgccctggaccgtgcgctggaaagtattccttgcggttatcagtccgaatggcatcttaacatagcaaaatacctcgaacggcatgatgaatgctgtcttctcttcgtcctctttcgccatgctgatttggtgacagccagagtaagcgtcgaggaaactcaacagctcacagccggctgtcgagtccaccagttggtctattcgaggaagaggaagtgatccttgggacacgccttgttgaggtcggtgaaatcgacgcacatcctccatttcccgttggccttccgcaccatgactggattggctagccactctggatgaaatacttctctgataaagccaactttgagaagtttgtcgagctcttctcatatggcttgttttcggtctggtgcaaatctccgcagtttttactttactggcttggcatcgggtcgcaccatgagtttgtgctcaatcaactccctagggacccccggcatgtcggacggcaaccaagcgaacacgtcgcggaggaagatgatgagcgcgagttcctatttctcgcttagtgatgccccgatcttgacggtcttgttggggttggcac

SEQ ID NO: 50663 - DNA, 741 bp, Oryza sativa
tgcaagtagctcatcattttatatatgtaggagaatgtttgcatgtgaattaaagccgttggatctaattgcaaagacgagttgagggtactatagaaaccaaagatgtatgtatagaatgagggtgttgggtagtatagggagagaggaatgctgtaatattgacacattgtattgagtcttggggccggtatatataggaatacatggattggatcttaagtaaactcagatagatagagatcgaaactaatcctatcctaccataacaaactggatacaatacgatcttatccatatactctaacatcccccacaatccaaacgtgagcagcgcggacacttggactggagaagaaactagcaagaatgctcaatacggatgatagccctttgtgtagtagttgacgtagccaaagcaaagggtgcgagggagccatggtagatgaagccgtgcgtaaagttgacgtggtcgatgtagccaaaattgaggagccgatgatgtcgaggtagtcgagccgtagggcacgcatggggcgccgtagagtggtcgtggatgcacgggagggcgtcgtggaccaaggtgcgtgaggacgcgctggagacgatgacggtgacacgatcgtgacaatcattgaggtagatgatgccgaagagccgatgtagtcgaatcgtgaaggacgagacgtcatacagggtttgccagaccccgggacaactcgggacgaacgcgcgtgctgg

SEQ ID NO: 50664 - DNA, 789 bp, Oryza sativa
agatcagatcgacgacgaccgtgggagatggagccagcaaggagatgacccccggtgaccgaggtggactcgtggaggtagctggtgctgttgctgtttttgcgacgacgcgaagaccaccacgcgatgaagaagtagaacacgaagacgacgactaagataggaaaaaaaacaggtgtccacccacgggagatcggaactctcccggggcagcggcggctctaggtcgcctgctctgatactatgttgaatagtatagggagagagaaatactgtaaatattgatacattgtattaagcatcagggaccggtatatattgtaatacatggattggatcttacggcccgtttggttggagggagtttttaggagggattgggagtttaaagagatgaggctattaagtgttttgtttggttgggagacatgacaattttggtgcgataggaatggggaattgagggaggaactctctcctttttaatacctgggtagaggcaggtaattgggagggaattccttctttactttgtctaagcaaatctcagccatctgtttttattaatgacctaatctccaactaaactctctatcaatttccatcacatctaccaaacaagatattgggattaaaaatcaaattctcatcttaatctcatcagcaattcccttgtgtaaactcccaatccccttccctcgagttactaaaccagccgttaggtagatttggaaactaatcctattctaccataacaaaccggatacaatactattgatgaactactgt

SEQ ID NO: 50665 - DNA, 1005 bp, Oryza sativa
aaatattaatatcaaaagtagatcaaaagtagatgaagggagtatctctctaagtgaaagttggaatgtgccacatcatgcaatgaatattggccatcggattcagaaaacgacaaactagccagagggagatggtcatacacgtcggctcagatgaatggttaaaatgaaactgaaaagatgcaactagacgagtcagggaaaaaaatcacttctctcctcgtgcactttccgccattgccgccggcgactagtcgacccctcctcctcctcctcctcctcatcgccacagacgcaacctaccatccttcctgacgccattgccgaatgctccgtggggggaggatgagactcgatgagggggctggagaggagaggcgaatacgacacaccaccagccccatccatcatcacgcctcctcagttttccccgcgcagattcagcctcccatcccccagcgacctggcaactatggtggagctcaagaacctgtaaccggtggagaatcggcgtgcgccggtgatcgattttggggaggaggaaaggacgagcaaaggcacaagaagagacagcgagatgggtctgggtaggagacgttgttgggctgttgggctgttgttgggcttgtcctacggatgtgctgttcctcttcaaaaggctcgatggattgtcgtgggatggaaggccgcattgtctgttgtaacaatatcccctcattctatgaaatttcctaattcgggcgacgggacacgtggcgcgcgcggagagagaggagagggggcggatggaggatggcacaattttcctttttttttcttttctagtttcttttccttttttttaggttctttttctgtttttcaatttttaaataaacttttatacacgtatacaaactttatatacgtctagacatgtatatgtatgtcagggttacgggttaggtagaccctttaccgttcgatatacgttacatatcgatatggcatgcccgcgcatatatg

SEQ ID NO: 50666 - DNA, 1424 bp, Oryza sativa
ccaaaagattgtcaattcagttttctgctgacgaagaagatggctaaccaacccgccggtttcaacggagagaagcatcaaggcaacaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgcaactccctgcaatcagaagcttgctcctcaacgaatggtcatccatgcatcccgaagcagtcctatagcccgcgttgcaacagctccaattccaatgagtgcactaccacaaggtgtcaatgctcaatttcagccccagccaccagctgacaagacagatgccagtatctgcgttgtacctttagaagctccaatacagcagctgagaaatcaagtacaagatgaagaacccgagtgtaagaaagttattgtttgtcacaactgcagtggagaagggcattactccaaaaactgtccccgacctccacattttcgccaatttacacgaagcagacattccaatcgtattgtggtcactggagcaaacgccgtacccgtaaggcctcgtgttaatcagaacccatagcagaaacaatgcaccaatgctccacctgctgcacctgactcggcaataaatcttagcaaccattctctgcaacgacagcctcagcaaagaattgtcgtagatggaaggagttgtgtctctccccgacctactccaggccgagccaagggcaatcaacctccggagggcgataccaagcagaagaccgtcatccgctgcaaccaacaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagtccgctacttatcatggtgtaatcgaaagtttgcagcaatcatgaaattcataaatataatcatgtctgtaaacagtgagcttgctatgtttagagatgattcatgttgaggatacaatgtaccgatgttaagcaccgtcccttttcgtttaaggcagtgcctcgtattcatgtaatgagggagaaatgtgtaatacagacaagttccatgaggattcgtttgaaagatgcggatatgtgatcatgtgtataattgtttactgacataggagacctagggtctcatttcagaggaactgtgttccaacctcgagttaataacctacctgttgatggaaaagaaaaccaattttgctgtgttgggttaaaaagcccgcgatacagtagttgaggatagga

SEQ ID NO: 50667 - DNA, 3262 bp, Oryza sativa
tttaaaccctccccgagctccgtctttcgtttccgccgctcgccgctcactctcgccgtcggaatcgtgctcgcgccgtagcaccttctctccgccgtcgccgccgtgcttcggttagccgccgccgccgctccgctcctcctcccgactcggcgacacctccctcggcatcgccgcatcgccgtcgacctcgtccgcgcctccgtttcgctcgccgaccgtcggagcaccgtcgtcatcgtcatcccgagccgcgccgccgtctccctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgtcgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactccccgtggacccggtccgcgcgtcccctccctcggctgacgcaataatccgttttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattgttattgttattgttattaccttgttcaccctagattaaacaaaacctcaactaggggacactctactcatggttccattagtatgaacttaggtagatgcttcactggttaattaggcaacattaggtggtttttacaactttagacttgggaaattctcatatcatttggacactgtggaattgttggattatgatggaattggacatacacctctattcctctttcaaaacccctaaaacctgttttcggtggggtttgggtgcatgccagttatgggaagtggcaccccggccactataaggactaaagctcgggcctctgttgcaaagcactaccgtaattccacatgtctaatcggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcgagggttggtgcccaatgctaggggctcagttctacctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagaggtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggaaaagccaagtggataaaacctaaggacatattttataaataaaaattatttgcgaaagttcctcttttctccttcccccaatgctttttgcaaaaggtttactccgttcttccttcttcggattttcaactagtactagatggtcaggtcagtgaagaagaggacatcgtcagttgtttgccgaagttccagaagactgcaggatctgcgagtgaagtggaggaagcagtgaagccggctgtgaagcaggagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaggacattggtacctcaagctcccgagtgaatgaagcacaagacaccagttgtgcggcagtggtccaacacctgattaaccagaacaaattgcttatagagatactacagcagcatcggatgccaattttgaacccgagtcagatgcaacctcaggtgcagttggaggcagtccacgcactcacac

SEQ ID NO: 50668 - DNA, 2675 bp, Oryza sativa
gtctggtgctccgcaatgaaccatgctatacaaaaggtaaagccgttgcccacgctggcttggggttggcacggttaatgtttcacaatagtagctcgcgaaccggtccttaattgtcatgagcacgactctcaaaaccatgtgctcacaacccaccattacaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacacaaggtatcaaggaataaagtaatcaatgcaaacaggccataacaaaagaatagattcacaccacccagtgacattcgaaaataaatgcacagttgaaataaataaagaatttaaatataggatcaacatgctcaaaggattgtgtttaggatatgtgtgacttgccttgcaatattcggtcttcaattaatcttcttgaacacttctgacgcactcgcgaaccttcaaaacgatgggaacgacaagctaacacgcaaaacgaggaaaaaggataataaaaaccaaataaacaatacatataaagtaaacaaacatgtagatcataattttagatgaattatgagacttgaacggcctcattctgacttcatatgaatttattatgaattttacaagattaaatctaattaaagcccacttaaaaagaattaaataaatttaattctatttatggataactttaatatgtagatctttattttataaaacttttgcaacttgaaccacattaaactgagttacaaagaattagttatgaattttcaaagattaaatcggattaaagcatttatatagattttaattgaattatgacgcaataatgaattatttttgaaaaggaaaaggaggattattgcgtcagcgggtcgggttcacggtggaccgggtgcacggctgcggtctatggatcgggcggccgagatctaccctatccacaaagatcggccgagatctaaacggtctacgatcggtataaggcagacggcaacgatgacgtcagcgatgacgtcatcaccggcgacggcttgggcggcgcatgctcgccggcgaacgacggcgcgacgacgcaaaccgaggacaccaacgggtagagggcgacgcggcgaactcaccgagctcttggacgacgacaaacgacgacggatgacgacggcggcgaggttgaagcggcggcggtcttcgggtcgacggtgacggcggtgctccggcgtgctacagcggcggcgaagcggtggagggggacggcgacgacctcgtgatcccgatggtggcgacggcgaccgacgacggcggctgcaacggcggcgcggcgcggctgaaccgacggcaacgacggcgacggctagggctacgcggaggcggcgctagacgcgacggtgggctaaggcaaaggtggcggcggatagaggagagctcgggggtgcttttatagtggctaggaggcggcgacggaggcccacggcgaccggcggcgagaaggaaagtctagggttagagcagagagatgaatccgaatccaactcaaatcctccggtttccaaagaaaattagccgatgtttccaaaagagaaaaggaagaggagatctcaaggatcatttgccctcaatcaatttgaccggaaatagagaggggcgacggaatttggaagggcagcggcggcggcgcggcttggctagggttcggccgggcggctcgaggaggacgacgaccccgacaggtgggtcccgcctgtcagcggctgagagagaggagggaggcacgcggcggactgggccgactgggccggggagggagagagaaatagagaggttttgggccggctttcggcccaaagccaaaagagacttttaaaaacctttttcgatttaaattattcaagaaatgcgattccatttattaaaaatactttcttggctcaaataaatcccagaaaaatctaggaactaaagattcaagagaagtatttaacaaaattttatctaccccaattttatattgagatttagcaaattaaaattagatcttctcttttaggcttttaagatcatttctaataattccttttaaacaacaatttaaggtttttaaacaagaaaagcttttaacaattataattagatcattaattgattaactaattactgaactgttttttgtatcatttaggaattgagctccgaaaaatccgagaatattccagagagtataattaaccatggagaatttaataaaaattaaatccatccatgctttatatttaggaaattttatttcccacatttaacttcacttgaaaattaaagaacatttaatataaattctaataataatttattaaataatttataaatcctgaaacaaaaatcaggatgtgacaatacccttatgaaacaatatgctcttgagttggttagttcactctctccataatatgtaatagtcttccgttcctgttttagtaactaactatatttgaataatgacaagatatcgatagtatacatgagagcaactaaaagaggtttgttcatcttgg

SEQ ID NO: 50669 - DNA, 3076 bp, Oryza sativa
cgttgagaaaatatgcatcgggtagcgaaaaaaggaaacagaaaaagcgtttgagatgttcaagcatattagagatgtggattgttatcctaatctctccattgcttatcagaatagttctatttgaagttttaaaatgttatatatagataaatttatcacatcgaatattaaatgttgtgtttttatgagactataaatatatatattagtttatgtgtatatatatataaatgggcctcccctggtccgcatagttctgaaaggactgcagtttttaccacgactccatcaatcctatagctgtggaaaacaaaacgttctggctgaagatacactcccacaatgcagtgacattagggaaaagaggaaattcctagtgcttcccattctaacgatgcacaactgtttgagaccggcagtacagatacggatgcagcatttgtaattccaaagaacttcacaggaaaaatatcatgtggcctttttgccttgaatatttcttacacaaaaaccggtgcctactatttatgccaatatacactagccataaactgcgcagcaagaacccataaaacttcttatgcatagtttagtactacctccatccccgaatatttgcatttcactattaaaattttgtaaaaaaatgttatttctattgagatgggacctaataaattaattagattgatatactaattccctcacccttgttattagtcaagtttgcaagtatgtaatgtgtgcgtgcagtgtggtcatttatatgtggtgctaatctgtatgtaatatcctagaaatgcaattattcttggacatagatagtataatctttcaatttcacacctataaactataattcaaaccacatctttcaaacagaattaatagcataaaaattttgttccaccaaaaataaagaaacaattaataccaacatatttattttctcaatcttacgcgtcatatttttttccacgataaaataagattcaactttcacatctccacgatgaccttacccgggcatggccgccatgctcttctcccacgcctgcgccgccttctcgaacggacaccgcgagtcgaccaccgtcctgagcttcccttctccgacgagctccatcagaaacctcatctcctccttccccagcgacatgagggccatcatggttatcttcttcctggcaaacatggtcagcatcgccgcgacgtagttcccggggtttggtgttatgtccaccaccctaccacggctgctcagggtcggcttcatcgccgaccagttgacgttcatggcggtgttgatgatgtagtcgtacttctcgtcggaggccgagctcgtcagggcggcgccttggggggtattgtagtcgaggacctcgtcggcgccgagggagcggacgaggtccatgttgcgggcgccgcatgtggcggtgacgcggtggttgccgagcttggcgagctggacggcgtacgtgccgacgccgccggaggcagcggtgatcagcacgttggcgccggtgccgccggtgccgtcgaatttggtcccgatggacatgagggccttgagagctgtgaggcctgcgaccggcagcccggccgcgtcgacggcggaaactccggcggggcggacgacggtgaggctctccggtgcagcgacatactcagcgaggcctcctcctttctgtattgcaattattattctggtgagaattgatcattttcttgatgagaaggttaagcaataaaattgttacaaactctatttttttaatgtacgacggcgttaacttttttataaaaattagattatttggcttattaaaaaattttgatgataaattaagtcataataaaataaatgattttataaacattagattatttggcttattaaaaaattttgatgataaattaagtcataataaaataaatgataattaaattttttagatataacggatggtcaaacatatctaaaaagttaacgacgtcatgtattaaaaaacggagggagtattaaagaagaaatgcatcagaaaattcaggtgctatacatgagatgaatcatgaacaaactggatgtttgaaattacccagaagttcagtttggacaaaactttgtcaccaactttgagctcatgtactgcagaaccagcctccacaatctccccggcaacatcagtcactgtttcatggagtaaattgagagatgaactaaataatattagattatccattggtgttatatacttcatcaccggtcaaaaactgaattatcttcataactaagagtgtgcattactgaaatagacccgttcatttgcaatcaattgcacataaatatatgtgttgtacgaagagtaccttttgaattagtacttctgtctagtttcataaacaaatggtccttactaatgggtaaacacctggaataaatggaaacttgggaagaaatgggcgtagcatccctttctgaatactccaatcaatcgggttaacgcttgcagcttcgactttaataagaacttcatgtttcttcaccgaaggaacagggatttccacgtgctgaagtgaaactaaactgtatttaaatcaataatagaataaacaaattttacatacacatatggtgtgttcaatattttcttcaaaaaatcattgctagctatatattctcactttgatgaaaatgttcagataagtcatgtcctggaagtgtcgtctatttcttggaagcaactagactcatgaattacagatgaatcggaaaattgtactagaaataaacaaagttcaatataatcgacaaatgcaatttttccaggacaaaacgaaaaagaacatgatcaaattttatgtcagagcagtagtgcagaatatcctacgaactcgatcactcgtagagcattaaatcaggaggaagaagaagatagcaaaccttgagggcaccggcgccgccgccgtagccggtgtactgcaccgcgcgcatggtggccggaatcccgccgccggcggccataatcccgagcaattcctgaatttctcctgttgtctgaacaagtcaatc

SEQ ID NO: 50670 - DNA, 894 bp, Oryza sativa
ttctgggtccgttacgcgcggcagtttttcagacttcagtttaaactcactcatgaccattgggcttcacacgatgttctcgactatgtcctgtctctacggttcccacaccaagaacggcatcagcctcgacatcagaagtcgcgattggttacacgagctcatttaagcagaagtcgggggctactgtcagggttacgggttaggtataccctttacccttcgatatacgttacatatcgatatggcatgcccgcgcatatatggacattctctgcatatactaaggaaatccttcacggagtttgcagaaaataagagtcctactcggacaagactgggtcgtcaatgtatcgtatagggctgatgtctccgagttctacttggaaaccgcttgacctgcgatataaaagggaccccctgggaggacttaaggcatcgaatctcatagccaacacaacgaccacagcctacgaagtcgaagcctgcaggagccaaatcgccgggagatctagtcgaaccaactcgattacaatctcgccggtgtcatcgagttccatcgttccctttgtaacctatgattttccatcatataatcccatatcaactggattagggctattacctatcaaggggcctgaaccagtataatgctcgtctttttgtttgcttgatgtcgtattacgtagatccttgtaccaacgtaccccaatattctctatatccagtctacgggtatcacccgtcgataatgtacatatacaaagtttgtatatctttttatacgtgtatatatgttttatacagcaaaagtgtatgcgcatacatgtaaaaaattgatttacgtatatatacaaagtttacacacatattatattatatatatatatatat

SEQ ID NO: 50671 - DNA, 704 bp, Oryza sativa
atataatgattagtgtgtgacacactataaaagttaataattaggcttttaggcgtataattagagctgaaaaaagtttttaccccttcccatttcgaatacacaagttcaaagtccttggcccgcgcccctggctacatcgtagaccgtgctgaccatgtttgccaataagaagataacatgcatgtccatgagaaacgaggagatgagatttacgatggagctcgccggagaagggaagctcaagatggtggccaactcatggcatccattcgaggaggcggcggagccgtgggagaagagcaccggtggtcatgcaacacggaaggtcattgtggagatgtgaaagtaatatattagtttgtcctaaaaaaatgatgggaaagattgagaaaattatattttggtctgaatgtataatttttgtcccaaaatggagtaacaaaacgagatcgtcccaaaaatatttttttgtctgttttttttgtacaccctctatcccaaaatataaaggatttgagttagatgtgacacatcttagattcatactatgatgtgttacattgaaccaaaatctcattcatattttggaacggacggagtacttatttgctagatgtgaaatcgatagattgtactgaactatgcctgggaagtttatggctggttggtgcgcggtttatgcctgagatacctagctactt

SEQ ID NO: 50672 - DNA, 712 bp, Oryza sativa
tcctgcagccctcagtccccttttgtcagaactctcagaaacaatgttccagcgttcactggatttgcagctgctacctgactagaagtctagaacctgaagatcatactacctccatatggatctagaggaggataactaagcaatatatattctgaaaaatgtcaatgttgctgtcctgtgctttagcaatacaaatttactatgttctcagtttctttcggtgctatatatatatatatatatatatatatatatatatatatatatatatttgcgcggtttcggtgctatatatttgacagtatccagttattgatcaagatgttttgacacaatgaagcatataatagcgtgtgaaatgaactgctcttcatctgttttgttgatgaactgaaccacctaaattttgtctagaacttttatatgacaatggtcatgtttggtttgcatgccaatttttaaagggagtctctgcaagctgctactaccctactcccttcccacaaaaaaaaaaaactcatcgctacaaatctggttgagtagttttttttctaggttgaagggagtactactctatatgctgcagcctctcaaccaatgatagagcagatgatgaaggcacggtcatctttgtcctcagctgccgctgttacctttttataataaaagatacaatcatattgagaatactctcgtctcccggtatata

SEQ ID NO: 50673 - DNA, 2863 bp, Oryza sativa
cagctgggatagatttcctaatttggaaacaaagtctctagttgcacgaacttcacataaagattgcaattccttcaagttccacaagccctcaaatggctccaaagattcccaattattcagacttttgtatgtagcatcaactaatttccaaacaagtaaatgacgcaattttttcagatttgaaaaccctctcggaaaattcagcaattgtgtacgttcaagactcaatgtttgtaaattgagaagctttgtaatagattttgggaattctttcacattggtatcattgaggcataaataccgaaggttaaatagctccccaactgaatatggaatggtctcgataggcaagccggataattctaacacagcaaggtacttggattctgagaaaatgaaataagaagctgaagataatgccatgctagtgtcaaatgctaggaaggtacgtagcctggatggatctacagttgatcgaatttcactgttgcattggagcacagagacgcggcgagagtctgatcccacttgtaccaccccatgagtgtcatcataaactgtagagaaactttctttctttgattggaaaatggctagttctcgcaaaatatcatgcattcgaagacactgaatcctattaaaactattccttgctacgacttgaatcatgcttcgtcggacaagctctgttaggtaaccttcagcaacatcttctaagctgcatgttcctttctgttcaataaatccttcagctatccacaatctaattaatctctttctctggataatgtagtcttctgggaacatagcacagtataaaaagcaattcttcaaatagtttggcaagtgtttgtagcttagatttagaattttctccacccggtttaagttttcattattgtgcacctctgaaataagttggttgtagaaaagcctccattcttttttattccttggtttgagggacagtaaactccctattgtaacaagagctaaaggcaaaccaccacatttgttcactatgtccataccacactgatgtagttctggagggcacatatgattttcagttttggggaatgccttcctgcagaatagaagccatgcatcatggttatttagaggctctaaacggatcttacaaccatcctcagctattgaagctacttcctcaattcttgttgtaattattactctgcttcctaggccattatcaacaagaacctcccgaatctttaaaagatctgcagccaaccagacatcatctagtatgatcaagtaccgcttctgacgcaaaatttttgccagttccagtcttagttctctattgttcatattttcagcatcaacccctcggttgtcttctccacaaagttcttttagcatgttttgccaaatatcatgcattttagatgattgagagatacatagccatgcatggcaattaaaattggatactattgcttcatttttgtagatatcattgacaagagtgcttttcccaaggccacccataccccagacagcaatgatccgaagagaacaatcttccaaacgcaatgattcaatcaaggtttgcctatttttatcaatccctacaagctcattgtcattgattgaataatcatatccaggcaaatacaactgttgctcgctattataatttgttggaggaacataaatcccactcgataatggtcgggtccaacgatctagtcttttggaaagctccacaagctctgtgtttatcatatctgctttagtggcgatttcatcaagtgaaaataaaggtttaggtttcttgataattttcttcacacaagcccatgatttcttgtgtctgtttttgccaacaacatacataaattcatccacaacatcttccatatcatgtgccaacctccgaacttgccttatccaagtttctacaacttcacctttgtacccattcatgccaagttctttaagaaatgcattgataatttcaagttccttttttatttgtctcatgttaactggaagtgctgttactagctcaactttctttaactcggtcttttttgcaaagaggggtatagctaactttagtgtatctcctgccacagctattcctatcttttttatgacaaaaagaacggcaatttcagccatttctattagtgcagttacttcaatatttcagtgaaatgcagttgcaatgatgaacaatcagtcctaagtaccaattccacccttgtacatcatatctacagggaaaaaacttattcatcaaacaggaaattctaactgccgaacaagttgcaatggttaaagcagcaattatagaagtgcaatctgctaaaaagattgttgctgaataccttcagtattgctgaaaattgttgaaattatttttttcttgaagtacacccgcttgatggagaaaaaggagagatgaataataacacaggaggacacgtgtgtgtatagccgtgctgttcctgtatatgtcacaacaatttggcaggggagggaaatggaagaatttgtcagttaaagatataagtactgggaaacaattagattgttttcaaactgagaaaataatgcaaaaaaatatattgtgcttgagtaacacattcattttccatgttagctatatcacgcttacagtgtaaattactaaaaagcactactctgaaaccgtaaaaggaagaaaaggagaagagagcattacaactttatacatttgatcaaattttcttcatcatcatgctgatgtgaataatcttccctgttgagcaagaaggcagcatcatcaaaattgccaagtgacagaatggcaaagctgaaggaatgcagaagtaaagaagcagcagtg

SEQ ID NO: 50674 - DNA, 5617 bp, Oryza sativa
ataattataaactcaaatgttttggatggaaatttcactcattgtagctcaaagtatgttcatgggaatttcactccactacacagtcagtgttgtggtgtcacagtcaggttgggctgtagctagtaggcccaatcagtaagagaggatgttaggtaaaatgtgtggcatctctactatacttatcgaactggaaatacacaaataacccattcgtgggtccagtatttttttccgtttgcttcctgtcagagctccacggttgtctttcattagcaaatttaataattaagatgtaccaaaagtatgcagaattgcctaacagctagttgatggtttcttcagaacaaattgcagctgtctgaacctttgaattaagaagttgaaaataactttggtagatttacgcagttgatgatattatcatctagacttctctcatgatgcaatgccataaaagcaaatcacagcaggctgaaccataaatcagttgagaaaccaaaccctgtattggtataagtaagcatacaactgaaaatttcaattttaaccaaaaatgagagtaataaagcaatgaagtatatcctgaatgagtctaattttttttttgtcggtaattatgttttggtgctttcctttctaaatcgacatagaggtagcatgattctcagctctagtttattcagactctgttatacgcaatgttacgcggtaggaacatttcgctctaccacagatttcttttaggttgattgttattgcttttgctggatcttctaccttccatcctccatcttcatcggggcatttaactttttgccaaagtcagtacccctaattgtccaaatatctctccatcttctactgaaatgaactctgcttccccatgaatcctatcatgctggaacatcaatcaatcaattactagcaagcaaagcataacagcaaacaatgaggaatcgattggaggcttgaagtcgaaatgtacctccgtggaacggggcggcgtaatggcgaaggccgcgggtggaggagggaggggcttccggcgagggcacccgcgccgccgatggcgcctgcgcctgtacagtccaccctgcctcgcgcatgccgcgtacggccgtgtcagcgagcagagcgcgccggcggcgtgaaggtggccggccggtggcggcggcggcggttgttgcctgctgctgcagcctcggcgaaagcctgggtggtcgccggtcatcctccggctagccgcggaaggggtcgaggtgggaacacggccgcagagggagacggcgacggcgacggcgagctagcaaatgtgcagagaagcacctgcgaaattacacaaacttctaaaggtccttactaggggccgtttgagttcacgccattagcgcaagactaaggccctgtttgtttcagcttatgattattataatctagattattaagccagattataataagctgtattataataagttgacatataataagctatgagttgtttgtttgtctggattattggaggtatggattattgggtttgaaaggctaaagtctataatgccctcagctatatgttcggttgatggcataggtgggtaatttttcttaagtatgtagggatagtgggtctttagctactcaataatctgaaaaaagctcctctagagcagcttattagattataataatctggcttatagattataataatcttctataataatctacttgtttgtttcagcttactactaataagctagattataataatcctaaactgaatcaaacagggcctaaatgaattttaattattccaaacttaatagggttgtgtcatataggtccctaaactctcgaaatgcatatctagatcccagtacttgttaaagtgtatcatctaggtcccaaatcgacacatcccctctaggatctacgtggcgctgatgtggcatgtcacatggacgttacgtgtccttttcatctttttcttcttttctttttctttttcttttttgttttcttctcattctactttttttcctttcttctgctcgggtcacagagaaaggagaagaaagggaaaaaaagagaagaaaaaagaaaaataaaaaattttaaatgagtcccatttgtcaatcaaaatgataccatgtcatgtccgtgtggcaatgccacatcaacgccacgtagaatactgaagaggttgtggcgatttaggacctaaatgacacactatgacaagttctgggacttggatatgcattttgagagtttagggacctagatgatatacccctacaagtttaagggccgcccgtacactttactgatagatttgtctgatagcagtttttatataaaaattttatcgtacgaaacgcaccgtttagtagtgtgaaaaacgtgctaataaacacccagataaaatctgcatcttaatcagaaaagaatgttgagtggtatgacaaacaaaaatcagttttgaaatagtagattacagcaagtttatttcaaattttaattattgtttttaaaataaaattccaaatatatacagcaaaatgatcatgattttttctataatatagttgtgtttattggtgctacatgaggtgaagtgtaagtaaagagtagcacaattttaacgagatgaaaaggtaagtgaaggtttctaacaatgtgtcatgtatttataaacttatagtgagatagagtaagaactttcaatgaagcttctagccaattcctcagttccaaatgctaccatggatgaaaataaaaacccgcatagtagtggtttttcatctcttgggtttccttggaaattccaccataatgtgcatgctctaaggatggagtagagatgagatgagccaatggttaataagaaaaaaacactgtgagttgaatcaactgtattttccaaccaattgatcttgcgtaattaaatttttgaagaggtaaatagctgcacttgcttgtcaattgtgtatttatgtgcaattgacataaatatttgacattttgggcaagatttaattaaaactttgatatttgctatttatcgaatgcttaattaaaaaggcatatattccatggaaacaactctctcgtaatatcatggaattattagattttttttttaaaaaatgtcctaatataaaaatgaaagatcaaaatttcacaggtttgactttttttaaaatatttataatcggaggtcacctaaagcacaccaacaagatcaaaggtccagaagaccaacacagaaaatactgagtggacaaggtatatctgtccactgtcttaaagtaaagactgagtgcattattcatcaacattaacctgataattactccgatcagtgttgccaattataaagtcatccgcatacacacatgctaggtcaaatagaccacaattgaccagctagacagctagttaagagtaaccactgacaaaacaagtgttaacatcaaattggtgatactactacaaagacactcaacacaaagagaaaacttgaccacagatggagtaaaagaggagatatgatgatctgataattaattacacacgctctgtatagtcttacaaaaatatctcgatccgcgttgaacagacatacagatttctttcaccaatcaatatgtgatcgatctgttgttatttaacttcttaattaagtaggtctgcaattgcctatcaatttggtgctaatttctgtatcagacatgcactaccacaagaagcactcgaaagggcagttagtcatagagtgagaagactaactgaattttactgattgcattgtgcagtgtcaacgatcgatcggctaaatttattaaacaatgccaaataaatatttacacacttgaagtaagtaagtagagtagcagttgcgagttgctcagcaacttgtagcattgaccagtaacctcaatgaaagatgcatggtatcagataccacaagaccagcttaattagaggcttggagctagtaaacactaacaatgtaacataaaaacacgtgttagcatcagcctaacacctgcccatttcgtcccttttttttttttttgttattgtgttgcgtttcctcctagtaaacagtgtattctacttagtaatttacttggcttgaattttttttctgttcttttgagtcaaatgacttggtgtgtgaccgtgtgaatcaacaggaccaagcagggttcgtctttccaattgaatggtagataccgaccctatcagtatgacattttctgccaaatttcaacaaaatttattattccaaagttgggctctcgaaaaccattttaaatttcactcacagtatacttctgtcctacattgaaacatcgaaatttcgtcgtttttaatccgctttcatcgaaaacataaatctgtgggaccaagagagtcggctagtaactgacgaccagacgagttgcgattgcgagcagccttccggcccacacaatagtccacaccggccataaacgcgagcccactaaaagactcggcccattactatactagcccaagcaaaagactcggcccatggatagcccaagtaaccaacgcgtatgcttggaaggcccatcaaaatcggcccagcaggcgagcgtgacgtggaccggtcgtttcgcgcgcgaaacgtggcgcctcacatgctcgcggtcgccgccgcgcgccacgtcgcgccttcaccaacacgtagctcgggacacggcggcgcgcgccgccgctgcacgcgtccacaaaaaccccacctcgccggcggccgcacatgaccaccaccaccgcagcaacgctcgtcgacggccatggacgacgacggcgagacgccgatgccgtcgctcgagctccacaagctccccaccctcgccggcgccgccatcccgaacccgatcgcgcgccacccgctgtaccacccgtcgccgagcttcttcatctcccccaccgacgtcgtcctccgcgacatcctcttcgacgcctcgccggcgtcggccgccggtgagcggcggcggcggcatgtcgcggcgtaccaccgcgcgggccctcgccgcgaggtcgcgttcgacccagcgacggtgcgcgcggccatcttcacctgcggcgggctctgccccgggacgaacaccgtcgtgcgagagctcgtcgtcgggctgtccgagctctacggcgtgcgcggcggcgtgttcggcgtgcggaacgggtaccgcggcttctactccgacgaggtcgtcccgctcgacccggcggcggtggagcactggcacaaggccggcggggcggcgctcggcacgtcgcgcggcgggttcgacctcgccaggatcgtggacgccatcgagcggcacgggttcaaccaggtgtacgccgtcggcggcgacggcacgatgcgcggcgcggcgaggatccaccgcgaggtccggcggcgggggcggctcgccgtggcggtggcggggatcccgaagacggtggacaacgacgtcggcgtcgtcgaccggtcgttcgggttccacacggcggtggaggcggcgcagcaggcgatcgccgccgggcacgtggaggccgagagcgcggcgaacggcgtcggggctgcagg

SEQ ID NO: 50675 - DNA, 1276 bp, Oryza sativa
atccgaaccagttgcagcgagctcactcgaactctgcactggcctcacaagccaacagaatcatcatcagctgctgccttctccagctgcgaggcagcaggatttggactctcttctctttttagagaagcataatttggacttgtgttttggtcctatcaacacaccactctgaaatatcgtatgtgatacacatgcttaagcaaagtagagtgatcactatgtctgaaatctgaatgttattgtgacctatgagcaggttcaggtggattggatagttgttttttttccaacttctctgaacaaaagggatggtaaaatctgaaaattgtaactggaaagattatgcagaagtgagattaccagtgtctagattgccaatgatgacgccttctccaaatctcgccttggcccagatggagttggccctaatccggccatccttctccatcccaagaaactcccatgaacgggtggtgtgcaacctatgccctctgtttgggaaaaccgagatgacacttggatgctctgcgatagagaaccagacgaatcaccaaaccaagaaaaaatcgtacaaaaatcacacaagaaataaagagaaagaattacaagactattagactagtacttgatatctccattgcttcctcctcctccagagtagcagcgaagccattgatgtacttggtgtaggagtagaagatcgcatctctcgccttctccttgctgcattcaaacacaaccagatcgtaagattcacttgcatttgcagcagatttcatattcagattaaacagcaggataggtggtcctttaccttcccaggaaagagcccaagaactcgtggtgggagttcttggcgcgttcttggctggaggccaaggcggctcctccccttccatgcgagtggccgccgaggtagacaacaaacgactgcaaagaaagcaagttttcaccaccaaatacaaagagaaaaacccaatccagcaacagaaacgatcaagaaaccacttgccttcttctcagcataggctggtctctgcaggagcacaaggctaccgatcagtagagccagagcaagaagaggagcagggggatgattcttcagagaggaacacatgttacacacagagtctactcagattgttctatggattagtggtcaaatgctgggggggggggggatttggagtggatggaatgggtgatggattcttcaggagttcagagaaggtgaatttctgaatgtgcttgggcactgttggtattttatagg

SEQ ID NO: 50676 - DNA, 1558 bp, Oryza sativa
gagtagtagcactagcactctactagcaggctagcagcacagttcatgagctgtgtgagcagtggcgttcgttcagagcatcaaaggagaggcagctttcctacgcctgcaggctgcggctgctgcaatgcagcctgatgcctgtggccgccgtacgtgtgcaccggcggcgacagggaatccccgaatgtagagtcaaatccctcatcggcgccattgccattgcttcttggttggtttacagtattcgcagggccatgctctcgcgtgcctgtgagcatgtgaaattaacaaggatttgttgctcgcgcgcgtgcttgcaggggtgtggccggaggccggcagcttcagcgacgacgggatgggacccgcgccggtacggtggcggggaatctgccaggaccaggcctctgacgacgcccaggttccttgcaacaggtctttctcagcctagtctttttagcttatgcttatactcccatcttatatccaacgtttaaccattcatcttatttaaaaaataaaaaataataagtcacacataaaatattattcacgttttattatctaataaaaataaagatattaattaaaaaaataaataagacggaggggtttctatgtcaaacgttagacatagaaacccatgactgcacttgaaattggacggggggagtacttatcagtcaaaaatttgaattttcaactttaaatttgaagtttatttgaggttttttttcatcgtagtttattttatcctttgcttttagatcgctaagaacacgtatataaaatttttattcatactttttttcatttgcaaatatatcatttcgctttttacaaatgtgtctctccctctctcctttttaccgtctcgtcgttcgccctatacaaaatcagttgctgctaaaatttaaattttcagtttaatttcagtattttttttgaatgtagttttttgaatgttgatttttaagtcaataataaagttttatttgtaagtactaaattatgtcttctctctcggtctcggacgctgtgctgtgtccttaacctgcgtgccttcttcgtctgatcggctcacgagggggaggtttatcctgcgtgatgggggagggtttgtcgttgctgatcgtgttgtttatactgcgtgccttgtttactgcttttgtttaatccctaagcaataggcgtgcatcttgacttgtcgcattgaagagtgtaaactagagttttcacaactactgcacttttgtttagaacgagggatggctacaaatgcctacagagcagtcagacctggactttggttccagagacgtgtctggtcttgctaacttggatttgttcttcagagagatgggctttgtctggacttgattagtttaacttggtgcttagtgctatctggataactctccttggaagctatgccatatataatgccaagcttacatgactgagagctcttttttttttctttttttaactaagtagtagtgtaaaacaactaatcgagccaaaaactagttctaattgagaaaagaaaaggaga

SEQ ID NO: 50677 - DNA, 8280 bp, Oryza sativa
cctttcatttgataataaaaaaaagttttatagcgttagcaatgtgtgttgtaataagacataattttttagcagaataatcaaaactgcatttaaaaaagtatgcataacttttttttcaaaaaaagacaaaagattgggaaaaaaagtaagtagaattaggttcaagataaaagaaagttactagggcaaatatcacaaatgtatgatgtcagcactttagcgtttcctattaaaatgtgataaatgaactgctctgccttgcaaggttgagataattagagattacaagaaaaaagaaagagctttctatcatgggagaaaaagaagaaatagtggtaggtcgactattataaatcatgaaatcttatggagtaaaaacattcagagactagctcatttatatagatgtaaaacaaaatgtaaaatggataaaaagaacagaatgtgaaatctctgtagagtgtagtagacttttgtcccccttgccttttagctctggatctctcattctctctctcactctccctccctaccggccaatccatccagtccacgcagtgaatcatgtgatgagagatcagatgaccagagctcatcctcacctcaccggccggtcagtcacaggagcatttctttctctctttctttctttctttattaatttctttcgctgttgctgttcttggcgccacacagattgctgccatgattccgcagagattagagcccaaaatccgcccccaccctggaaagatttcccctctctttgtcgtcccctttcccatgattacatataatccccacacgatgaaccctacctccctctcccctcggagatcgtgctctctgaattttactgtggcatcacactatgtgccaaattaacctgcttgtcccatgtagtaggagtatgtgtatcccagtgtgcactgtgcagtgagctgtttgtttgcttgcttgcttgcagcttgtggattcattcacattcagatatcgacaagcagcaagcggctagaacagcacagtgcagtgtgtgtgtgtgtgtgttttatctgaagaaaaggtcaaaaaatgtgcgagttttggatggatggatggatgggtctccatgaagccatgggccatggctgtcttgctcaaggcagcagcatggtgcaatgcagtgcagcacagtggtacagtcaaaacctgaagaaatgcattcagggagagatgagatgggatgagagatcagacagactggttgtcgtcgacctgtgcatggaccattgctccctcccttatcccaaatctctgtttgctttcgtcaggattctcttggtgctttgaccacaccattagcttaagtgcttggcaattactccattcattctccaaatagttgacacagttgactgcggtcatctcacgttaaccataaattaaataattagaagaggcactaatattctggagcccatcaccttgtggagctagccaggagactcctgggtgtttctcataatacaaaacattttcaagtatttataacttttgtgaaaaaaaagaagacaagcggtcaaagtttaaacttaatagtatcacggtcaattattcagtaacagtgtagaaatttacaagtgttaatagtatcacggtcaattattcagtaacagagtgtagaaatttacaagtattaatagtatcacggtcaattattcagtaacagagtgttgaaagttagtacaactttggtgatgaactgttccttctgatcgagatgcagaatggagagttcagtgtttcacagttcagaagttgatcagttgatgaggtgaatgaaatttgtacggatttgatgcaggaagctgatcggtgcgaggtacttcaacaaggggtacctgtcgacggtcgggcaggcggcgaacccggcgagcaccagggacaccgacggccacggcacgcacacgctgtcgacggcggcgggccggttcgtccccggcgccaacctgttcgggtacggcaacggcacggcgaagggcggcgcccctggggcgcacgtcgcggcgtacaaggtgtgctggcgccccgtgaacggcagcgagtgcttcgacgccgacatcatcgcggcgttcgacgcggccatccacgacggcgtggacgtgctctccgtgtcgctcggcggcgcccccgcggggtacctccgcgacggcgtcgccatcgggtcgttccacgcggtcaggcgcggcgtcaccgtggtgtgctccgccgggaactccggccccggcgccggcaccgtgtcgaacaccgcgccgtggctcgtcaccgtcggcgccagcaccatggaccgcgagttcccggcctacctcgtcctcggcaacaacaagaagatcaaagtaaatcgaatcatctctcatcctaccaatcttttttcagtcctgattacatcagaatctcaccgtgtcgcaggggcagagtctctcgccggtgcggctcgccggcggcaagaactacccgctgatcagctccgagcaagccagggcggcgaacgcgacggcgtcacaggcgtaaagacgagcacgaaccaatcctcgagctgaagctgccatggatgatgccatctcatcatctaaatgctgtgtgttcgatgtgtgtgcaggaggctgtgcatggaggggtcgctggagagggggaaggtggaggggaggatcgtggtgtgcatgcgcgggaagaacgcgcgggtggagaagggcgaggcggtgcggcgcgccggcggggcagggctcgtgctggcgaacgacgaggccaccgggaacgagatgatcgccgacgcgcacgtgctcccggccacgcacgtcacctactccgacggcgttgcgctgctcgcctacctcaattccaccaggtgtgtgctcctatttgaattttttattttgaattatactcctatttgaatttaagtcttggtatttttggaaatagtttgacgcagctaccaactggcctattagctcagctggttagagcgtcgtgctaataacgcgaaggtcgcaggttcgagacctgcatgggccaattctttttttttatttttttttcaatatttttgggtacatagtaattttttcttacattcttttgttattatctaaaaaaattcttttgtacattaatttttttagaatatcttaatgttttgccaatctttattagcacagtattttattttttccgtcccaataacgcagatcgccgtcgggcttcatcaccgtgccggacaccgcgctggacacgaagccggcgcctttcatggcggccttctcctcccagggccccaacaccgtcaccactcagatcctcaaggtccaaacctttctcccaaattaatttcgcaacacactgtcactcactcactctcactgtgtccatcgtgtcgagatcgccggcgagcttgacctgtgtgtgtgtttggtgtagccggacatcaccgcgccgggggtgagcatcctggcggcgttcaccggccaggccggaccgacggggctcgccttcgacagccgccgcgtcctcttcaacgccgagtccggcacatccatgtcgtgcccccacgtcgccggcgtcgccggcctcctcaaggccctccaccccgactggagccccgccgccatcaagtccgccatcatgaccaccggtaagcgcccgttgcagaggccagagacgtaaaccatttccattatggccgaagacataaaccatttctattatctatttctgcattgtagaggccgaagatgtaaaccatttcttccgtggagtaatttataaggtgtttgtttggttgcagcgagggtgaaggacaacatgaggaggccgatgagcaactcgtcgttcctccgggcgacgccgttcagctacggcgcagggcacgtccagccggggcgcgccgccgacccgggcctcgtctacgacatgaacgacacggactacctcggcttcctctgcgcgctgggctacaactcgtcggtgatcgccacgttcatggcctccggctccggcgcccagccgccgtacgcctgcccgccggcgcggcggccggaggacctcaactacccgtcgttcgcgctgccgcacctgtcgccgtccggcgccgcgcgcaccgtgacgaggagggtgaggaacgtcggcgccgcgccggcggcgtacgtggcgagcgtcgccgagccccgcggcgtgtcggtggccgtgcggccgagccggctggagttcacggcggccggggaggagctggagttcgccgtcacgttccgggccaagaaagggtcgttcctggccggggagtacgagttcgggcggctggtctggtcggacgccgccgccggcgggaggcaccgcgtcaggagcccgttggtggtgagggtcgtggacaagaaggggaagaatggcttgcccatctcttgatgagttcttgccatgatttttgtaaaatctttttagataagttcttagtttgcgtgtgtttttttttttgggtgggatggtttagcctgaccaaagaaggtttggctagtttggtgaacagacttagaaatgataaactgaaacttacaaatcgcccttctatcacccacatacatgtggattaaaacttttttttagaatattttgctgatagagttagaatagcaattcatgtcatcgaaaacggtgacattaaattggttattcatagtatcgatgacattttttcgcgaagtctaggtggcatttccttccaatcggggtgtaggatttatcagcggtcttaagtgtgtggggttgtttggtttgtaccttagcattggtggtgcgtaacatgtagctaagggtggacaaaaaactcatggctcggataagctcatagtgagcttggttcggattgactcgaacttgtagccttaatgagttgagccacactaggctttcaactcacgaactactcatttaacccgttagcacaagagatcatcatatcttcgtgtacttggttcttcttaactaatatttagtcacttaattacatccaatctatttgtattcaatgacttatttagtagttagtgtttattgttatgtttatatatgataaaatagtaaacttaaaattattagggtttaataagctcactagccgagctagatttttaactcgttaaggttaatgagccgagctgagctagcttgttaagataacgagtttagacgagtcgagctgacttgttatcctctcgattcatggctagttaagtcttttgtgctgcgtaatctgcaattaattacctcatggagggtttgcagaattgcagacggaggagtagaaaagatcgccatttcttccgtgcttttttggccggttaattccacaaacacttgtggggggcattcatggcaacgtcgccgttgcaaagccaaacggacgtgcaaggcaaccaaacccaaacttttcggtggatttcccaccaatccatcggttgtactccaactgctgcttgaccattcgatcgcagaatcgcagcagcagcagcagcagctgtagtaggctagtagcatctgtagacatcagtgcacagcacttaacccagatggattcgcgtaaacgtcactgaatcccaatccggtggggaaagcgcctgttgactaactcgtgatggcgtagttaggagtattatctggttggttaattggtttggttcgtgtgccaagccgaacccacccacatgctccggttgccgtcgccggaagcgggaggaattcggatgaacggacaggcgagcgaccaactccggcgaggcctggccggtcatgtgcgccgcctcgcgattcagcaacgacgagattatgatacaagattatttgcgagtaatcaatcaagatgccccggtttgtcccggagcgcaggcaggcacgccaaccaatcacacatggtggttttttttccccaaagaaatcaaaaaagggacaggaatgggaggaacaagagaccaaccattaatcaatcaatccatggattgcaaccaaaatgcaggtggaaataaaataaaatcaaatccggcgaattcttctttacaaacgattagtactactactactcccggtctcccctactatcccccatggatagatctcgggagggagagaagagaagaggaggaggggctagcagctagtacggcggcggcggcgcgaagaattggtgggcgcggagggagccggcggcggtggaggaggcgtcgtggatgctgctggtgagcttgtggaagccgcgggtgtagacgccgaagccgaagccgatgccgacggcgaccagcaccagcacgatgagcgtgcagatgcagcacgccttgctcgggcagcagcacatctcgccggcggcggagcacgagaaaggcgatgcgcttttgcgtgtttttttttctctttttggtgcgggagcttttgccgggtgggcgtgcgtgcccggggacgcgccgcaccgcgcggctataaagggtggtggctgggttgggggatcgccgagtcgggtgcggacgccggtgtgttgggttgggttgggtggcggtttccgtctcggtcccgtcccgtaggggcgacgcgacccagacgctttggctggcggtggcggcgcttgccttccgttccctgcgatgagaaaaatactactccctcagcttgtgtcgtttaccttttttaagtatgtttaaccggtcatttgtttatttaaaaaatttaaataattattaattctgtttctatcatttaatttattgttaaatattcttttatgtacacatgtagttttacatatttcacaaaaaattttgaataaggtagacgttcaaacatgtttgaaaaattcaacagcttcaaatatttagaaacggagggagtaataatattttatggacgtaacatggtctgcagcctactcgggtccggggaggaaacggctatggcaatgtgaagcagaggcaaggtcgcaaggacgtgattggttgtcagatgtgggccaccaagacgtgattggttgtcaggtgtgggccaccggttgtagatgggttggagcgggacggcgacctaacgtatggccgtattggtcgtccttcttgaaagttgggctggaagtggatcgtgagttaacgggagtgaagcgattggcctggaacagaaaaggaataacgcaaaacctaaactgcatcccttatttcttgctcgtgtttgaatagtcatccataaaaccggatctaacgcctcctccatcttctaaaactggtgcaaggttttctgctgatatgaaaaaaaagtgggacccatgtgtcaccaacctctttctcctcccctcttctctctccctcccccttctggccatggcggctactacacgagcgtactcagcatgacggctccttgcaagacagcaacaagctcggcgagaggacgaagagccatcccacctccctccctacgcggctacgctgcacccgtcagcctcctcccccaccatgttgctactccgcgctcctcctcccgtaacgacaacctccatgccatcaccaccttcgagctcttccattgtcgtccctggtgagcctctctgagctcacactgtcgatggcctccatgtcgtgggggtcgaggtgtcgctgcctcgtcaagctctgcctccgcctcctcaagctgtcccttccccaagcgttgccgcctcctcgagcttccccctccccaagtgccaccgccgcttccccctaactagtggtaccactgcttctccacaacaagaatcgcctcctttgtcgcggtgaaaagaacaagatagagtgaattctcttgggggagatatagggggtggaagaaggagaaggggttggctcctccttcacaacctagcccagccatcgccaccactacctggttcgttgcccagatattactcggggcggcatgatgcggtcggtgactggcagccagatgtagagctcagcagtagtgaaacctcgttgagtcccctaatttcgaggatacgagcgggacactatggctcacactgttgccgccgaggtccatcgactcctctgtccaacgagcaccaatagtaatgatgccagtgagcgtgggcgcgaacaaaggagataggaatagaggcgaagaggacaatgcaccgtcgcagaggggctcgcaggagacgacatggtggacttgaggtgagctcggaggggcttgctgaccacccccgtcatgcctggcttggttggggaaaatagaaaa

SEQ ID NO: 50678 - DNA, 1740 bp, Oryza sativa
ggtttttaaagttaaaggatgtgatatactcgttttatggttgagagatgcgatatacttgttttacggttgagagatacgtttgacgaaaacaatagttaagggaggccaaacatagacttattaaaaaaaaaacaatggaccgaatattcgttctcttggaccgtgcgagatgaacagagcactacaccacgtatcgccgttcgatgtttgcgtcctccgtggtccggtgcagtgcttggacgattcaccgagcccccgggccagcgacaaaaatcctcacgatgcttagctactcgtacagctagcgcaggagaaactgaaaccgctcacttccctgacagcatcgcagcaaaatctcctctgtaccagctaaaatttggtttcgacagaagattcgagagccttacgctcttacggccgcacgcccaagtgcacgtttccttgatcccttgctaacattcaggcattcagcatgaagccatgaacttcggagcatataaccagatatacacaggcctctgttctctctctttctgaattctgtcagttgctcacgcacacctgacggcgcctgagtcccgacggccaccatatcctcgtacgtcctcctcgagagatatatagcagcgatcgatcgatcttctcttctcgtcttgatcatcaagtaggtaggtatccatgcatgttacgatccgtgcatgcaagaaaggtttcttcggttctttgttcctgaattattccactactgtttgcatttgcatgcctgtccatccaaaagaattgtgaaatctgtggttcttgaggtgatcagatcaagagttcggaggctgaatcgaatcaatgttaatccgtgggcgtttgcatgcgtttctgtgtagagtgcatggatcgtcggcggcgggggcagccggagcgcaaggcggcggcggcgacgacgaagaagcgcgggagggacgaggaggtggcggcggcggcgccgccgccgccgtgtggcgcggtggatttcccgttcgaggagggggacgaggaggcggcggcggctgacgtcgtcggggatcaggcaccgggggtgttccggttcccgtggcagagctgccgcggcgggctcggggtggtcgccggcggcggcggcggaggaggagggtgggagatgcgggacgtgttcttccgctccctcgtggacggcggcgcggcggccatcggggtgccgggcgaccgcctcgtctccccgccgccgccggccgagctgcggcgcgcgctcttcgacgacgtgggcgcgtggctcgccgccgccggcgacggcgaggtggaccccgtctggcgctcggcgctgctgatcgagggcgagcctcccgcgccggcgaccgtgtgacgacgacgacgtggacggaggtgggccccacctggcatacactgagtagcagcgtgatggtgacgtggcgtctgggcgccgccacgtggggactcgagtgctgacgattacgatggaggatatctacaaagcgaacgtcactctggtctctcttgacagagttacttccccttaaaaaaaagagtaaaatacatgatgggtcattaaacttgtttaagtgtgtcatataggtcactctacttttaaaatacatatttgggtcactaatatgaggtaagtgagtcacttacccatctaactatccacgcgagcatactttgtacacatggcatgccatgtaggattgaaaaaattacatttggata

SEQ ID NO: 50679 - DNA, 846 bp, Oryza sativa
tggttacttcctgggaggggattggctaatgggctaagaagggtgaaaattgacgtgcacacaaatagtatggctactttggcacctcgattcaggaccctgaggttgtatgttcataataatgttatcaccgaatttgctgagatggattcactcggaaaacatgagttaaatgcaaatatcaactttaaaaaggctcacatttcagaggactaccaagttgacaatataagtgataatgatgatgagggtgctgagtttactaacagtgattatgaaatagataaaggtgatgatgatttgtttgagaagtgggtggacaaggatgtcgttgataagctagtttcaccaaagggcaaacaattgtcaagtgctggtgaggaagatgaaaaatgccatctatctagtgaggaaggtttggatccttgtgatacttctagtcatgatgaagaggcgcaactaaaattcaagagtttcatgcctaaggacatgacaaatccacagttctttgttggcatggtattcccaacagtggaagcactaagggatgctataaatgatataaatgaacacagtgtcaagaacagagtggctatcaagatgccttataatgacaaagatagaataagggctcattgtgatgaaacctgcccatcgaagttaaatgcttcacatgatacccgatcaaaatgtttcatgatcaagacttatatcggcgaacacagatgcaacaagaagtgggagctaaagacattcactgccaactatattgctaacaagtatgtggaaacttttagggcagatgataagatgactataaggaattttgcaagaacagtgcaaaaa

SEQ ID NO: 50680 - DNA, 711 bp, Oryza sativa
gaaaatgcaacaaggacctagagggaaaggttcgtcgcaccttggaccatctcctctcttgtggttataaccaggatagtcttctatatggaaatcaactttctcaaccataataagtgaagattcagaggctagtttctcgatctcccagttttcatacacctttcctctcttgtgactaacatggatttcaccggaaggccgaagcaggcatcttgcattgcggaagaatcctctgaccagatccttgtgcaagctaacagtcagagaaaatggttaataaaaagttaaccaataaacaggatatccaaaagcagcagcctgtttaagcattacggcattctaaacaggttcctgccttcaccaaatgcaacaagaaggccatcagctaaaaaaataatgaccatcatctatgaaaaggttattttgctggccagagcctcccacacatcataactacaacctaagaggctaagatccattccagtgtttttatggtttatgctattagcagtgagcaaaactgactagaattaaacttggaaaagagaactgcttcctagagattatatctaaagccatttgcatccgtgaatacttcttctcaacaaaatcaacataacagcataactccttgtactgccgtacaagacatatacactttctctataacacaaattgtgaaacgactgattcatatggcaaacaaca

SEQ ID NO: 50681 - DNA, 5512 bp, Oryza sativa
aagaaccaatttttattttgttttgctcaagccaagatcagatcagagatcatcagactgatcagtgctatacttagtgcacacaccaacactgcaacaaccaaatctgttctttgtacaaaaaaaaatacaaataaataatgtttttttaaaaaaaattgcagtagccattagccattagcagcttgactagtggtcatttggatccagatctcctaaacttttcctgtataaacaaatcatggggtctccccctctacaatcccaaggctttgcttagttagcagcagcagacgccaccgccgccacatcaccaacacatccaccgcattgccaccctcgcctcgccgtcgccgtccacctcgccgtggcgcgcgccgccaatgccgccgccgccgcccgtcgcagcagcagcagcagcagcgaggcacgcgcttctgctcgcgtccgtcgccgtcgccgtcgcgctgctgctggtgtcgccgtgccacggcgtgagcgagcaggggcaggcgctgctccgatggaaggcgtcgctgcggccgtcgggcggcgcgctggactcgtggcgggcgtcggacgcgacgccgtgccggtggctcggcgtgtcgtgcgacgcgcgcacgggcgacgtcgtgggggtcaccgtcacgtcggtcgacctgcagggcccgctcccggcggcgagcctgctgccgctggcgagatcgctgaggacgctggtgctctcgggcaccaacctcaccggcgagatcccaccggagctcggcgaatacggcgagctcgccacgcttgacgtcagcaagaaccagctcaccggcgcgatcccgcccgagctctgccggctgtccaagctcgagtcgctgtccctcaactccaactcgctccgcggcgccatccccgacgacatcggcaacctcaccgcgctcgcctacctgacgctctacgacaacgagctgagcggcgcgatcccggcgagcatcggcaacctgaagcggctgcaggtgctccgcgccggcgggaaccaggggctgaagggcccgctcccgccggagatcggcggctgcgccaacctcaccatgctcggcctcgccagaccggcatgtccggcagcttgccggacacgatcgggcagctcagccgcatccagaccatcgccatctacaccaccctcctctcaggccgcatcccggcctccatcggcaactgcaccgagctcaccagcctctacctctaccagaactccctctccggccccatcccgccgcagctcggccgcctcgccaagctccagacgctgctcctatggcagaaccagctcgtcggcgccatcccaccggagctcggccggtgcaggcagctcaccctcatcgacctctcgctcaactccctcaccggcagcatcccggccaccctcggcgacctccccaatctccagcagctccagctcagcacgaaccagctcaccggcgccatcccgccggagctctccaactgcacgtcgctcaccgacgtcgaggtcgacaacaaccagctcaccggcgcgatcgccgtcgacttcccgcggctgcgcaacctcaccttgttctacgcgtggaggaatcgtctcaccggcggcgttccggcgagcctcgccgagtgcccgagcctccaggccgtcgacctctcgtacaacaacctcaccggcgtgatcccgaagcagctgttcgccctgcagaacttgacgaagctgctgctgatcagcaacgagctgtccgggcccatcccgccggagatcggcggctgcggcaacctctaccgtctccggctcagcgtcaaccgcctctccggcacgatcccggcggagatcggcggcctgaagagcctcaacttcctcgacatcagcgacaaccacctcgtcggcgccgtgccatcggcgatctccgggtgcagcagcctcgagttccttgacctccactccaatgctctctccggctcgctgccggagacgctgccgcgtagcctccagctcatcgacgtctccgacaaccagctcgccggcgcgttgagctccagcatcgggttgatgccggagttgacgaagctttacttggggaagaaccggctcgccggcgggataccgccggagatcggttcttgccagaagctccagttgcttgacctcggcgacaatgcgttctccggcgtcatcccgccggagatcgggacgctcccgtcgttggagatttcgcttaacctcagctgcaaccggctctccggcgagataccgtcgcagttcgccggacttgaaaagctcggcagcctcgacctgtcgcacaacgagctctctggtggcctcgactcgctggcggcgctgcagaatctcgtcacgctgaacatctcctacaatgccttctccggcgagctcccggacaccccgttcttccagaggcttcccctcagcgacctcgccggcaaccgccacctcatcgtcggggacggctccgacgagtcctcccggcgcggggccatctcgtcgctgaaggtggccatgtccatcctcgccgcggtcagcgcggcgctcctggtcgccgccacgtacctgctcgcccgcatgcgccgtggcggcggcgccggtggcggcggcagggtcgtccacggcgagggcgcgtgggaggtgacgctgtaccagaagctcgacatctccatggacgacgtgctgcgcgggctgacgtcggcgaacgtgatcgggaccgggagctccggtgtggtgtacaaggtggacacccccaacggctacaccttcgccgtcaagaagatgtggtcgacggacgagacgaccaccgccgcgttccggagcgagatcgccgcgctgggctccatccgccaccgcaacatcgtgcgcctcctcggctgggcggcgaacggcggcgccaggctgctgttctacggctacctccccaacggcaacctgagcggcctcctccacggcggcggcgccgccgccggcaagggcggcgcgcccgcctccgactccgagtggggcgcgcgctacgacgtcgcgctcggcgtcgcccacgccgtggcgtacctccaccacgactgcgtcccggccatcctccacggcgacatcaaggccatgaacgtgctcctcggcgccgcctacgagccgtacctcgccgacttcggcctcgcccgcgtcctctccaagctcgactccgccatgccggcgccgccgcgcatcgccggatcgtacggctacatggcaccaggtggggtccaaatcacaccaaaaattctcgttacatttcccgcgctttttcacaaatccatcattatttcgatgtattttgctgaattttttgtctgaatttctttttctttttttcagagtacgcgtcgatgcagcggatcacggagaagagcgacgtgtacagcttcggcgtggtgatgctggagatgctgacggggcggcacccgctggaccccacgctgccaggcggggcccacctggtgcagtgggtgcgggaccacctgcaggcgaagcgcgacgcggcggagctcctcgacgcgcggctcaggggcgccgccggcgccggcgccggcgccgacgccgacgtgcacgagatgcggcaggcgatgtccgtggccgcgctctgcgtggcgcgccgcgccgacgaccgccccgccatgaaggacgtcgtcgcgctgctcaaggagatccggcgccccgcgccgtccgccgccggcgacgacgccaagccaccgcagcccacgcagccgccgtcattgcccaccaccgtcaccgcgacgccggcatcgccggtgtcgagctgctccttcgccgccgtcaccgactactccgtctgaaatttttgaaaagcttagtaaaaactagcgagcagtaattagttaattaccctcccataatctgttgattagccaagaaatcatcagcagcagcaactctgtacttaggtgtaatttttccccactgtacattaatccaagaaatgccattagcagcagtaaaataactctgggcattctgattgctgaagattacatctcgaatttgtggatgaggcggcgtcgttgtcggatcacgaacagaaaaaaaatgaacaaacaaagcgatcgatgatctgtatacccaatcagttgatggtttgtgatgatgcagattgatgggggctgagccaggtgacatgctcctgatcatgcgtgtgtctcattgtgtgcgtctcgttctcggagacaggtcacacgtccatctcacgccgacgaggtgaggtgatcattgattggatcttttgttgtccaaccgagttgccattctgcatgctctactattgaagctaaactcttttttcgcaagcgcgcaaaaagtttgcacgtcaatatattagaataaaacatagttttatgggcaaaattcagatttcacaagttcagtttacacgcaaaataaaattttaaaagaaggcattgcagtatatgaaatagtgtcatggtaattcgatcgaaagaaaatacatagtagggaatgtgatgagcaattgagcataactaactacaactagttaggtttacttccatttgttacatattgaaaaggatatgagggttcagctgagtgctaaagcactttttttgaaagactttgctggacagaagcaaatgctggtcgttaagcagatttatttttcagataatgtgttaagcagacttgacgaacaaattgcattgtgcaagataaataaatcctaaataacaaatttcggtcagcacagcagtctttaaaattctaggaaaacatggcagtatatgcagcaaaagatcgtgaaagcaaactggagtagctccaaaccaagaatacgtaggcccaccagttgtggcccacgtacgtggcaatcccttcaggcccacctattatgggcctcgccgcaaatccccgtccagcccataaataatgggcctcatgtttagccccgatttccgatatggcccaacttgtgccggcccagtgatggtgccgtgagcctcctgccaagtggaccccatgcggcagaggctcgccctgaatttatcacgttttgatcattttagaaaattttattacctaaaaaagtttattcagaatacgatcttttcgagacgctagtgtcatgcctggttttgctggcgaaaattttgagttcgattgtaacatcgcatatacaaacacatatttaaaatattaaacgtagtataaaaataaaataaattacatatttcgtcagaaaagtgcaagacaaatttattaagcctaattaatctatcattagcaaatgtttactatatcaccacattgataaataatggcacaattaggcataaaaattcatcttgtaattttctgtcgaactgtgtagttggtttttttccacatttaatatttcatacatatgtccaacattcgatgtgaaaggtgaaaaatttttattttagaaactaaaccgggtctcattggcgccgtgatctaatataatgg

SEQ ID NO: 50682 - DNA, 1534 bp, Oryza sativa
gaccaatggacatggactagcgttgcggaagaggcgacgaaacggacacacatggcggtggcgccgccggaggtagggcccgccgcggcggcggcggtcgccggcgggaagaaggaggtgcgcgcattggatggagcatcggcgatcggtgaagaagaggaggtggaggtggaggtggaggaagaggaagaagcggaggaagagagagaggatgaagaggagggggaggaggatgggggcgatgaagaagaggaggaggaggagggggtgaagtggctgaagcattactcctcgatgcaaagcatcttggtcgtcggcgacggggatttctccttctcgcgggcgctcgccgtcgcattctgctccggcgagaacctcgtctccacgtctcttgattcctatggtatcttcgattgcttcttctctcaactctagcctctcacttccccttactcaattgattcggattttgttgcggatgccgccatttttccgcgcttagtagaatagtacactactatgagtgcgatatgcctttcttgccttgtatgccttgagattttggcctgataaaaaaaaaagaaggcgaactttactccatcaagaacttagtttaccttaaattggtgcgtgtgcaaacgtaggaataacaattttagcaggctagataatactagggtatacctgtatgaaatttatgtgtcgacatccacaaacatggggttgtcctaaaccttttgccccaaaacctaggttccttgagaagaacccgggttttccgttaaacttggggttctatgaaatgtattcattctgttaattatttgtgggataccttcatgtgttcttggttttggaaataagctttgctagttggtacattttactgaggataattataaagaaaaatgttctctactgttagagttgcatgttattgaaggaacactcatattgagcacactatttctatcttcaaggtattctgctctctgttgttgttggaacacaaacactgtaaaattgtgacttacagccgtatggttcaaaagttctaggtcggattatcatttcatattggtaatggcgtccatttattttattttttttgacgcaagcgtccatttatctgtttctctgatcagtttttaggcgtaacctctatgttaccttcatatatcatttttgcgcctgccagcacgatattattatgttgtgtttaatcatcatctttgtttcaagtttgctttaaggtacagacatcaaagcaatcgctaaggggctaaatggaaacatatgtgaaccagttaaaacattgttattcaacagagaaaatatatcaggaataggatgtttcataattcttttttttttaaaaaaaatgtatgcattgagctgccactgcttacccgcttacattacatgccaaaagggactttattgtttgatttttgtgctcatttgtatttcatgtgagtaccctgttgtccagaggctttgagggggaagtatgccaatgcagagtcaaatataa

SEQ ID NO: 50683 - DNA, 1465 bp, Oryza sativa
taagcctatccgtgacaatgtggatcacatgatctgctggtttctgcatttaaataaagtggtatgcatctcgttaaatataacaaaaaatgggtagaagaactattagttcatagagattaatgtcaaaggtcaaatgatgtaccttagcatgaataatagtggagtttacaaccactgcagcagccaacacattatctgagaacaacgcatagtgatagagttttggatcttccaacttttctatatgtgggaattttttattgttggagttggtgtagtagtactcatttgtaagccgcagcggaaggcaatgaagtccttttggtaaagattttgctgctacttgtgctagatagttggtttcctttttatgagattggagtcgctcctctgttgagtgaagggttgcacggagcctgttcagagcacccgagcaactatcaagaattctctttccctttcccaatgtttgctccattgctcttattttgctaagtacactgcataataataaaaaagggtgagatgtccaatttcaacaaaaggtacggcaaaagcaataatgcaccatgatgacacacacacacacagagagagagagagagagagagtacttctgaggaagctggccaccactggttgcatcacctaggactctttggatatccctcatccgtgcacgaagctcccttgcaaaaccatgattgcctctagaagctacaaggctcagatatgtcgttgctctcgtcaactggtccttgattgtgcggatggtagcgtctggggaagtagtggaatgaccagcactaacacttgttgggagagcagaattactgttagttgttggtgtgtaagactctttgggaatagcttttgtaacttgttcagacaatctaccagtgctcctttcctggacaattgaacaattaacagttagttcatagcataacctgaaagacaatcactgacggttgagtggttgacggaacacatatactatgactgtggataactgagtacacaagttacagtatgttaacaccactaaacaatatgtttattccaaataagcagtccagctttcagaaaagggtgacaaaatggaaaatcacaaaaagaatgggcatctaaatgcatttttactcaagtgtatagagttgtaatatacatgcaactatgcaagaaaggtgaacaacagaatattaaattcattaaagaaaataaaaaccattgaaaaatctgcaccacctcggcagcactcacttacttgattcctaaaatgagcatgattttaggtgctagtaaatatgtatagctgcgaggtgttgatggtacaaggtgtctaaagtcttactttctagttagtagtccctacccatgattcttaaaaggaaactttatcacccttgccaagtatgcaatcggtcatctgtaatcaattttaccttttctagggatgaat

SEQ ID NO: 50684 - DNA, 5260 bp, Oryza sativa
  unsure (1)..(5260): unsure at all n locations
taaatccgcactactggatagtacaaaaaatgcaaaatgataaacagcggaaggcacccccacctttggtgagggagacgtcggaggcagccaccaccagattgtactcgccatcccgatccagcacgccgctcgccactgcaaaagagaaggaaaaacaaaaacaccacccgtcaagcacggatctccccacattgtcggcgaagagagagaggggggggaggcattcgtccgttcgtaccggtggagtccgggagggtggagacggagacgggggagccgccgtagaggacgaggggcgcgagcaccgacgagaggaggagcagcagcaccacgcccctgcagcgccggccccgcgccaccgccaccatgggctccccaattcccgccgcctccctgcacttcggagagcacgcgcgcctcgccgccgccgccgccgccgcgccgagcgatgcgggaggaggaggagatggcggtcgcgttttgcggtgggcgcaggcgcagcgaaagccgaggcggccgcttattttttgggaggaggcgagatgtgttgtgtgtgtgtgggttttgggcgtcggcacgcgcggcgcgggggggcccggatgcgaaatctcggggcgcgcgtggcgtgggtgacggcgtgagcgtgagcgtgagcgaccgacccatatgcgtgtgtacgactttaaatttgcttgctccaccctggattcccatgatatcgtggagtagaagtaaaaatatttttctccatccaatttgggcagatagtgtgtgagctggagtagtagatctatttgctgtccctaagctgataactgtcccaaattgctttaaaattggtgcaggtctctatatttaaggctgtgttctttgattagggttccaacccctctccctcatgtttcgcgtgcacgcttttcaaattgttaaacggtgtattttttgcaaaaaagcttcaatacaaaagttgtttaaaaaatcttattgatctatttttttaaagaaaatagctaatacttaattaatcacggactaatagaccatctcgttttccgtgcacaagacatgggttcccaactcatagaaaagaacacactctaagagcacccgcaatggtaaagtaaggtgctatctataaaacatgtacatctcagcaatagactcgattaatagtaaaccaccttaatagtatgtctacattggtatctataattctctcatgcattgcctcgtttttctctatagactatctctaagttagtagatagctttgctctctctcttcatttaataccttccaagtaggaaaatatgctgacatggatctcttgtagagagcctatagataaccattgtgggtgccctaagcactgaatgcagtgtgaattattagcgtatgactagttaactattagcttaaaataactaaaaaataaattaatatgatttttaatgtaaattcttactatatgaaaatataaaacaaaacattatagtttagtagttcaggaagcacacgtgtgaaaaacgagagtataagttgagaactttctcatcaaacatgcccttgatctttttatctctcctatttttttttgtcccgtctcacaccattgtgataccgctccaccgtcttcctcatcatcatcgtcgccgtcctccaacaccatcaccgttaccaatattatcatctccaacctccttcccttgtctcacccctccctcccccacctcgatccatcatcgtcgctctccacctcttaatcacatggcctttgttttccaccgctgatctcacccattatcggtcttccaccaccgccgtcatttgtctaaagccttccttctatgtacattgtagtttggttatcactagtgccaaggctcgccaaggaagctcccatcgccggttagtccgccatatcctccatgtattctttgtttggacctctcccgattaaagtgtgtgtttgtgtttaagggtccgtgatccatttcccaaaaaaacaggatagctatttagtacataataattaattaggtataactaaaacgatttaaaaaatggataaacatgattttctaaagtaactatcatatattattttatagagacacacagtgtttaaccgtttggaaagcccgtgcgtgaaaacactagactataagataggaacgggtattctgaacgcagcctaataaaactaacactaggagcttttctaaagcattgataggcgcctacaaatcgggcgtccgattttttttttttttgctacaagtggatcgaacatgtttcactaaatagatcgaaaatatttcagtcttttaaaaagctgaaacacaaccaaatcacctcatgaaatattttgctacaatgtatgaaacaacggttccaaaaaaaaccgagcgttgtttcaccctatataaaaataatattttagcaaatagcgaaagaatgtttcaattcactggaacatttgatccatacacagtgaaacattatgagtacactaggtgaaacatttttggcggaacaaaaaaatgaaacggatttcttaatagagggtttctataatatatgggtgatttgttgcaaacgaatatttcaattcactgcaacatttcatccatacatagtaaaacatcatgcgtacactagctgaaacatgttggtgtaacaaaaaatgaaacggattttcttaatatggcgtttccataatatgtgagtgatttgttgcaacggcgtgtgtggtggagacacgtggcgggggtggtgcggcgtggggacggcacgtgggcggcgggcgcgcgcagcgcccgatttttctagcgcgcgtcgggcacccaatccctggcgtttttcttgatttccatgatcaggggtggatctatacagtagtatgagcggtgtcaagcgacaccgacgactttgggcaaaacctatagcgaaactgcttatccacatattataacactatggtctaagcataattaacatactatgacaccgatagacacgttatgataccaactaatcgattttttagatctgatgatgaataccgaaaatgctcacactcggacgaccgcgcgggatggagaaaaatcggacgctgttgttgacgaaaaaatcgaacacaccggcctgggagatctgcttagctccagtgtaggtccaaatcttggtgaggtgcaggcgtgccagtcagtttgatcctgcaactgacaagatatgcaaatagtagatcaaaacagccgatcggctaacaagccaatggagtggttccagccgatagccgataatagccgatgccgataccagccgatagcgatagggtttaagcaatcggctatatatccaatgtagataatgatataaaggcgatcggctgatgatgatagaatatagcaataatataatccagtataaaccaatcagctagcaatgatatgataaataagcatcgatccgaagtttaaagcacacatcggctggaggtccgatgtcatgaaatccacaaaattagattaaacagtgaaacctttgttgtcatcggctaaatccaacttatatgtatatgcaatcctcatgagccgatgcaacgtccagataacttaccggctgaaaccccgatgaaacccttattggcaatcaataagcaggctagagattatggttctaagcacgacttagtagatcaaacttaactgatgtagcactaagtatgaaaagaaacataatatctagacaatcaagccgatgactgatttttaggatggtagatgcctatgctaatctaatctagcaaggcgatttagccgataccggcagaaaccctaaagcgagagacagccgatagagctaaattgatatgctaagactggattatcagagacatatgataaataggtaggcaaatatatcatccaaaccagagcaatccaagaggtcgaatgtactgatgcaaccttgaacgacgccgatgtagacgatacaattgcctaggccgacggaacattggacttatcccttcgccggagatcgaagacgatgcagccccgcgtcgggtgccaagttccgccggaatgtaaaaaataaaagtagaagtaaaaagggtggcgatgcgctgaattgtattgttgatcgatagattgatagattacaatgaccccgggtgtacatatttatacccatagagagatactagtcctcgtcggacaagaaagaaactaaaaaggaaaagataaagtccttatcggacactaaacacactttcctaaagataaaaggaaactaacaaattatgcctaattaatagataactgtcatgttgcatccttcttgaactcgaactcttctagataagcttcctttgattgatccgactccactaagaacacgacatcgtggcgacttagactcccatcggctgattctagaactttgaagccgatactgactctaaaccgatggtaactttgggcttaccaaatttcactgttaacagctgtctgccactgcagatnnaaataatcttttcttttcttatttcttcaaaagattttttatcgtaaactatttatctaatctacgatctgattgcacccctaaattcgttacaattaaatctttacaacaagaccacacattattatatttcgacaaaaaatattttaatttttttattgattttttttaatgttgcatgtggtctcttttgatgtttcaaccaatagttttacaatgtttcagctagtgtacttatgatgtttcactgtgtacggatcaaatgttgcagtggaacgcgccgttgcaataaatcacacacatattttggaaaccctctgttaagggaatttggtttattttttgttccacaaaaaatgtttcacctagtgcactcacaatgttccactacgtatagatctaatattgcagtgaactgaaatatttcattgcaacaaaaaacccacatattttggaaacctcctattaagaaaattcgtttcattttttgtttcacaaaaaaatgttccacctagtatacttataatgtttcactatgtatagatccaatgttgcagtgaactgaaacattcttccactatttattgaaacattgtttttatataaggtgaaacaacaccagatttaaacgagtgaaacattttcgatctacttagtgaaacaattccgatatacctggtaaaacatcgtgcaatatttaaaaataattcaataataagctaattt

SEQ ID NO: 50685 - DNA, 2584 bp, Oryza sativa
gtccatgcacatttcagctcgatctacacaaaagttcaaattgaaccaacaaaagtaaaaaactaaaaaagataccgaagcaaaatttcagtaacaacagattattttttttagggtttgttggaaccatgccaccctaattttacaaaatttgagatatgtcacccgtatctcagtgacatgtaggacccacatgagtcaatgacatgtcggtcagggtggcatatcacaaatttgaaatttgtgtggtatggttcaaattttcccttttttttagagtaaaatgcatggagggtcattaaacttgtttaagtgtgtcatataggtcactctacttttaaaatgcacatttgggtcactaatgtgagataagtgagtcacttacccatctaactattcacgcgagcatactttgtacacatggcatgccatgtaggattgaaaaaattgcatttgaaaatatgcaggaaaccccctatgcattgtgattaaatcgtctcgtatcaattccctaaataaattgactagtaaacagatcctgaaatcagtgcatgacacgttcgtaggaggctgccaatattcttattcccgctgaatgcatatgtgatatcaattttttaatggatgtgttagaccattggaaattaacagatactagaccattgtatggcataagaattcaccaatttgttggcatgcatgttttgccatagtggcttctacttttacttttaatttcagagacactacaggctttcataaatcaacatttcttaatgatgttccacatctcaaaatcacatagaaaacgatcttacattaactgataacatccatgagcagtcaacactaagttccactaaccaaaagccataaatttcaaaaggggaataaatccaattgttgaattgtgcaccttttattttgcattttgcaacattgaaaaaacaagatagaaagcacccatataacttctatttttttttcttctggctaggtggtctagatgatctggccgttgttgatcttgtgttgcttctcttcatccttgctctgcccacgtgtgtacatgttgtcgctcttggctgtggtagtgtatttctattagcttcaatgaagactgaatccggtaaagggcctagctggttaatggaggattgagttgatgttgcctaacaagcaaattagtatgaaacatgagtaggtagcagatagtgacagtgaaaaatgttaaaccatgcatgcaactaacctgttctaataaagtagtcaacactgaagtgctatgttggccctcttgtactaattcttctggaacaattggaaacgtttgacataaaagattaagaaatgcttgccgaaggtgacagtacataaaggatatagttaactatacctcattcatgtaaacatctttgtcatcttgcattacttgtacactcctcttcctttttggtctcatctttttagttgtaccaagtaattcacaattattcctattgtgtccagccccatcacaataactacaatgaataaccacgccatgcttggacaattttgtaccaccctccaattcaatggattgcttcctcctagttttctttggtctccctactttcttttcatatttaggaggttggacatttacaccattcattttttcccatttagattgatcccttgaaggcactatgttatatttgtatgcagcacgaaatgactctaatgagtagcatggagataccatgtcctcagttgtatcctttcattcctaaagcatgatatggcatgactacatggtattcctgtgagttgccagcgtctgcaatcacaacacttcacattgatataactatgaactggtgatctctgtcggtgacttggaaaatacccttcccagcaggcagtgtgtagcatgtattggctaactcggcagtcttctctagtttctgttttatctttgggcatatatttccactccatttctcctcaacctccttttgcttcatgtacactctagtcatgatttaggtctttattttctcaatcatgctcaatattggcagttcccttgcatgaagaatgtacctacagattgaaagaggaaatgttaatactattgataatgctaattggaaagcacacatgtacaattaggaaaaatatatctcacttattgaaaacttcacaactattattcaacaatatatcacacttcggaaaatcactaaagaatgctctacaccacgtatttggtgggattttgaaacaacccacagtttagttaaatcataaatctgtagttatgcacataattatagttttaaaaggaaccaagcagtgcacatgtaggcactcaacttagtttcccatgcattaaatcagaatcccatatatattggttagcaaccccaaagcatttcaatacatgtctagaagtacattcgattaaataattaaaaatgtagatggtctgaatacataagcatataagaggttcatactagctacaaattagctgtcacacccataaactgcaactttcatctgctaactcagagaggtatcaatgccatcaaggata

SEQ ID NO: 50686 - DNA, 701 bp, Oryza sativa
ttttccccatattaccccacccacattccctagtaaattaaacttaaaccaatctatcaccagtgtgtagttttccctagcaccttagttcagtttttaataggaaagaaggaggagcagcagcagcagataaaatggaggagtaaggaataggagcacttacctaggggatggttgcacggtgatgtcgagctctatggggcactggtcagggcatctgggcttagagctccatgcgtgactccattctagccatgggagtccacttctttgagctgtgggttggagagctcaaggaggaggattaggagggcaggtcttgttggtagcctgggcattgaggttgccgagagcaacatggtggcagcagcaacagtactagagtggggatttgagggagaagatagccactgctagcagcaaatggaggaaggaagaaggggattagctagctgatgcttttacctgtacaagtcataagaggggagagaaggggagaggtctgtacagatgagaacagaggagaaaaggaaaggtggactaattgctagatgcacattagtaggctacacagaacaccaacttgagcatagggacccaataatctgcagtccaagtatactttagataaattatctagcacatcgcaattggagtttcggtataataaaaaggttacaaatttgtaagcacatttgtaa

SEQ ID NO: 50687 - DNA, 1582 bp, Oryza sativa
tcatcttctcttccattgttttaccttttatcttttccaatgcagtataaatgaagggcatcaaagtggtttgagttgttttcttaattattgtgcagaagtctaaaaccatttatgcagcacagatagctattaactgtgtaatataatatctaacatcatggctattcgtattgcaataataatgaacggtaataaggatgaacacaaaatcaagtgactgcaacaaaagcaacagaggaaaaaaactgagagaggtaatacttgatcatatgcaaatcatcctcttttcctttgaatccagcatgaggaaaattgaagataattcgatcaaaccgtctcagcttcaggttggtgtgatccttcatcctttttgcatcgatgccatgcaaaacagtggcccccatccttttcagctccattatatttgattctgctttgctgtatttgcccctcaggtcctctgttcacaagtaatgcacaaatattagcatattgcagagaaaatggataaacacagctaacaattatctataatctatcaattgcccttctttctctaatttagaaggagttccactatcaacacaatgtaattaacttgattcgttagaagagtttctattgagtctctgcacctatccttttcctttggattctaattcaagaaccgcttgttttcttaaaacacggatttggctcaggattgccccttttaatccagggtttctctgaatttggaagttactacttaccaacagtattataggtttgaggttgtaagatatacaggggaagttcgatgcatgtggaggtctcaagtaagaattagaaatgaaacaaataggaaacatggagactattgagagttaaaaaaaaatctatagaaaccgacaaacagccatcgttacatggagacatggagttaaatcagggtaactttgtgagttagttttttattgttgtgtgttaaagctctaactgtgaattctgtcctttctcttctaaggaaatccttttcagatcctaaattctttactggctgtactgactcttgagtcaaccatatcataacaaatttgctaaatattgtaagaacatattgccacgttgagcttcaaaaagcaaactataagaaagcaaagaggcgaggccatgccaaactgatgatcatcaaaccatctcgcccaaaatcattgtcaaaagacaacactgggtacccaacctagtctaggccaattgaactgtactaccaacaaggtccataaataggttgagcttagcaaattagcaaatttacattgttcaggccgacaggtcctatcaatgcaaaatgcagaaaaaaatgctaaaggtggcagtaatgcttactcagcatgcatgttccttccatgacatactacatgttagtagtgagaaacaatatgccacaaatagtctctccgtatcaaaataaatccttcacaggatttagctatagcattcccaatcccagcattcatgtattggaacaattatttattttcaatatatgcaggagaatagtgttccataaagagatcacatataaatcattaacgat

SEQ ID NO: 50688 - DNA, 1802 bp, Oryza sativa
cactcaaaatgaacccttttttttaatataacaccttgatcttaacagggtaaaatgcaccagatctatttaccaaattatcctagaatctacaaaaattggcacatggattcatgcatgcacccccattgtttgttccatttatggattcccatatccaaggcgagaagaaccctaccaaaatgctaattgcgcccataaaatctgcaccattattgacgagaagcagagaggaagaacagagagggtcgaaccaatgtgtccagcgaggtggcgacgaggttgtcgccggagccgaacgcggtggcgagcgccagcgagaaggagaagtccccgtccccgacggtgagtatgctctggagggaggagtagtgcttcagccacttcaccccctcgtcgtcctcctcccgctccgccgcggcgatcgcgttaaccccctccgccacggccgccgcctcgtcggccaccggaatcgcttgaagcgcctcgcccttgacatccgcagccgcggccaccgtgttcccccccgctgctggtgcatgcgccgcctcgttctcgcccgctaccgccgccgccgccaccgtgtccccctccgccgctgcatgcgccgcccccttcgcggcgaccaccatgtccccctccgctgcaggcgcctcccccttcgccgcggccaccgtgtccccctccgctgcaggcgccgccgcattctcgtccaccatcgcggcgaccgtgcccccctccgctgcatgcgccggcacctcctcctccccgcaccaattcgcccccggcgccgccgcattcgcctccctcccgtcgccgtcggccacgatcgcccgcaccaccacctccacctccacctccacctcctccagcggcggcttctcctcaccctctgtcaccaccgccgcagccgccgctggcgagagcagcgcgaccgccgccatgcgcgcgtgcgtgtgacacgatcggcgtagtggagtggagttggagtgggctcgagtacaaacagtttccgcgcgtgaggatgaggaggaggaggaggacgcggcggcggaggcgaaaggatgcttttgacctcccggaggaaaaaactcgcgggattcccgaggaaggggtgggtcccacatgcagtgacacgagggcatgcactagtggtagtatgagcatctacgtttatactgtgcttttattaaaaaaatatattttatttataaattattatttgtttgtaaatatgacgtaatttacagataaatagcaatttataaataaaacttatatttaaaaaaaacacagcacaaacgcaagcgctcacaacatgtgcacacttacaccctatagatgtctcgttgtcgatgagtacgtcgtctatcactgaaagaataattagccgtaaatacgagcacactcataccctgtccttatggccgtcgcctgccactaaaaaaataattagccgtaaatacgagcaccctcacaccctgtctttatgggcatcttgttgttgacgggtacgtcgcctataactgaaagaataattaaccgtaaatgcaagcactcatgatctaggattttaaccgggggtaggctgattccaccacaagaaacctaatcagttgatctacgctcacttcgctccaaatttaaaagcaaaaaagcaaaatcagttgggtggactggattttatatacatgttcttagcgatctatgagcaaagactaaaaaataaacttcgatgaaaaaacctcaaaatcaactctaaatttaaggttaaaaatttaaattttagctgataagtataa

SEQ ID NO: 50689 - DNA, 1055 bp, Oryza sativa
ttttcttcctagcttttcatgctcatcctctcactatcaaccagtatccctcagccttattattcttttctagtaggagtactaatctttggcatgaggtagccgtgcccgtttatagcagtttaccgtggacatgcttcacaagctagtaaaccgtatatttttcaaagaagttttatataaaaatttcttagaatacttctccaaatctatttctattttttttaaaaaaaatatttatccatttatatccctaaataattaccataaaatcagaataatctaccatccatcctccacaatctattgcgaaccgggagctagtagcagagctagaagtcatgagctcatgatgcaacggggcataccctgctgggtgttgagtactccagtacagtattcgccgtgccgtcaaatttgtaggccctatacaaggctctaagcgagacctaaatcaagtaccaaatatagttaaaataatatatatactgcagagtaaatgcgatatattaagaatagtatattttttaactcttgttttgcataatcagaaactgccaagctagaaacggagaatgtttgttgtttttgttggcttgctgcatagtgcattgcttgttttatgccagcaagcaatattttattttatgccagcaagcaatattttatgcgacagcaagaatgtcaagtagtagtagaaaccagtgtttcagtagaaccagccctcagattgggcttacaagtaaagccaagataaccagggttttttcagtcccaaacggcacctgcattacaaaaaggaacttggctgttgtggtcagtcagagttttgagacacaaaacgatcctacctgtacattttcgacatcatccatctaacacagcacctcttgaaatgaaatgccaagttcttctatcctagagaaatgctgatccttttagcacttagcaggtcaaattctcaaaaagatacacaccaagtcaccaaccaactatcattgatcaccaccgtgtagcgtgcaacgtaatcatagtttgcagccacttctccttct

SEQ ID NO: 50690 - DNA, 724 bp, Oryza sativa
tcctgcacccctttattatctctttagatttgtccgatcgatcagtcacactgaaccatgtttaatctctctcttatcagacatacattacagttctttctcttgctgcattttccatcaggtattgcatatgaccctggtcaagcagatggagatgatggagaccttggaagctatgcaacatcactaccaatcttccagtgtcagggtgagtcaatcacaaaccttcattttcatttatgcatgttaatagaacttgccttgtgatattatcctggctacttttgcagaggagattgtgctgttcataagtaaaagactgctcttgtctggctggccttgagcgaccatgaagactgaagctgtagcctgaaaaccttctgcaagtgccatttttgactcggagatcttcagccctgtgcagaggaaagatcatcgctcgctcagctctgtcgctggcttgctgcatcgcagcttgtgaatccgttttggtagctgttaatctcaacaataatcccttttttgcctccctgaacattaccaatagcaagatcagtgatgcatctgtcagctgctgtagctctctgctctgaattggaggattgaagggagaatctgttgttacattgtctgaatttttgtgatccatatgctgaaaggacgtttcatggcggctgtgcttcttcctttgctaatctccaggcaagttcttgtttttctgcaa

SEQ ID NO: 50691 - DNA, 1462 bp, Oryza sativa
cttgtcaatgctcaatcatctgaggttttatctccctgaaatcttcccgaagcttagcaaggtgttattcctggatgatgacactgtagtacagcaggacttaagtgcgatttggtccattgatctaaaaggcaaggttaatggtgctgttgagacctgtggagagacctttcataggtttgataagtacctcaacttctcaaatcctcttattgccagcaattttgacccgcgtgcctgcggttgggcgtatggcatgaatgtgttcgatctatctgagtggagaagacaaaagattactgacgtctaccacaattggcaaagactggtgagtacttatgagcttacaatcatatttatttgtaaaaatatttggagatggtctctctgccatcctactgctcctcctgcacttgaacaccagtagatgtaaaatattaagcctcaaccagcagagaccatcttgtcaatctcgttgtttgaagaaaagctgtagtgggtccgttcagctagtgtaatgaaaacttgcacttctaaccctggctggaattgaattgaaagcacctgatctaatgttccatacttccaactaggaattgagcatgttatattgttatgcttagaaaagctgctacagttaaaccgatgaacaacctcaaattctcaaccgaaaatatgatttaccattctgtagtgctggtttttttttctcgaacgtgcaggagagatgtagtgttggtttgtcctattgttctgctgtttatttcacttattgatatctgatttctgcagaacgaaaataggatattgtggaagctaggtactcttcctgctggtctcgtaacattttggaaccgtaccttccctcttcatcactcctggcatcagttgggacttgggtacaacccaaacatcaatgagaaggatatccggagggcatctgtcatacactacaatggtaatctgaaaccctggcttgagattggattgtccagatatcgcaaatactggtcaaaatacgtcgatttcgatcaagtcttcctacgggactgcaatataaatccctgaatgacagagtgttgtattatccaattattttcttttcacctggtagattaattctttacgctctaggttttatttaagctgtctagagcgatattcttttatctgggctcttctctcttgtaaaggttccagcaagttagtggtaggctttagatcagagacatgttcaatcacagatcacgaaagctgcatcacattttgtagtcactaatgttaatatagtaaattatttgattgtattattcctatggaagagtatttaggagtacctttattaatcttatgtggctccagtatttcaggtatactacttggtcatttgttcacttgaaagccatttattaatctgaacaaaaccaatatttgctgactcgaacacgaatgcatatacatg

SEQ ID NO: 50692 - DNA, 2533 bp, Oryza sativa
  unsure (1)..(2533): unsure at all n locations
atgcagcgtttgttccttcttccttcttggcggcggcgtcctagctctgcaccgccgttaagcaacagccgttccggattccatggacagatcagatcaaattcgttattatctccatctcaagaaaaaaaaatcttgagagctatatatatatcgcatcgctcttgcagtacatttttccatccgtttgcaatggcgagaatactcctagcgttcgccggcgacgccgcgtcggcggcgatggcgacggcgaccggcctcgggcggccgtggttcatggcgttgtgcatggtggtggtttgctcgttgaccgtctcgttcgccgtcttcctctgcggccacagctccggcgtccacgacggcgatctcctcaggaagaagaagcctatgaaaccaccgccgccttcatccaagaagaagaaggtgtccacgtcgatgtccggcacggtggtcgacacgacgggcatgtatacggcggcgtacggcgtcgccgtcgtcggtggacacggtggccatggcggcggcgggtgcggtggcggcggcggcggcggtggtggaggcggttgctgcggcggcggcggtggctgtggtggtggtggtggtggcggcggcggcggcggctgttagacttgccggatcttgcgatggctttgcatggacagtgatggctgcttggtcattgtaaggtagtcttgtgatctctcctgtgtttggcctgatgttaatcttaggaaatttttgttacaaatatttgtgtcagtttgtagagattttgatcaatgctaatggattttgacatcttgtcatctgttcatgaggtcaacaaaaaacagaatccttgtgtaaactaggggcttaggggtttgtagttctgaatgtgttcatgaggtcaacaaaaaacagaatgcttgtgtannnncnncccggatttgtagttctgaatgtgttcgctagattgtgacttttaagtgctttacagtttgtcgtcaggatatttcaaaatgtgacaaatcagactttatcgctcgttgaaatactcacaaatattctcgcaaaaaaaaaagagaatatactacaatcataagataatttaatagttaggtactagatagactatcattgtagtatgcacttgcagtcaacagtaaacagctttagtcaattcgatcgcccatttgcccacaccatttgtttccctaatatgtcaaactcaatgccactacgaatcaattgtactccagtgccagattcataatcagtgcacaaagcagagacaaaaagccttcactggatcacctctgccttaaatatcgcctcaatactttgaacgacgacgagcatgttgaacatgcaggcactgcacatggcaagcaggattcagtaggtgaaatttcgacgacgacgatgattaattttctaatttcgaagcgaactctgcttcatttaaaaaaacgctgcacatggcggtcagtgaaggtaattcagaaggtgaaatttcgtctgcagtgttgttctctgaattgtagaataattttctccttccaaagctttgctccagttcattcaggattatcgtactttgcaagtgactgttctttactcaatgtccaaatcacttttctaagaccacgtttcaggctattgctgcaaatgcagaatgaacattttgggtataaagctgtccaaaaattcatcctaaaatttgcacacagttttgccacatcctctgaatctgtagatgtaaagtcgtgtgcagcaaaatagcaaattgaatggcatactctgaatctgacgagtgagtgaaagctgcagtagtcaagcacgcagacttgcagtctaaccagtttcagcctttcaggttttgctgatgccaataaaacacctacctgttccttgcattctgacaaaattttctctgaactgatcaacaacgaaatccttgaactccacttgatctgtctagtactccctccgtttcaaaatgtttgacaccgctgattttttatcacatgttttaccgttcgtcttattcaaaaacttttgtgaaatatgtaaaattatatacctacataaaaatatatttaacaatgaatcaaatgatatgaaaagaattaataaggttaaatatatgctaaaaagtcaacggcgtcaaacatttcgaaacgggagtattagtatttctctcgttccttcgtaacttaatcgttaagaaatcagcagcaggttcagcactcggtcgccatcactccatcagaaaaatgatcacgattgaatatgttaaaccactactactaagcaagccaatcggcgatttgattgcttagctcaaagtacgctcaactaaccgggaaacctacaccgtattgacccggccaaaatctagccgtctatacatcaatttatcagaataaatttattcacatgattaattctcagaatattttgcttaattcttagagcgattcgtgcacaaattcgttgaagtgcaaagtcaaatgcagaatcacacatgcaatttggctttttttttttg

SEQ ID NO: 50693 - DNA, 2279 bp, Oryza sativa
tccttttttttctcccaaatcgatcgatccaatgtaaatttcttgaaatcttgatctttgatgctcttgctttgaactcgcgatcatatgtaaattgatcgatcaagctgatgtgctcttggtgttcttgagtattagcatggaagctcatcagttcctcttcgatcaatcctatgtaaattccttgaaaccttaatcttaatgttctcttcctcacttgatgctcgtgctttcaacttgcaattctatgtaaattgatcgatcaagtagatgttcttggtgttcttgagtattattatagcatgaaagttcatcagctctcctgagcttgtgaaccaatttgtgttttgtttgttatcgattagtttgatcatggcatgttcagattggtctgccactttcaggtggcaaagcacacaactgatgcagcaaatatctatctccaatatatcattttcaagtgtgcaattcggagttgggagttagttggggggtaggcaactttattagtagatgagcagctgagctcccctctcgtagtctgaagcgactgcaaaggtgcaaagccgagctaacacgccaacgcacgcaattcaggggagcaacccaatcaactcccggagtcaaaaaactggagctgcacactggattctgcggctgcaaacttcttgattttcttgcctatttttccaatctatgtacaaaatcagccgtgagtaacagtgtgaggagtggaattctgcaacgtgtatgatcaactgcacagcataaattgcttaattaaaacgtgtgtggggtcagctccgacaaaaattagcacatagagtggatattctgggctaatactatttacttcatccgtcccaaaatttaactatttttagacgatacggtctacaagatgctactttaaccaacaattaccccataaaaataagatattctaaataaaaagagttacatattatgatagtttttttaataataaatctataaacatcaattttatattattgatcttttttttattaatagtcaaagtttaaaatgtttggcttatcactatgctaaaaatgcttatattttaggatggaaggagtatttttttcgctaagtgcataatttagaaaataaattagtatatgattagtaaagctacggctaataagctatggaaaaataaacaaaagaaatgatataaggataggattggctgggttaaaaaaacaaaacgatgaaaaatcacctaactgaaaattactaattttagatgccatttacaataaaaagaagaagggtaaaatataggcagacgtatggcccggatccatgcgaagattcatgacccgataaaaaatcaatgtagaaaataaattaatgaaaaacaatgcagactaggggtggatagcgagccggctcggctcggtctagctcgttatcctaacgagctagaaacccagctcggctcggctcgtttgaaagctcgagccagctcgttagactcgcgagccaatccaacaagacagcaagctccggaggaggggacctgtgagtgcaacctacgccttctctggcagcggtggcggcggccctagcgccggctggggaagtgcggctggtggcggctgcggctggggaagtgcaacggcagcggcgactctagcggcggtggccctagcggcggtggcctagtgcctgctggggaagtgcagtggcggttggggaagtgcggctggcggcggcagcaggggtgacggccctagcggcttgcggcagcggcgacgcgagcgcctggcgacagcggcggcgcgagcgcctggcgacggcgtcggcgcagtcttgtgcggcgaagcgatgcggatgtgcggtctcgactctcgtctcgtactcttgtgtggtgcggtggtcgacggatgaggaataggagtgaccgagtgaggagaccaagagaggactagggttttgcttttgctgttgtcttgggcttgggcctttgctattgtattgggttgggcctttgtggttgtctaataagtcctggctcgttaaggctcgcgagctggctcgagtcggctcgttatccctaacgagctaaaatgccagctcagctcgttaagaaaatcaaataagccgagccgagtctgtcacgagccgagcgagctaacctgtccaccctaatgtagactatgtttgttctcttagtttggagaaagttttgtagtgcacgtgaaacgagaaaactcaatgcacataattaattaactattatagatttaaaa

SEQ ID NO: 50694 - DNA, 3305 bp, Oryza sativa
taataataataataataataataataataataataataataataataataataataaacacaaaaacaaatccatcacccaaacccaagtgaagagaagcagcaaagagagagcttttccatccccaaatcccctcctcctcctcaaaccctagctaagctccgcttgcagcagccatggatcccaccaaatccagcacgccgccgccggtgatgggcgcgcccgtcggcttcccgcctggcgcgtaccctccgcctccccccgccggcgccgccgccgccgcctacgcgcagcagctctacgcgccccccgccgccgcggcggcgcagcaggcggcggcggcgcagcagcagctgcagatgttctgggcggagcagtaccgcgagatcgaggccaccaccgacttcaagaaccacaacctccccctggcccgcatcaagaagatcatgaaggccgacgaggacgtccgcatgatcgccgccgaggcccccgtcgtgttcgcccgcgcctgcgagatgttcatcctcgagctcacccaccgcggctgggcgcacgccgaggagaacaagcgccgtacgctgcagaagtccgacattgccgccgccatcgcgcgcaccgaggtgttcgacttcctcgtcgacatcgtgccccgcgacgacgccaaggacgccgacgccgccgcggccgcggcggcggccggcatcccccgccccgccgccggtgtgccggccaccgatccgctcgcctactactatgtgccccagcagtaatgtatctgattaacccctttcaagccttttctaagcgaaggatgtgttgttgtttgttgttgctgttgctgttcttgttgttgttgttgccgcgtaataagatatgttgataatttatggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcatgattactgtgctcatgtgctgtgcaatttatgttctttgttttggatgtacaatgctgtaaccagaatttggttgtgtaaggaaactattaaaggttgtgcgagggcagtgtggctatcgctgcattttagcttacaagtccctcgtatgcagtaaggtttatgtgttcaaagccaaatgcggaagcttttcgtcaatgaagttgacacacttaacttaagtgccttataggtttttgctattattgatgtggttgacatacttggttgatttggtttgtcattgacaatttagctcttgtgtttggtttcaaggaaggttcttttttttgtcaaaacatgaagaaacaaaatatcaaatattgcctctccaatcttatacaccctccacccacaaatataaagaatctaggttgtttagaagagtttaatgttcaggtgaaattactttgatgcccctgggtgtttacttgattgggaaagatcattcctagtgatgcaactactagtaagtaataaatccaaaatcccttatattcgtggataaattttgaatcccaaaatcccttatatttgtggacggagtgagtatatagttactaaacaatagttccgcatttctaatttttcacctatggttgtatgggtttgcagaattatgcagttttctttttgctattgtttcgtagggcataaagaaggtaattaattcggttcttatttatttcctttacgcttctgtattttcagtcctcagtgtgtagagtttaaagtagtgatgtcatgtgtaagtatggattttcttttaccactgaatccctcatgcgaacttggatatgtggtccttttctgcacagttagtttatcaacacttcttggttatgtaatttgcagctactcatgtggaacaaccagcactacaaacatgcatttgcagtacacatcattcatcttaaactgctttacctattgggtttgctgataattatggctttaaagttagcaatgcccatttcatactgtaacggttatttgcttctgaaatcatattgaaatgtggcatgttatgcttcagaacatcattgttacgttccaatttgttcatgtgactttcatcctgttctatgtggatcatctacccaggcaggagcattccatgatactgcttgcatttgatatttggaaaagcttttgcttttagcatttgttttcctctctttggaatagcttcctctgacccagtatctgtatattattggactgcagtttataccttgtttcttctgattttattggctgagactatgctcttcctggaatgaaatgacaagtagttattacctctgaaggaaaaagtacaccagtggtctctcaacttgtcatcgagttacagaatcatcccccaaccgcaaaaccagatatccggcgtccgtcattcggtggttttgaccctagttttattcgacgtggcggctgagtcagcgtgggccccacctatcaggatgccacgtgccaccctctctctccttcccctcctttcacttcctctctctctctcgctcgcttttctcctctaccaggccagccggcgggtcgtaaggtcgccggggcgagaagggagaggagaaggcccgacggctggcgacaggcgacgaggcggcggcggcgacgcgggagcaggccggttggggaggaggccggcgacacagaggccataggccgtgcgggccgccgccagggacatctccacggccgccgtcgtctgggcgctcacgcacgtcgtccagcacggcgacaccatcctgctcctcgccgtcatgctgctgccgcacagggcacaactctggtatacatggccatgccttcctcttgaacagcttgccaatttacaatgccatttttatactgtatgattgagctctttggatttgtcttcatggatgaactttcactagttcaattacagttcttttcctctcgttttcaggcaagaagtcctgggagtttccgctctttgcagggggttgtgcgagcggccacaggagcgtgttgattcagaattcggatgtcgcttatttgtgtaatcaaatgatgctaaaacttcgtgatttttatgatccgagcaaggtacaaaaaggagcgctgttgtgttttttcagttcaatattccagcacaagcacaagcacaacaaaagcacgatggcagtggtgggagacggcggggcggtggccgtcatcgagcggcggcgcctgggcttg

SEQ ID NO: 50695 - DNA, 2023 bp, Oryza sativa
ttcgttccatgtcgctctcacgccgtgcgaatgtgccatgatcctgcatgcatcatcgccaagattatattcctcacattttttcttcctatcgctcctagtcgtctgtttgggagcttaaaattatgaaaagcagctgctgagaagctagctggtgagaatctgaagaatttgagttctagttcattctccagattctacaattacagattcttataatttaggtaaaaagctggactgtttgggagcttctgtcagccggagattctgtgagaagctgcagctgctagaagcttccccaaacagacccctagttgtactccagctgatcgattcactctattttatatgcaccttgctctctagcttatcaaacgtagccaagacttgaattttaaagcttaaattgattttgatgttcttttcatcgtaattcacttaccgaccttagtcggcatttgaatttttaaaaataatttttagagctgattttgatttttttttcagcggaatttattttcacgtatgtaaaagttttacctataaattattaattttcagcggagtaagcattagtgttatgggttataatcatctggtatgcttaaaatctctttacttggacttagttgggacaattgctaatgcattctcgtgcccatctctataaatacggcctgctagctttgctcttgtatctgcacacaagaactagctgcaaagtcctcaaggcgaacggcctccatcttctccttccagctcctcccatggcgtccctcgtcgccatcgccatcgccatggctctcatggtgcagaggatatcccagccatggctgaaattaacttgacgcatatcatctcatcatcacttgcatttcaacttctggattgtgcagacatgtttagctgatgcagtaaacgttgcctgtttgaattggtccttgatcaggtggttcaacctggccggcagatgactgcctttgctgctcggacgtcgccggcggcggcggcggaggcgttctggcgtgccgccatgcccggcgctcccatgccggacgccatcgtcgagctcctccaccatggtgaatccgtgaacttaattgtgtacactactttaaatgatactagtattagtgatggtcactactagaaaacaagtttttgcaggcagctagtaaatatttcgccggtaggctaaggcctgcgaaagtcgttgatttttgcaggcggagcctctatccgcttgcgcagacggcatccttgtatcacccacttgcaaaaagtttttgggggcaaaaaagaaaaagattaaaaaaaaagcaatttccactacatgcaaagcatcctattcaaatcaaaatcagattcattcaacaaagaaacaacatcgaacaggcagctacaatcagatgcactagaataaacactataagctgacatgtaagatcctcacatatatgaatgcttttgctgttatatatctatttttttaacgacggttatatatctaattaactaactatactataaacttatcttttgttttttgcttttatcttttataatatccgttgcaacgcacgaatctttagctactgatcataaaatgaacagaaataagagattatgtttttatacgtgggagcctctcttacatgcgtagctgcatgcgtgcatgcagagcacggcgttgctagcgccggcggcaaggccaacggcggcggcgacggtccaccgccgccgatgaacttcaactacgacgactacagggccctgcctcggagcgacgccccttccccggatgcattgaaccgcgtcgccgccgtacagaacgccgacgagaacggcgtgtcctcgccgccgccgccgccgccgacggtgttcttcctcgaggacgccgtgcgcgtcggcgagagcctgcccctaccgcgaccggcggccgacgcaaccgccgccggcgcagcggcggccacggcgttgccgccgctgcggctgtacaccgtccggtcggtgagggcaatcg

SEQ ID NO: 50696 - DNA, 2837 bp, Oryza sativa
ccggaagcgcggcgggcggcggcggcgccgccgcgtcgacttccggtacccggccgccatgtccatcgaggacgtccgcgacgccgaggaggagctcgccgtcgccgcgttccgcgaccgcctcgccgtgcacgccctcctccccgacaagcacgacgactaccacatgatgctcaggtggagaaatgccaagaaaaaagaaacagaaaatctatcattttttcccccaaaaagttgctaatgataactcccgttgtgattcaggtttctgaaggcaagaaagtttgattcggagaaggcgatgcaaatgtgggcggagatgctgcgatggaggaaggagttcggagccgacacgatcttggaggtgatcagagattcagatagtaacattttcacctgataacttacagtgtctgaataatttttggattgttcatttgttcttcatttcttgggtttcttgtggtttaggagttcgagttcgatgagctcgacgacgtgctccggtactaccctcagggctaccatggcgtcgatcgggaaggccggccggtgtacatcgagaggctcggcaaggtgtatcccaacaagctgatgcagatcacctcggtggacaggtacatcaagtaccatgtgcaggagttcgagagggctttcagggagaggttccctgcctgcacattggcggccaagaggcacattgattccacaaccaccatactggatgtccatggcgtggtatgtatgccaatgacaaagctccaacattgggtttggatatatgtgtgttgtgttgtctttagtgttggatttttgtcaatccttcagttttaatgttgctgttgttgtgttgttttgttttgtttgttgttgcaggggctgaagaatttctcaaagactgcaagggagcttgttcaccggatgcagaagatagatagtgattactatcctgaggtaattttggatttccatgggtgtgatgtgtgtagtgttggttagtgaagtgcacattttaattgcacatgaatttgcagacattacatcagatgtatgtagtgaatgctggcagtggcttcaagctgatatggaacagtgtgaaagggtttcttgacccaaaaacttcttcaaagattcatgtaagtgacatgtttgtgatcaatgaggattagcatcttactggtgtgttaaaattgggtctaaaattgttgttttgcttaggttcttggtacaaactaccagagtagacttcttgaagtaattgacaaaaggttagtatcaactagctgcaactagcaaccatcgttgaaactcagcttgtatatatttatacagctatagctcttcagcttaccaagatttggaaaatgctttgtgatttcacagtgaattgccagagtttcttggcggttcatgtacatgcagtgaaggtggttgccttggttctaacaaagggccgtggaatgatcatgtcattttgaaggtacctctcaatttgtgatcctgaccatacttttgtacaacagccccaacattagaaatgctgtccatggaagattacttgtgagttgtgacagcgttctagaaatgaatatccctctgaaaagtaaactaatgtggaagtttcttttgtagctgatacacagtatgaggagcagtagtagtatgagggaaatcaagcaagtttctgatagcgaagacaggagcggatcttccctaagggcagaaaaattgaaggcaaggttctgaatgtctcttttccttcaaccattccaaactccaatgaagtattgcttcgtagttcctgatgaaccttttgctattgtttcttctggaagcaggggatgatgagtgatatatcaaatgctgaatcagagtcagatgttgatgagttcagtttatcagctgtcctgaggagtactgactacagtttccttactccagttagcgaagaagtatgtgctgtgcttatttgttgaactatcctttactttaactaagatacattatctccagttattttgatgccttgagctatgttcttgatacattatatgaactgactcgatatcaaaatgcctgcactaggttaagggatcagattcttcaactttctgtagttgtgagtcttgtgacaggaagggtctcccagatgtaactcctgaatcttctcagtctgtacaacaatcttctgaaatggtgccaaaccaactggtctctcatgaacattcatccacaaccagatggatgaataatttaggtacctcttctttttcatagcaagttagttgcatttcagtacagtttccactttagaacaacaaaaagtgtatcttctgttcaaataattcaccacaccaaatatctctttcagattttgtcttttcagccacagtcttattttactgtataattatttataaccacttcttttgaatacccatttttgctcttgcagggaacatggcaattagttttcatggcactctgactggaaggactttgagcaatttcgttagagtagtaggcacactcatgatcaagatactagccgttttcagcctttttgtcagtagaagaggaaacatgctagagaatgttcatccttctaatgtagaagatgaacctcagcctcgaagtgcaacggaagataacatgagtgcttgtttacaacgtcttgaaaaacttgaatcattatgcaatcatctcatgagcaaacctccagatatgccaaaggagaaagagtgtctactgctacaatcgtttgatcggataaaaaccatcgaatcggatctagaaaggactaaaagagtaagttagtttgcaaactaatttgtcat

SEQ ID NO: 50697 - DNA, 2543 bp, Oryza sativa
  unsure (1)..(2543): unsure at all n locations
ctcaacaataatcccttttttgcctccctgaacattaccaatagcaagatcagtgatgcatctgtcagctgctgtagctctctgctctgaattggaggattgaagggagaatctgttgttacattgtctgaatttttgtgatccatatgctgaaaggacgtttcatggcggctgtgcttcttcctttgctaatctccaggcaagttcttgtttttctgcaatggaaatggaaagctctgtcctgcctgaggaacataaactaacatgacgaatnncaggttaatctgaatttctgaacaagttcttgttgagttcatgctgtaaaaagaacatctttttgcaagctgaacactccctgaaaatgcaacatttgcacagccactacattcaccctgccttcctaaccaaccatgtaattttttcctgagcaacagaaactaaaggttaataatcctttttatctgatggagaacggtagttaatctgaattcctgaacaagttctggttgatttcatgctgtaaaaaggaaaaaaaaaataactttctgcaagctgaaccactcctgaactgaatgcaatgttgcacagccactacatttcaccctgacttcctgaccaaccaagtaactttccagtagcaaaagacagtgagatgcatagctaaattacttgaatttcagaagagagtagagagggggagaaaaaaagaaaccaaattgctatggcttagaatatagataccttatcctggacccaaccaatccccacaacgcctcgaaaatccccctcctctccaccacaaaccctcgcattccccccggccccaccatatccgccacgtcacctcccgctatatacccaaaccaccatttacacgagctcgcgagatcaagagagcaccaccactcgatcgcagcgagacccaccctcaagctccaagctccaagaaccatggccgccacctcgctgtcgccgccgaccgtggccgggctgcggctggcgccgtcgccgcgcgtgcggtcgccgtctgtggcgttcagggcggcgccggcgaggaggaggtcggtggcggcgagggcggagctgagcccgtcgctggtgatcagcctgagcaccggcgtctccctgttcctggggcggttcgtgttcttcaacttccagcgggagaacgtggcgaagcaggtgccggagcagaacggcaagacgcacttcgacgccggcgacgagcgcgccaaggagttcgccggcctgctccggtccaacgaccccgtcggcttcaacctcgtcgacgtcctcgcctggggctccctcggccacatcgtcgcctactacatcctcgccacctgcagcaacggatacaacccaaacttcttctgatcattctcatcttggatggatgcaatgtaatctgaatggatctctggtgtttctacgtgattatgtatgagatgggtaaaaaagaaaagaaaaaaggttgattaatttggaacagtagtgcaatcgcgtgtgtatattggccgcatgaaatttgtcagtttgatgatctttctctatgctcatgtatcagttactttcagagtttcagacttcgtatgtgtggcactggcacttacccagaaactcacttaccagtgctccatgattcatgaattgcaatcttgaatttgcaaatagagagcaccaggcacagaaaagtttgaaagtcagtatgaaaatatgagactgattttggaacctatttccaatttcaatttatacggtctgcaaagaaatacatttatataggaacttttgacatttacagaatccagataatcgagaagtacattggtgattgaagtacagtaaagataagaagagattactagcaaaattgagttgatgttacagacttgaaaaattatagggtgaccaatgcttagtaaattacaataaggaacttttcaagaatgcctacacaaaggctcattggcgccggattttctaacctcaggtaggtacaaattcagaggaagagggccatagccggacgaggaaggttccgacggcgatgaacagcagaacaaactggacggagcaaaacagcgaagctctgcttgctcttgcctgcagcttcaggatttctgaagtcctagcaagatctttgcactgtgcctctagcttctccaccatctcctctagcatcagtgccctgttctcggtgtgccgtagcttagcttcaagctgtttgtgatcctcaggtagagatttctgaatgtcaaaaatagcagcttgatcctcagtcaggggattccaagcttgcgatgctcttgtcaggatgaagcattgagtctctgcttccatcttctccaggaacagttgatccatatcagattgcagagacagcagctcggtattgcatagaacatgctgctttggttgtttgtggttgagcacatcgagttcaagtatttctgaatccttatcattgatgagggtagaagcttcgtttagcctagcctcgcgnnnnnnnnnnnnnnnnnnnnnnnnnnnnnnnnnnnnnn

SEQ ID NO: 50698 - DNA, 4130 bp, Oryza sativa
  unsure (1)..(4130): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctacacttccaatctttcatggtgtattcttctatagttaatttaaccagtattatatatttatcttttggaatttgagagattcccttgtcttgaggttttgtggggattctaggcccccatagacttgatgatagtaccaaacacttgtacttttactccatttcacagggtgtgtggattcccacatctggttcttctacttagtggcttcgaccttcaacacttctgctcggtggtggccatgcgagatgatggtgacgatttgaagattactgaaattcacatggcattatggttctatgtggcaggaattcttgctactatccgttctatcgtttagtttttctttgagaacctccacttctgttttcttgaaggatttttgaactcttgctgtctgtcatgttaaaccagtgatgttttagtcaccatctatattatgttaatggagttttcatggctattattatatccatggaaaattttatcgctgtattagaaattcatacggttcgattacatgctagacctcttggagagtggcctgaaatctttgcaaaagcaaaaaaaatgtggtcagtttttgcatagaggtgtgatcccaaccaggatgtgagataagcttgcatgaggcccatgctgttcgctcttcttcaaccaaagtttgagcataagagtacgcaaaccaaaagtgaaatcgttttttccgaattcgtaatcccgtagcaaaaacgtattcctgggagaaacgtgcttctaggccttgtgggtcatactgggccttcctcttcctcgttggtagatatttctaatatttttatccatctcacacatattccaatataaaaaaatatattcctattttatcgaatcacaatacaactatttcttactttgttatctatttccaatacaattaattttttactttcacaaattttgatgtaataattactttaaaaataaaattatttcagaacaaatgtaaagaattaaaaatgaatttattattggacgaaggtagtatacacttcttgtcttttccctactaaaataattaaaaaaataagatctctttccctttcgaaaccaccgaaacccaccagcggcgaggggagcggacgccgaggcggcggcggggttcgtcgatgcgttcgtaagtggcaaagtttcgcaaaatttcgccttctctggagtgggtgttacttcggcattggtttctgttggttccttggcgacaggatgagatgtggttagggttcttcgtgtggttactgtggattccgggagaattttctgtcttggagtgggggagaattttgtgtgaattttaggttgataaatgaatagtgatggctttccttgagttgaggggtgtttgatcttgaattttcttgattgatcccacctgaattagattcagaagtaggagcatgcttatcctggaaattggctaacagaggagtgacactatgacagggaagaaagcgaaggaatgcaggagtggatgatattgtcagagtagaaaaaaaaagtttttcccccctcttttatgggcaaagatatgttagtaccatgaagcttttgggcagtcataaggaggagaaaggggtaatcttgatatggtggtgattagtttcttcagttccattgttcctctgtgatagttcattatctaaaaaacctctgtgatagttaaaattgacttgaattatattgcttaaatgtattaaatgcatggtttatacgttcctcgattaggtttgttctgaaattttgtgaaattattgctttcaggaagatctggtagatcctaggagcaaaccatggcttctaagaaagccttggcaatgcagccaagcaagaaaatttgcatgaccttgttgccgcaagacattgttgaactgatacttctgaggcttccggtaagcactctgctgaggtgccgtggtgtctgcaagcaatgggatggcattattcgggatcctcagtttgccatggtgcacatccagcgtgcgccgcgtcgccccctatttttctttcaacgagagaatttagtccatctcctctaccctagtgaagcaatcctctttgatgaagcatggtcaccatcaaaatgggttgtacctgtgatcgagcctgatgattttttatgtgcttcatgcaatggacttatttgtttacactcggataaatcaacaatcaagatagccaaccttgcaactggtgaatgtatgcatctagtaaaacctgtcaggaactcaaagactgatcacttctcttattacagctttgggtttcacccagtgacaaaacaatacaaggtaatgcactttcttcgtgacgagcacctccatgttggtactagcttcagcataattcaagtttacacactcggtgatgagaaatggagagatgttagaactccacaggctttaagcttgagatgtgtggaaagatctggagttgtcaatgttggtggggcaatgtattggctgactgaagatgaggaaagtgtttggaaacatgcagttgtgacctttgatctcagtgaagaacttttccagtggttacagctcccagcagttgatcctgcaaactatgtgcttggtgatcctgaccagtggctgattacagaggttgatagcaatgtgtctgtaagctattacgagacagggaagctgcatatctggacaattgacagcaagatagagcaaagctggagtcagaagtacaacattcgcttatcaatgcttgaagttccaggaccacattggatctgcggtgataagattatcttgcatgattttaataagaacctatatttctatgagttgatggggaagaattctgagattgagtcgagcaagttagtgaagcaattgagattcagcccccgcaacaacatgcaatgctttatgtttgtgaagtcgcttgtacggttggatgcattcagaaaggctggtgttgtgcgtaggccaaagcgacaggagggttggaaattgaagaagtgggaagtgtggatggataggctccatcgactagagaatcattgcagaagtatccatgatatgaaaccaagatttatgtatatagctagactttctttacataataggattcacgaatttttcttgatggtttgacaaattcctaactcatagttactcttttctgtaggaaaatgcagataaaatgggcatggagatcaaactagatttgcagcagacaccagatttggtaaacttactgcttctgcatcgaattggaagttgtgcagcttttcatatttctggtaaaaaatagctgtgaatatattgtaattaaaactattgcaattatcttgtgtgtgaatgctgcaggatagttccctgcggctgatcaactggttggagtataggcgggtactagagatattgtgtgttaatctcgacaacatgcatgaagtattaacggtatgtgggtgggctgatgtgtttacttcttagggtctctttgtttaggcttagttttttaagtcagcttttggcttatataatttataagccgatggatttaaagtcctaaatttaaggatgaaattatacctctatctcacataagccaaaaaaaaaaaacttctccaacctagcttttagcttaatagtgtaatactggcttatggctttaaaaaagccaaacgaaaaaactgcttatttttttagacttacactttttagctcataaaaacaaagagggcctaattataactatttgtggtttgtttttgtgtcttgtaaaactgacaaaatttacctatatttaggtcatgaacaacacaactggtg

SEQ ID NO: 50699 - DNA, 13748 bp, Oryza sativa
gcaatttgtttcactgccctctctgctctttttactagaggcacaataggtgttataaatactcttcaaattaaagaaacaaatacatccaaaaaaatggtgcaacagtttcctcattaaaaataaggacaatttagtgcaaactgcaaaggttagttcacttcagccaatttattaactttagtattgatgccaaacaaagattgctaaccgaatagcagtatatgctgtatgcctacaaaaaatatatacatgctaacatagttgttggacttacattttgcgataaatttgtcatcccattcatcataagcagctttgtccatgttgccatcctcatctccctcgctgtcatcagtttcattctcagaaataccctttttttaaataaaaaaaaatgttaaacagtgccaacagatagaaaacaaactgattatagttagttaactacataatcaaaagaggctgctaactaaagagaagaccacaaataaatctctggtgatcatggtccttagagtgaagtatattttatactacagtaacagctcaagtgtagtgaacaaccctcaactatctaaaccagttaacatatcccatgtaagataaaaaaaactggattaagtggtggtttcatggttttgacatcccgtaaatatactttttgactaatatggcaactattttttacattttctattaattgggtgcaatattatagagaacttatattaaagaaaaggttaaaatggggctggatttcccttgggggtattttaaccggttatgttggttgtgcttgagggttgattttggaccaagatcataatgcctgctattgctatagtggtattcagtaatatcaagattgggaaatgtacccgcaccccggaccccggtacaggcataatggactagagtaaaaaggcagtagtagagaaataactgatcgtcatgtgtatatatacgaggcgattacccgaaagagaaaggaagggagcatagaatagaaattacctcgagatcgaagacggggtgttccaggtcatcctcagactccatatctgaaatccatccatccattcagtaaaaagattcaagtaaaaaggaagaaaaaatgacggctggtacatgaaaaggaagaggggcggaccgtggtcgtggagggggatcatgtcgcggtgcttgtggactggaaatacccacccacccacccaacacagatggataaagcgtgagatgctggaggtgaaagaggaaagaggagagagagggggtcaggtcaacgttgtcttacaggcgtcgatctcgtcgtcgtcggaggcggaggcggccatcaccggcggcttcacggtcgggggcctcttccacttccccttccccttctccttccccatgcgagcagaagcagagcggatgaggcggcggcgttgttgttgatttgtggggttttagggttttggagatgttgcggcggtgcaggagaggaggcggggcaacacccacatgggcttttctgcctcctcctattgggcttcacaggagaccactggcctggcccagtacgtgattatttctctctctttccatttttttatggaaaaagtgcacccaaggtccctcaacttgtcatcgaattacaaaatcgtcacccaaccacaaaaccggatatccggcgtcccccaactaaccaaaatcggtcataatagatccctcggcggttttaaccccggttttgtcctatgtggcgggtgactcaacgtgggacccacgtgggccccacatgtcaggctgccacatcagcacacgaaccttcttgtgcttggcgttgagctccttagagacggaggccttctcgttcctggctgcgctgcgcgccccccgaaatccctcgaccccaaatggaaactcctcccgaatccgaaggcaaaccaggcgccagaccaggattcaccgtctcggtgcccttcccccctctcctcctccctgatctcgccgcgtcaaggggaagagagagagatgggcagcgaggagaggggagggatctgtgcgtgcgtgtcctccccggcttgaccttcctcccctcctcccccgatttcctttcctttaccttctatattttttcaattataaaaaaaatacctgtgcgttgcaataggtgaaggctattttaatcttattattattgttatacggtttaactaagttgaaattaactctgggaatttgattggatatttttttttagaaaatcatgagatgtaattaggagtttgcatgcgagttttttcaaagagatttcttatatgactccttatgtatttctaaaagcaaacaaacttaaaatccgacttaaacatggatctgtatttctaaaagcgaacagactttaaaaaccgactcaaacacggatgacatatcaaaataatagcaaaaacatctttaatttttataatagtaaagatatatctctgttccaatatgtaggatgggtctgagtctaatcccatcttagtttactaaattttggaacgaagagagtatgtggttttctttttgtctccatcagcgaagtaaaagactaaaaccaattaaataaacgaatttgttaaatgtcattcgacataaatctaaggatgatatctatagattttggaccattatctcctttgactcctgtgagcttcccctcttctccagcactggcaacacccctaattccgacaagggacatacacaagttcatatgaggtcccttaacttgtaaatgaatctgattttcgtccctcaaccagaaaaccaaacacaacgggtcccttaactattaaaaccagtgcagattagatcctcggcggttttgaaggtggttttggctgatgtggcgtctacgtggctaatttgactcggtcttcatctgacgtggcattgacgtggcgcttacgtggcaattcgatcttggaaaaataataaaacctgtgggacccacatgtctcagtttcacccacaaattaataaaaaatagtggggcctacatgggccccacatgtcttcatcttctcttccgcatgcgagcgaggcgggcggtgacctcagtgacgcgccgcctcactccacctctgagccgccgccttcctttcccctcccccgccctcgccgccgctggcgtgtggcgccagacgagacgactgttggatcccgcgtgcaccttgctgccgccgacggcgagctcgacgtaccacatgttgagcgccatctgccagaggacgaaacgaagcctccctgctcgacggaggcggcgtcgcggccgctgggcccacggttgcagcagctggtagccgcccgacgccgccatgtactgctgcagaatatactgtgccgacgccgactcttgtatttttcacagtgagtgagtaccagatgcacagccatgaatcaaccacatcgatctcctagaagcgaagcaccaaacaagcaggtgaagcaagaaatgtgccgtacaatgagggtccccttgatagagaggagaggcaggggatctgctagcttcaaagggatgggggccagcggcgtgcccatgacgcgggggaggaggtggagttcgaagcagcggaacgagtcgctcgaagcctcgaacccccgggaccggcggtggctcggaggtggagtgcggcggtggcgcgcgagatcagcgcctcgccgaggtggccgcccgctgccagcctcgctcgcatgcgggaagagaagatgaagagaggggagaggaagagaagagaggggacatggagagagagagaggaggaagaagaggggtgagttggactgacatgtggggctcacgtgggtcctactattttctgagtgagactgacaggtgggtcccacggggttttattatttttccggatcgaattgccacataagcaccacgtcaatgccacgtcagatgaagaccgagtcaaagtagccacgtaggcgccacatcagccaaaaccgccgaggtacctaatttgtaccggttttgatagttgagggacccgaggtgtctggttttccggttgagggacaaaaatcagattcgttgacaagttaagggacctcatatgaacttattccgagtggttataggagggggaagagggtgtttccccaacacttagagagatggtcggtggacataggcaggcagcgatgtgctggagccacgaggttggcaacgatggtggcccaacgttggcatcgtagggcaaatgatgaaactggttaagacgtggtggtggatcccaacaacagggagccgccagagactgggaggacgacgaggtaaaggcactcgtagccatcaccttgggaagagaatgggaaaggaaaaatggagggggccttgtcggcattgttttaccacttacgggtaaccgacgaggccaagcatggaagagttgcgtgtgcaagcacgtgaaagtagtgtgcggttaggtggacttatgagggaaggagaaaaactagggtttaagtatgttgcacaaatttcaaagtgatccaatggtccaaaatttaggagttatttttatgtcaaaagctacatagacaatcccttaaaaagtcatttataggtacaacttgtttatccgtattattaagggtctaatggctaatgctgagaatagaataggacaaaacaaaacaaaaaaaacatatcatatttcaaattttagaaatgggaaaaaacattatgctaaggatccgtttggtattgagtttaggagtgtcaatttgctcgttttcagttaccatgtttcaggaaccgcaaaaggtgtgttttttcaagaactttttttatacaagttttctttaaaaaatgaaatataactgttttaaagttagcaacaattaatggttttaaaattcatatttaatctaaaataagaagaaaatggtcatccaaatgatttatgaagctaacattatccaactgcataaaaacttgaataagggtggtgtgtactgcgaaatttgaaaactaaatattatatggcacaacttaaaatatatatagttttatacgatttcgacaaaaatcctactatttgctaaagaaaatttgtttgtgggccttgttcacgtcgcttaggctgggttccttcatttttgcttcccaacacgaagagtgcacacggaaacggaacaggcaattggcacgtgattaattaagtattagctatttttttttcaaaaattaatcaaatatgattttttaagcaactttcatatataatatttttataaaacacacaccatttagcagtttgaaagtgtacgtacggaaaacgagaggggagagttgggaatcggctggaacgaatgcagccttattgttgtgttagccacactcgcaaaaaattaaaaaaaaatgaaatttaattttagaagttttgtttatcgcaatttattttactaaaatggctttcaaacggcaaacaacaaaatactactccctccatcccaaaatataagcatttttagcatagtaacatgtcaaacatttttaactttagccattaatagcaaaataaaaaggtcaatcatgtaaacaaattatcataatatacaactcttttatttaaaatatcttatttttataaatattagtgatcaaaatagtatctcagagaccattgccaggatctataaatggttatattttaggacggagatagtatatagtaataaaatattttattttgggctgaatcgttttttttgttggtgtgctttgaatgcacaaggcatgtcccggtggtgctcgcagttgcagttgcttcgctttggttctcccaaaaaattgagcaccacaaataggggtgcgctcggctcgtggtcggctcgttgagaaaagctaacgagctgagccaagggtttagctcgagctggctcgcaagctgctcacgaggccaacgagccagagaaacaccaggaccaggagtccactccgagccgggctacctaaccagaaaagcccattagtggcccaatagcctatttccttgagtaaacaaaccctagaatccctaattcacagagaagaggcacgcagacagtaaggaacacaggcgccgcggccacaacccacacgcgaaccggcgaacacgagcgagagtgcgagagcgagacgcatcctgccaccaccggcgaccaaggcccgcagcgagccggtcgcacggtggcacctcgcgtcctcggcccctcctcctcgccatccgcccatccctcgtcggtcgcggcctccccgaacgagctggctccgagccgagccagctcggtacactaacgagctggagcgagccgagccgagccaagatatccacccctagtgtggccacaaacaacaagagagagcagacaccaccacaccatccaaccaaccaaattcctctctcctccgccgcgcccgcgccgcagcaagcaggagggcctccgcccgtgcgatgccggcggcggctaggctacgggcggcccggtgatggcgaccttcttccgcagcgccaacctcgcctccagggtcttcgaccgccagttcctctccccacgccccggcgctactgtacgcccaccgccccccattcctttctctttctacggactatatattgactagtattcctttcttatttgctgccttcctttcttattgagtatatgcctgacctacctacccacatagaatttcccttttctcgcttcaacaattgtcaattcactattatcatcgtcacacgtctcgactactagttcgcatcgcgcactgtctattcaattatactagcagatttcatcatcttcttttttccccctcttgttgacaggttaacactgttagacagttctatgagaacttggttccgagttacactatatgtgacatagattgcccagattattcatttcgtaaattcactgatgatggcaactatcttgtggcttttagccggaaccaccaagatttaatcgtgtaccgtcccatctggccaacattttcatgcaatgagccatgcgactctcatgatcttccacccaaagcaaagaaattcgacagcttctttaagcagctctactcaatttcacttgcatctagcaatgaatacatctgcaaggactttttcctttacatggagtgccatcagtttggcttatttgccacatcaactgcacaaagcaacgattcaagtgccactgagggtgctattcatggggtaccatcaattgagaaaattactttctatcttgtcaggtacaatcatcttgtttcgctaggaatgcacttttagttgtccgttatgatgtctatgtattataaccatcctttcctttcgtttgaatggttctcgacttctatatttctcttgttcaggctagacgatggcgcaatactagatgagaaagctttccgcaatgattttatcaatctggctcatagtattggagcttacttgtatgaggacctgctatgcattgtctctcttcgatatcaaacaattcatgtcctacagatacgagattcaggcaaccttgttgaagtacgcaaaattggtgcattttgccaggaagatgatgagctatttctccattcacatggtcaggtacctactgatccctacggcaagattgctggatctatatttagtttacatcatagttggtactggtcatgtattacctgtctaatcaaattggtgttgattgcactggaaccatgggcattcatagttcaaataatagtaactagaaagaagcacgcgctacgctgcgtgtgatctaacaattactgtttgcacttaaaacaaaaatcatctttcaccatacttcgtacttttctttgctctgccatccaagcatgctctgtaatatgatcaaattgtaaataaaaaaactaaattgcatcattaaggtaaaatatggtataaatttatcttgcttcccccaaaagatagatatcaccgtaacatctgaacttaacatgttcaccaatcctcgataatgcaaagggtaaagaatagaagatatctttgcattgatccaattcaagattattcaaaattgacttcagagtcaggataacacattagttacactgaccagatataatctgatatttgagatttatttgattgaggaatttttttcataaaaaagaattagtagctatggccagtaaagatccaaccaccagcttgcaggtgcttgagatgtactgcacgcttgctgatccctatcaccatctacaatgataataataagagcaatccatgagaattggtctagacagtttttacaatagaaggtaaatatgcccacaaaatatatagagaagttggtaagggaagcatgactaactcaaaaaactaaaatatgtatggctgtgaagtagggagaaatggtgtttccatacgacttaactaaaatgcctcatttgtatcacaaagaactaaactgcattgtaataattaacctagtgaaaacttaatatgtggtagaaaaataacagatcatgtagttagtgaaatatggctatcgttccatattgagaaggaaattattgctcaggtaagtggtcatgcaatccaagatataccatataagcctctatcatcttagtgtgcttggttcttcaactgatagcttcgttcattattttttttcatgagctgaggacaatgggttgcccctctcaacaaaagtaggagttttgttttgcaagaaggatctgtcaccttgcttgtctcaagataaagaacaactaagacataaatataaatcatggatgctgtatacaaaagaacaattttcatgaactcctatccaaaaagtaagtacacttgctataacaataggatattttgtaaagaaataggaagaacatggagccgatggcaactatattagtggtacatgcgctcatgtgtaatcaaggaaaactaatgtatatagacaacccatcatagaatgaagaagcgcatctagaatttctcataggatctctttaaaaaaaatcaaaactgaaaacacgttgcagaacctttcatgtgggtctgaacttatcccacaatcatttatgaatattcttcatttgtatcttgtacatataaattggaagacctacaaactataactgtcactttgtcagataggttgttgctttctcataggtgggacagagcatatacttgacatttgacatcatgatgaattaagcctaaatcattttgctgaaatagaatagaacattgctctggaagtttggatacctcaatataattcaaatgcaagcatcagcagttgctgaaagtgagatgtcttgttcattttccaaaatgatggtcattcaacagtttgtcgatgagataaacattgcatgattgtaatattctgcaaattaaaaacatgatgaaccaaaacttagttgatttgaaaatttaatatgacaactaaagcaaatatgaaagtactggattaaggagctgaattctacaacttccatatacaaagaatggcattatctgccatgtaaatggggtgaaaaccctctgcaagttgacagatcaagttatagtcgaactgcaatacacagacttcttatcagaagttacctctgtccttaaacttgatacctgcaactttgcagtttttcacattctctgatttggacttcaaagattgcaaatatcagctagatgtaaattgcatactaagaaaagaaaatcatataattgaaattaggatgaagcatgaaccaattacctcataaattggaatgtggtctgaatataaataaataatgtagtctctgaaaactgcatcagagtagcacaatcttttgcccatcttttcccctagttcctctattgctcccttctcacttcaattccattgggtctagcagtagcacaatgggatcaccctcctctgctttcttcagtaggaatatcgctgtaaggaaaaaaaagaaagaaagagggcagccgctagcatacctctcgttcgggtggctggatcttccgatgtggcaatgacggctagaagagcgcggtggcggcagctgcggtgatgtcggcggcggcgacgttggcggcggcgacaacggcgatgacggcgtatgcgaggggaggagaagagcgagggagcgggccggcgcgcatgagggaggaggaggcgaggcggcgcgcttgcgcggctgcgggcgaagcggacaatgaggctagggtttggtgcaatctctgccgtccgtttgtgatccgacgatatcacaggtgtggaagcgccggcacggtaggacagatgtacgacccagatcgatcgtagcacaagatcggacggtggggtagctgggactggcacataattaactggaagttcagggacctttgtgcaaaaatacgctgacgtggcgctctaattctcaagcatttccacggcgtttaagtaaactaatatatgagagctactggagcatcaccaggagattatataaagaggagtaatcattccagttttaatgggttgccagataaaacaacaaataggtcaataaccactgatttcaacacccattctttgctgaaaaataaattaggctataaccaagaatatttattggactgaattgatcttctagactgtagcaagcaatatttttggtgctatgttaaaaatagagagaaagaaaagaaaattgtatgcctgcatctgtccaggagtgcttttgttctgacatatttgattatctatttgctaatgacattcttctattgttttcatattgtttctgttatgtaaacggtataacttacaggagactagtgatagagaagcagatatgcacttccccatttgttgcttgaaatatatttctcgtaattttatttccaccatgttcattcattcattcattcattactactagttctttggatttttttttaactttggctccttgtttcccccactatttttattgcacaaaagcgccttctcagtctaggaaaatattcatgtccatgatctattattcttgatcaacaatagttgatattattctagttatgaacttatgcacgataaatctaaatcaaatctacgtatgaatcacaaactgtcaatgtacttgatgcctgcaggctgcacgaggtgtttcttttcttcctggcatcaagcaacggttgttgtcatttatttttcgcaagacatggaatgaggaatctgatcagaccttggttagccatcttttctagttcattcatttggtattagttttgaattaaggtgtgcgttgtcttctgtgccatggtcctgttccaaggttgatcacatacttttgaatattgatgtaaagtagatattatatttaagttgtcccaactgacatgcccactgctaaaagtaatatttataccttttttccatccttctcttgtatatttcctctttcattggtactgttgtgttctgtctttggaacttaatttgttgtggagcaaaatattttgttttaattgtttgttgaaccaatggatttgtttacagagagtccagcatctgaagaagaagttctattttcactttcaagactatgttgatcttatcatatggaaggtacctacatacatccactgctcactttgtctcttactctctttccctacttttatttcttgaaaagtttcttaaccctttacctggaaccaatatagttaattttagctaactctcagtaataacacaaccttgatgatagagcatgtgctgataaccaaacattccatattctatcaaatatacatatatatatttttcgtaaaggtgcttataacatgatagttgaacaggtgcagtttttggatcgtcatcacctatttatcaagtttggtagtgtggatggaggggtaaatccatttttccagacatcttaccagtcagttgtgcataacctgatgtcatttaactgtaagtacatttatgtttctttaggtttctcgcagcactgaacagaattcagcattctttgctgtgtacaacatggagacgacagatattgtttcactctatcaggtacctattctcattgaaacatgttgttggagttgtttccgtttgttacgttcagcctattatgcaatttatcaacagaattcttcggaggagctctattcattgtttgaatatttttatgaccattttcacacaaatccacaaaattcatcgcatggaaattttatctcgtcacattccaataatgttcatgctctcgatcaacttcggacaattaaaaataaagcaaacagcacctcacaggtaatattgatagcatcaggggtatgatttttattttttgactcactacagttcttggctctgttagtctgtttatattgtttccacaagatgtgagattgtttaaaagttattgtgctaatgcctacatcttttgcaatgttctgattagaaaccgtacgagtttcaattattaagtcaatactgctcagttctacatgcttggatataatgtacagcaacactaaatcaccaacattgaactgaataatgtagagcaacgctaaatcccaaatgcataatgaaagttttcttaaacattgaactgaaaattttctgaatcgtcttggcattgaactgtatgtgaggaatttaaaaggtatccctgtattaccgttaagccttgaaccttgtgagcttgagcagtcttccagtaagggcctttttttatgtctgcttctattaacaccaggacaagtggtttgcttgtgaaaattttagaatgagccaaatctttgtgatgaaaagctagaggtgtgaaattactagttgatgatctttgatatttcttgaaatccacatttattttatgttactcttactatttatatatggcataaggcatatgctaactaatttgtgatgctgacttttggtaaatgcctgctctatatttagcagtttgtgaaaaagatgatggcgtcactaccttacacttgtcaatcacaaagtccttcgccatactttgacctatcattgtttcggtatgatgagaaggttcgctcttcaacttgtttgaaataattatacatcagaaagcagttgatattttcgaaatttatttttggctacttttacagtttacagtttacagtcaagttcaaacacatagaagatgctaccttgactaacaaatatgtgacacaatcttctctaaatataagccatgcgaggcacttttgtctattttatcccccttttgactttgctaaataaaaactaccactggcatgaattatggttgttcttttccatgtgggcataactgaagggtaagaaaatcatctacccactttcataggtccctttgatccactcctatgaataaatgttagttttttttcttattgttatttagttcttgacatttccttgtccctcgttttcagctgatttcagcgattgatcggcacagacactgtacagagcatccaataaaatttatatcagtgaaacagccaaatgttgtcaaattcaagataaaaccaggtatttcttactagatcatcgtcgttagcaattattatctagattctgaagttcgtgcttgtatcttcatataattatcaaggacattgtgtaatattacaattacgaaggccgcatcatatgaataaaccaaaataatggttaacatgttgtgaaca

SEQ ID NO: 50700 - DNA, 2911 bp, Oryza sativa
attcctgcagcccctccttgcttcgagtatgctggaatgtacattttgtaggaatatggctgtctgaaggtaaatgtagttcatctaaaaaaggaaggtaaaatagagttaacaaaatgagcttttattttgaattcatttcgctgtcttcccctcctgatcccgaagccttttcctaggggcttagctcaatttgtcactgtatatatagatcgtccatcttgcaacaaggcttgaaagtgttactattaaattagttagtttttttttgatcggttcgatgcgatcagtgcaattcttgcctatgatgattgaccccgagataaacatcaatagttgtttatctaagggctgtgatctctgggtttatgggcttctgtagttaaccatttatttagtccaggaaaccccaggccttgatgatagagtccgtctgtgttgagtgagtacttttgttaataggtgggctcaaaggagagtaattatataagacttacagcgatgtgataaaaggacatcgaatgaacattatgaaccctccgtcccaaaatataaacatttttagcatagtaataagtcaaacatttttaactttgattattaatagctaaaaaaatagaaaagatcaatctttaaaattgatgttattagatttattattaaacaaactatcataatatacagctctttttatttgaaagcattcggcaccaatactcaattaactcataattaagcataaaagtagccttattcggatcacgccacacccagacaattcgcccattgccaatacaccatatgatggattccttggttttagttagtcgctgctcattctaatatcttacttttataggtattgttggtcaaagtagcatctcggagattgtgtcagagagtctaaaagagtttatatattgggacggagggagtatcaaactatccccatgttgacgaaaaaatcgaacccaccggtctaggagatctgcttagctccagtgcaggtccaaaagttgttgagatgcgggcgtgccagtcagtttgatcctgcaactaacaagatatgtaaatagtagatcaaaacagccgatcggctgacaagccgatggggtagttccagccgatagctgataatagccgatgccgatactagccgatagcgatagggtttaagcaatcggctatatgtccaatgtagataatgatataaaggcaatcggctgatgtaataaaataacaatataatcgagtagaaaccaatcggctagaaacaatatataataagcactgatcggaaggttaaagaatacatcggctggaggtccgatgtcataaaatcaacaagattatattaaacaattaaatcttattgcgatcagctaaatccaatatgtatgcaatccttgtaagccgatgcaacgtccagataactcatcggctgaaaccccgatgaaacccttattggcaatcaagaagtaggctagagattatggttctaagcacgacttagtagatcaaacttaactgatgtagcactaagtatgaaaagaaacacaatatctagacaatcaaaccgttgactgattttcagggtggtagatgcctaggctaatctaatctagcaaggcgatttagccgataccggcagaaaccctaaagcgagagacagccgatagagctaaattgagatgctaggactagattaacatagacatatgataaatagcgaggcaaatatattatccaaaccagagtaatccaagaggtcgaatgtcctgatgcagccttgaacgacgccgatgtagacgatacaattgcctggaccggcggaacattggacttatcccttcgccggagatcgaagatgatgcagccctgcgttgggtgccaagttccaccggaacgtaaaaacaaaagtagaagtaaaaagggtggcgatgcgccgaattgtattgatcgtagcgatagattacatagaccccgggtgtacatatttatacccatgggttgatacaagtccttgtcggaaaagaaagaaactttcctaaagataaaaggaaaatataaagtccttataggatactaaacacattttcctaaagataaaaggaaactaacaaactattcctaattaatagataacttgccatgccgcattctctttgaactcggtctcttctgaataagtttcctttagtagatcaatttccttaaccaaatatagcaagaatccgacaaataacgacttgacaattctcatcgggtaatctcaggacttcaaagccgatgctgactctaaaccgatgactactccgggcttaccaaatttcactgttaacacatgccccccagttttggagtatgagaattcatgcttcaaaatttcttgtcttgataactccaaaaccaatcttcctttgcttcttgcaatcggctttcatgagccgatactgatgtgctccaccatgctgaaactgatgcgcttgccccccgagccaatattgttgttcctccgttaaattctccaccttgaccatgatcttggcattgacttcttcttcagacatgtggataaaaaattcgtggtcccaccaagcgtgccaatttgtgttgacgaaaaaatcgaacacaccggcctgggagatttgcttagctccagtgcaggtccaaaggttgttgagatgcgggcgtgccagtcagtttgatcctgcaactgacaagatatgcaaatagtagatcaaaacagccaatcggctgacaagccaatggagtagttccagccgatagccgataatagccgataccgataccagccgatagcgatagggtttaagcaatcggctatatgtccaatgtagataatgatataaaggaaatcggctgatgtaataaaataacaatataatcg

SEQ ID NO: 50701 - DNA, 3630 bp, Oryza sativa
cagcgaaacattgagttatacgtggtcgaaacataaaattcagttattgaaacatttaaatttttttatgaaagacaatgaagacacatattgaaacatattgctatcacgtctgaaacattaaatttaacagattgaaacatatgtttttctttgatcggaatgtaatgatgtgatatcttgttgtaaagatttaattataacaaatataatggtgtgatcatatcatagattggataagtagttcagaagaaaacatattttgaaaatcatacagtgtgtatggatgtgtggtagacagggatgtaagtagtagttttcttgtctgatttttcatgttacggcagacgtccgacactaagcattttcgctaaactcttgatattttttttctctcaagctcccaatctagcttggcatgacgctgtcatatcgcgggttcgtcacgcttggatagtttgggcttagggttttgtgtttcgccttcccggcccctccgagtcccacacacgggaggcaacgtggggggtctctcacggtgcctatcaagtatctgatttgtctgtttcttttttcttttaaaaaagttggacctatgtaataagaattcaaatcctttagggaggaagaacaaacacgtgaatgtttgttataatgtgtcactgaatcagaccgttcatttttttaaactgatatggcaacgcaaatcatgcagaatgttaggtagacatgcggtcccatgcatgctttaattttgtgcctatatatccacaccaaaaatggatattagctacataaatgaatgatgaattaatgcaagaacacctaattagagtagtatatatgaaaactagctagtcgtatatatatctcacttgaaaattaagttcatagtatataataagtacaccatacaccatgcatgttgtaattaaacaaaataattaattcacataattcaatccatacagaggaatagcaggcatgcactgctagctatgtacaacacaaatcaagctgggctcacgcacaaatacacacatatatctatcacgcatgcatgtatacctatatatatcttgtatgtatatacctgtaactataccttgctatacggtgcacgctcacacacatacgtattgctggcagacacatattattagtagtacaatatagctagccatgcaatctataataactaataataataatctctcagcaaatctcactcacatcgatctcacacaagaagccaaaattaaaggcaatgcaaaagccatatgatggatgcataaaatggagtatactagctaattaacccaccaccctctgtcatcacactaattaagctcgcgcatgcatatgtatatatgtatgtatggtatgtatttcagtacttccagatggcagcgtccatgttgcatgccatcgacgagatgtcggcggcgttgttgttctggtcggcagcatcctgcggcgacaccaccagcgacgacggctcgctcaccacgaaccctccgccggccatgtccatctgctgctgctggtggtagtacatggacgggttcccaacaaactgctggggatgggcgccgctgttgatctgaagcgggaagcctgcaggcagagtggagtaggaaggcggcgccatgagtgagagtgaagcggtggtggagaagtcgtccaacatctgcagctggtcagacatggatggcatctgcatctgcatggggacttggatgatgccggcggaggccatggccatctgctgctgctgctggtagttggcggcggcgggcacctgatgaggagcaaccggcaccggcttcttgatgccggagctcttgtggaagatcctgcagacggcccagtcgtcctgcctcgggggctctgcggaggatggcggcggcggcggagaggcgtcggcgagcctgtactcgtgcatgacccagttggtcttgtcgcccttgggagccctgcccttgtagaagacgagcgtcttcttcatgccgatgagcatgtggtggtcgcggaagatctccttgtccttccccgtcgccttccagtatccagcctccgtcgccctgttcgtcctcatccccgtcgggtacttccgatccttctggcagtagaaataccactccttctccccattcatcttcgccttccctacatttatttatttttacttttcacatgcatcatatcatatcatataaatttccctaattatatatataatttctctcaattcaaaataatactagaatgtttacctggcaaatcccatggctcgcacttgttgagatccacctctccaatggcagcaacgcaaaagcccctgctgtccacaaccttgggtgcaaggtaaaaggtgataatctcctcgtccgttgggtgaaacctaaagcccggaggcaggtccggctgccgctccacctgctgttgctgctctcccatgctcaccacctactactgctctcaacgatcgctagcttcaacctgacatatatagccaataatacatatatctatctatataagcaaatcattaaccaaattaatttagcaaatcgatgtagtatgtaaatgccaaaaatctcaacttctagatagtgcaaacataattaagctatagtactcttcatatattgaacatatatacctcaacaagctcgcatgcaaattaacaagcaccccaatgtagaagcgaattaagattgatggatggtgttgtgatgaatgcaggaagatgtaggccggagggttgggttaaataggggggacgcgtgtgcacacaagccacttgtcagggaagactccatctctactttaactcctaccgttgtttgtttccgatggtctgtttcatctttccaattgtgaatgcttatgccccgcgtgccatctatggatacatcttctgacgggctcatttctctatgggtgccacagctggaatcgatcgatataccgaggctttactgtcctggctcgtcatattcttgcatcgagatacatctatcgttatgatgtatcgcgtgtttggctactttaagtcctttagctatagctgcattgctttaccatttgtcttgatcgtttttgcatgcttccctaattgtctcgctgcatccaaagtgtatcgctttattgttggcttaatgctcacaagcaacaccgatcctcatgttgatcacgcatatacagtcaggttgttgctaaatcttgtaggataaaaagatatatcaatccagacaatataattaaactcgcgtgcaaagctagtgctagcatagtcataatcttgtgatctgcatatagaaacacatggctagagtaaagaagaggaaaaagaacatgagaaatcgagatgattctattctacctcagtacaaatttcatatatatgtagtagattcaaacattcatatgtgtcacactgttttaataaaatggctcgaataatatatatacttgtgtgacgtggatcccctcacattccagcaatcccagagggattcattcttatagatagatgtataaaaaatgtttcgtatccttcactaaaacagaacacgggtagcctgtccataaatagtaggcatgtatatcatatatattaaattt

SEQ ID NO: 50702 - DNA, 987 bp, Oryza sativa
ccgtgatgacctttcttcaataaggactatagccggtggtagtgtcgccaacacaattcgaggtctcgcagcaggttttgggatatcaactggaataattggagcttgtggagatgacagccagggcgttttgtttgtcagcaacatgagctttagtggagtagacctcacagattaaggacaaaaaaggggcacactgctcaggtagtctaaaatctgaagccaatatctatctattttttgcccttattttgctgcttagtggataaggctgaaaataatacctattatagtgtgcatgcttggtcgatgcaagtggcaatcgcaccatgcgcccttgcctatctagtgcagtcaagctccaggtaacccttgcttgatgcagtcttacactgttacttttctcttaacagtcgtaggcttgatacgatcatttactcattaacaggccaacgagttcaaaaaggaggacttcaaaggctccaaggtggtccttttcctcttacgccacattctgtgcacacaaattccagcatatgttaccatcacacaaaaaatcttactatgtcataataaatatgtttattttttgacatggaatgtttttgtcatcatgatgtaatgcagtggttggttgtacgatatgcaagacagaacatggaacagatccttgaagctattaggattgctaaacaagaaggtctctcagtatcattggatttggctagttttgaggtctgaccgcagctcattggtaccgtaaggtctttttttggtacaggcaccagtctgattttgtttatttattacacagatggttcgtgactataggacacaactcattgaccttttggaaactggcaacattgacctttgctttgccaatgaggatgaagctagagagcttctagggtgataccctcatcgccttattgtttcagatgttcttcagtgagtgatacctattatagtatatctgatgtgtgc

SEQ ID NO: 50703 - DNA, 5459 bp, Oryza sativa
tactagtatttgatacacatgcatgatgcatggttcagagttgagaatggtttcctttgcagtttgtttgagcaacaagaaggcggctttgttaacatgtaaagtgaaaaataaaatgcaggtggttcaagtggcggcaaccggggagagtaatgcggtggacgcgacgggggcgggggatctgtttgcgagcgggttcctgtacgggttggtgaaagggctggcattggaggagtgctgcaaggtaggggcgtgcagcggtgggtcagtggtgagggctctgggcggggaggtgaggccggagaactggcagtggatgtacaagcagatgaacgccagtggcctgctgctccctgacctcaagaactgaagaaaaagaaaaaagggcttgccttttacttgtcaagcttccaagaaagaaacaaagattcagaccatggtcattgatggcttgattgtttgttagttagacctcctatgctcggtttctttctttgtttcttaatttgtgagatgagatgaatggaatggatggtggtaacctgcactgcactacaagtctcgctgattattcaatttgctcgagaaaactcatatatatatatatagtataataaagtaacataaaagtttggatgtatgaaaatctgaacgtgtttgttgtcagctgtcacctcacctgtgtgcagagtcttaaaagtaaactagagactactagtaccaaattacgatcaatcatttgctgagctcgtgaattctgtctggttcaatgttttgcaaaaggaggttctttcacttctccgcagcaggcagcaagatgatgtttggtttttatgattggtggatacgtagagtggattgtgaggttagaaaaggtgtcaattcctttatcatgctatgctaggagctggagccttgtcgcttgcttgctagggaggaggtggggtctggccggggctaaggacatcttcttctttcttcttgccccttgtgccagaccagacggagaacagtgatcaactgtttagtttagttagcgcttacttatctttttctttttattgtcttgttctcgtgcgtgttgaaaaaaaaaaagattgtctatgggtaatccggctgaaaatttcagccgaatttgtagccttacaatcagccaagtcagcacccgcgcgtgcgactccgtccaggccttattgggctggattttgtgctatgatgggatttgaggcggcttgggcccagtacagttgataggccggaagtaataggcttgtgggcctcggcccatacatacatcgagaatcttcttcctttttgtgccgttctccacgagtcctcctcttcttcttcttcttccttcctcctccttcccaaggccaaggccaagaagaagaagaagggtgtgtttaactttaacaccgggggtggaacggccgccggcagcggaagaagatccagccaattcaatccaatccaatccaatcctcaggtgaccctcaccctcgctcgccatttgtcttgtgagttgtgaattcgaatttgtaattctccatatccccatgcaggctgcggagcggaggaatcaattcaatgtcttcctccgccgccttggccttggccttgaggagggccacctcctccgcgcacaagcagaagcagaagcaggccctcgccctaacggatgccgccgcctctcgaatacgccaactcctcagcctccgccacagaccctacctgcgccttggcgtcaaagcacgcggctgcaatggcctctcttacaccctcaactacgctggtaactcttcacttcttcttttctctctctttcttccacccaacctactactagcatgcgcctgcctgccttcttctttttgttcaatcaggccatttcttatcaaataaaaatgggccaatcaatattctctcaatatggttgacatttaggcctcaatattctttctctcttgtcgaatttagacgttatatccatttgggattagtggcccatctatgctatgcattgcgagtctcatttggtcaaacatcctaaaaaccctgctaatgttcctacaactccgatcggcctttcctacataacataaccattattacattagtaattactccctccgtttcacaatgtaagtcattctagtatttcccacattcattagcatcaatatgaatgtggaaaatgctagaatgacttacattgtgaaacggatgaagtatctattattggtcaaaccagtgtaggaatatcaatccctatttgcaggcctttacatattgagtttatgattcttatcaactaattgatttttatcttcagctcatatccatgtttgatatccttaccatgccttgttaggatactttcacatctaatgttaatatgttttcttctttttgcgtggaatctaatgtttatatctcattgcttctttttgcggggaatctaatgtcatatcttattgcgctactctgtcaaacattgcccgtgtaatgataaacttaggtcctgtcctgtctttcaatcatcaagaataccattactatttgcaaaatgtttgtagaagctgacgctgtctctgtttctttgtaatattttctctatatagatgtcagtaatttccccattaattagtggatatcttcctttttgtgaactgaatcatcatctccattgtccaacggctacatgttcctcttcctctactgctattatgtttttatttctattcatgctaaagagcgaaatatctgtttattcagatgaaaaaggcaagtttgatgaggttgttgaagataaaggagttaaagtactaatcgatcccaaggctctgatgcatgtcatcggcaccaagatggattatgttgatgacccgctaaggtttatgatttgtgcacaacatttcctcctctctacttattacctcctttcactaccttacggaggcttctcctgtaggtctgaatttgtgttcatcaatccaaattccaaaggggagtgcggctgtggtgaatctttcatgactacaagcagcaagggatctacatcttgaataacggatagtgatgggggtagtacgtgaggtaaacagagctaaatatgtcgaggcttcagctaccacttttctgctttatagcttattattattacattggaagtacatagctcaacagtggttgtaatagatgcaattgtgtgaacccacctcaactgtgttctttacattgggggggggggtatgtgttcttggtttctgttgtttgtttacatgtgattaatgaaagaaacgaaccacgtttggttcagacacatctgacgtgctcattgtgaagtggagactagctaattcaagtagctagctagagttgtgttttgctgcaagaaaaaaaagtatgatctggatgtcacatatcagacaggtctctgctctggctacttgactgctgtagtatatgatgtgtgcctgagcaaagaccaaattcttaacaaagaggagacatacacaccagacaaaagcagaggaatcggatactgagatcctccagccgagtccagtaatgttgctcagtttgatgagtagtacaactttgtgtgttggatctgctgtagctagctagctagatgagctgacattgttgtatagtactcctagctagtagtatgaatctgtgatagattagttcagtttcctctgaaattgggtggaggccaaaccccattctcgttggtgacgtaggaggtgcacgacaggggcaccaggcagagtcctctacttcggaggtcaagctttgctgctgcgtcccctccatttgacgtccccttctaattgattaattaatcaattgacaccaagcaaacatgacaggtcagttaacatagttttaatttctcttctgaaactaaatgaacagaaaagtttatctttttacccgttgttgttgtgctgccctgcaggctaatttcttgctgttcttggatgatctcaggtatggaccgctcaaagtctgcttacattgcaatgttttattattatttttttgcaaaacagcacaggaacaattaattctcagctcaggccaaagattaattcacaggtagatgtgcattgttacatacctcaacttggtcctgaagaaatttgatgtaaccgatggcctccatgagtaccgatgcggtatcagtctgcatctcatcattttaaaatcaaattctatcaaagggtgattatataattacagaaactggtaatgcattcattgattgtttgttacataccttaccaaagggtgagaccagttgctgaagggcggcaattctatcccctagtttctctttccttacctataataattagttgaattaggatatgcattaccattgtccaatgttcatgcagagcagataaatgatcaaacatcgatcggtcagatcgatctttgtatgtgtatatacggaccttgaatgaaggaagcattgaggaggagtgtgactcgagccggggcttctttgacgatggcggcagcgctgttgatgatctgtgctccgttgaactcccatggcggccacctctcccttgagctgctgcattcgtattcctcttcatctgcatgtgtaggtacacaaattgacctgcttgttaaattgcttacgtattgagcttccaagtaattaagctagtttcatcactgcaagtaaatataattatgtgttgcaaactgaagtaccactgatcaactccagtccaggatgcatgttgctgcaactgatgcatgttcaatgtagtaccagtactttttggggcaaaaagatgacgcatgtcacccttaaaagctgcatatgtgcagaacaaaaggctgtactttttgtgaatggaccgggcctagctagctaattggttcaggcaggccgggaaagcaaaattacctaactagctagcttgctgctactgtttcagctgtgtcacctaagcttgctgcacatatatgcttatgctgtccccagttcattacagacaaatggtcctacaattaacaactcacaggcttttgccaagcacaaacatgttctcttgttctctactctgcccaagacatgcagatcgttcccttacgtaccagttaagctaattaagctagctagctagcttgctgacagtatatctaggagacatctgaatcagggcaaatgcatataaatatgtatctgtcttacaagggcactactgaatatacttcaaattggcactccgagatactgattcatgcattttagcccgtcaatgctaattaatttcgtcatatatttgaccatggcaggataatatatatatgtatgtatcgagatccgtcaaaacctgatatgtcacaatcatgacagagacaaaagttaattatcatcatgcctgatgtgtaagtatttgcatgtgtaagtataggctgaaaat

SEQ ID NO: 50704 - DNA, 1157 bp, Oryza sativa
atatatgcatgaacaactcaaagaaaagatgcatgaataaactatatctatatataaatatgtatgtgtgtgtaaagctatatatcttacagcattggaggctggctccattggtggttcaatccaaaggtgttgggagcaggagcaaagggcatggaaggccatgggatcaggtcatcttgcaagagatgattatcacagaggctggaggaggaagaggaggaggccatcatgatgatgatactaaaaggtttataatgatgatgatctttttatttgatgttccttccaagagagtaagaaaagataggccacacacgcacacattgacacatgatcgatgcacgtactactactagctactgaatgagcttttagaatctctcaacaacatgcatgtgtgtaaaaggagagaagaagtatactattgactattgagattgggaaataatggatccaggtgcccataagctaaggcttcctcgccgctttctctctttttatattggttggtaactttgttcccatgccatgcctccttacagtagttaagttacaaaggcaactcagtatcaagagacatctgcaactctctctctctctctctctctctctgtactatcgtcatagttgggatttctgtctttagatccataagcagatgcttgcatgcatgattgaccaattaatatagattgctgcatgactaattaactgtgttgcccttcaaattcagaaaacagcaagcaaaaagtaatgcaattattcatcgtggcatctatgaccttgtaaggcctgtttgatagagttccaactcctaaatttagcttcaggagttgagtctggagtagagttgtggagctgtctaaactcagctccacctctctagttcattttgtgtgagagagttccacccaactctactcccatttaagctgaactctgaaaaaggtggagctgaagttggaactgtaccaaacaggcctgtagtataaactgatcgacatctgtgacaagtcgatacatatacaagggcggaagcaggaatggaagtgaaatacaattcacagaataatttggtccatggacgatattgtgtggtaaaggttagtgagggtcaagagtctattgcagcgagtacaatagcagattataag

SEQ ID NO: 50705 - DNA, 19913 bp, Oryza sativa
tacataacatatatatagtgaaaatcgccggccatatctaggcccaggactaatcgcaaatttgtggggaaaagtacaccgaaggcccctcaacttgtcatcgagtatatatgacatccctcagcttacaaaaccgttcactttaggtccttcggtggttttgaccccggtttaaagtgaacggttttgtatgttgagggatgtcatatatccggttttgcggttgggggatgctttcgtaactcgatgacaagttgagggaccttcggtgtacttttttcccaaatatttgtgtacacacgagaccgtacaggcccatcagctaacagcctcatgggcttctcccctgctccctggtttacggcctgcatgaaccctcattgcctgatgcccttagtaatactctctccatatttttcacttctaagttgagtatttttttaccaaaggagtacttagcatgccatatttattgcattaatttttttgcatccaattccaaaccagtactagtactaacctcaccagtacgacaatacagtcattgagtggcccactgccccctatttacctcctgcctagctttgcccatttaattgaacaccatatatatatattttccttttcttatctctttagagaatttacgtgtgtctatgcccacgtgaaatacatagatgttaaatctgaaagttacttgttgggcccaaaagggagggtaaatagattaaacctataattttaaacgaactttgattaaatacttcctcgaacactccgatcaattcttcggaaccctcagtctagtttggtagttccactaagttctacagaggtttcaagctaggagataaattaacgctactaccacaatagaatcctaatatcaagtcttaaagggaaaacctagtccatcggtggggattatttaaccccgttttccttgcgaaggtggagtagagccttcacaaattttcttgggcttgccacactgacttagaaacttgaaggagatacctaaacagatagcaggctgcccttcaagagtaaacaagcatgtgaaaggtccagcgtcgatctcaagtgctcaagcataaatcctagttcacaagcacttaatcccctgaaattccaactcaaatcccataaagatttgcctcaaaggtaggagagagaggagagcttaatgagagagagacagagatggggtgaaaaatcaaagaggagaaagtgtgggttagtgggtataaatacccccaactcccaactagtcgttatggcatcgccaacacgatcatggagtctttgagcatggccctagagcctttggcctgccacatcgttgtggcagaaactgtggctcggaggccctggaaatgggcatcaacactcgaggagactttctggagtctcccagccaaacaaaaggaataagttcatcaaaggtcccttaacttgtcaacgaatccgattttcatccttcaatcacaaaaccagatacaacggatccctcaactatcaaatctggtacgaattaggtccctcggcggtttcaatagcagttttggctgacgtggcgcctacgtggctaatttgactcggtctcgatctgacgtggcactgacgtggcgcttacgtggcaattcaattcgggaaaataataaaccccgtgagacccacatgtcagtttcacacacaaattaataaaaaatggctgggcccacgtgggccccacatgtcatttcacccctcttcttcctcctctctctccccatctcccatctcttcatctctctcccctttcctctctcgcttcggcgctcgccccactctcctcgtccccaggcctctccgaccgcctcctcgccgcccgccacgagctcaaaagcggcaggagcacctcgccgctgcctcctcgtagccgacctcgccgctcgacttcgtgctgcccgcgccttacccgaccccctcgtcgccgctgccgagctcaagcctctcttggtggatcccgagggatctggatctagtcaggacgaacccgtcgccgtcatcggcgtctgggcacggttcatgagtaaaggcggctgcgccgtccgtcgctgctccatcaccagcttctcgctgtccacgctgaccaactcgctcgtcgtcggcgtgcgccatgtatggcgagtgggcgcagcagctcgtcgttgtcagctctggccaaggattacagcaacacgcgcacttcaactagctggagcgaaaatctttgtggacaaacacagaagaatttctcgacgacgaacgccttatctagtttttctcattcacttggaacttaactcaggagattacatgaattttatagcccaacagacacaccactaagcaaacaaacttcggccgcatcgtacgcgcacgcagcacgcgatctgattaattcggcagccactagctagccgcatgcacgaagctaactgccacacaaaaataatgctaacagttgtccagctctccgtcttccaggccatcgtctgtttcacgctgcacgctgctgctgttcgtgctcgaggtcaggaaggccgccatcggaatgtacgtcgacggcgcctcatcctccgacgagcaaaggacgtcgaggccagcgctggcgccgccgcatccacggtcatcgttgtcactgcggtgagcggcgccggcaagccgtcgctgtggggtgctggtgaaagtggtggcgccgctccctcctctcctgccggcggtcatcagggagaagggcagcggatggcggccatcggggacaagggcgacgaccggtgggaaggagctaggcgagctctctggtctaccggcgagcgcgtgcaagagcgagatggccggcggccactcttcgccatttccgccgccgccgtcgtcgcaagagagataaaaggaggggagatggggagagagaggaagcagaagaggatggggagacatgtggggccaacgtgggccccaccattcttttattaatgtgtgtgaaactgacatatgggtccttttttcggatcaaattgccacgtaagcgcccacatcggtgccatgtcagatcgaattagccacgtaggcgccaaaaccgctatcgaaaccgccgagggacctaatctgcaccggttttgatagctgagggacccgttgtatctagttttgcagttgaaggacgtaaatcggattggttgacaagttaagggaccttagatgaacttattcccaaacaaaaaggccacagcccccgagcaatggccctccgagcaccctaggaggtttgacggagtctcctgagtttttgggcttgcaagtggaaggcgtagagcttggccttggggcccctagaaatggtcctctgggcacccgagagagcttcccggagtcttcgggctgcctagttgaagcatgtaccaaggagcatgggacttggaacacttttaacttaagaatcgaggatggattttgtgcatcattgccttgcattgcacacacccatcttgataagtacgtcatgcttagactcagcaaaacatgccacgaatcgagcaatttgcttggatcggctccaagcatgtgtttcacgcggctcgtcggcttcacgatcctcttcggcgctggccctcccacatctcccgctgccactgctatatatgttcctcgttttccgctggccagtcagggtgcttgctacctccgtcgccccctggccaccccgaagccttactatttttcggggggtttataacatggttttcagaaagattaggttgacagtaaaagaatgtggttctgacaggctgatatcctttgagaaaagtaaattcgcaaggagaaggtaaatactcactggctgattatcacccatcttcttctgtaattcaagtttcgactgtgcattgtctcgttgcttcttgagttcctccatttctttttccacctgctgtgttcaattaattaggtcagttacaaaatggaaatgattccagttaatttcatccttgagcataggcatttacctgtctaatcttcctgttcctttccattataatgatctcagaagaggaggcacgatcagggattctcagttcagtttcaagtctagcaacttctatctgaaggtgcttcaccaattgcttatctgataccacctgtatgtaccaagggatgaagatttgcattctgataagtgaataaatgatgtctcacagtcacagatcttaccatattaacttttgcattatttgtaacctccttggcacaggttgcaaagaatagagtacgtatttctagattgttctacatgtgtttgcgctggactcatggtacagatgatggatgctcttgcatttccacccaaagaaagctggagaatgcgtgtcaactttgagtctcgataaggtatgtgtccacttcttttatccgagctgcagtggaaatttagagtcagtctgccaatattcccaataaagatagacttcattatactttcctgttcaaaccaaggagcagtaaaaatgcaaatatgcagtaaattatgtaaatagaaaagaggcctcaaactgtgtatttgcatgacagtgcaaataaattgtctagtttaacatgttcatgacactgcaaatacacactgcttattattagtcctgccatactaatgtcacttagcccacacattcaagaacttaccctctttataattagctgtgttgcggctatgaccttttaacaaaactcacattagttttaaatatgcagaatgattaaacaatatagtggcaataggacagagtacagagcaagtgcctcccacttaaaggaagtggcctagtggtaatattttgatctgatgcatctcattagcgtttttagaaattcattaggagatcagatacattattaacatactgatatcattacaactgtgattgtttaattaattttcagaataatttcataagaataggtgggccgttgactatttcatacatctagttcagtaagtgtaccttcacattgacaaatcacagatgtttaagtcttacaaacatggttttgatgaattcataaatataaaaacaacattttatacagaacggaaaaaatgatagaacaaaatttatgctgctgaaatgcatgaatatctcaagtgagtcctattgcagtgaattttgttctcaagattttagccaaagccgaactaaaataacatatggaaggaaaagaaataaactccactttggttgggagctaattacatgaattatagctacacagaaaactcacccagcattaaatatgattggtggaagcaatacacgaagaagaggtccttgctgaacagaaaattgtgtgaattcttcctgctactgacgagcagaatcacacctccagttatcagcccctgcaagtgccaacccatagtgcaaagctcaaactactccactgtgagacaaaaccacaaaatggtcagaaaaaaaagacggtatgctttaaagagcatactgactctgtaattagtctgtatggtggtgaacagatcaaaactatggcgaaacattttaggaaaaaagaacttgctatctgtagttggcaccataagcaggatgcaaaaatgtgctaccataacaggaaaccaaaaccacacacagcttcctgtacttagactggaggatgctcccagtatcactccactaacaaaccgcaacttgttcatctcacataaacaaatgaactgcatggcatacatcagaaacaagcagcctaccaacagttgacaaataaatcaatagcagtacctaattctgaaactatcgccttttccccttccaagagtacgggaatggaataatctaccagactactatcagatcgcgaccaatacatgcaagaactcacgtagcaccttggaactaagccgaataagcatatagacaaggagcgggaggggaacacgagtgatctttacccagggaagaggatgagcggccgaaatccggaggagaaagaaaataaggtggttcgtgtgcgggatagatggaggagcgtcgaggtgcacgcagcaggtccacttgtgctcgccatccccaggccctagcctcatcgcctcgccttgccgcttcagttcgtcagcctcctctagagatccagacttttttttttctgagatgtttctgaatttatttacagctgatgggggcgaaatcggcggaaacgggggcattacctttgtggcgcttgtacttggtcttgcactgggggcaagcctgggcgccatcctttcgctcgtactcatagcaggggcggcacaccgggaagccgcagacgtcgccctccgtcacctaagatctggcacgcctgcccgctcccgtgcctccccgacttttgcggaacagatcacccacaaaaccaaaaatcaaaatctggactctcctccgcaagatccacccacgagttgcggtgcatttcgggcggccattcaccacggcatccgcgtcgccatccatggcgcacgccgcagcagcagcaaaccagttctcagctcaccgaatcacgcccaggatccgtacaccgggatcagcaccgccgcatcccgcgctgccaagaaatgaacacgacaacatccagatcaagaacggagacaaaaccaagaagtcaccggcggaggcggggcaagcattaccaggaatcctcccggcgaagaaggcttccagcagaggacgcgggagtggacgggaacttcatcctcctcagcgccgcccgatctgtcatcgacgagcccggtgccgctaaatcaagcgaccaagaactcaccatcaactgattcgacagccaaaagccaacctggatctgtaacatggaacatcccatcgtctttggatttggatcagagagagagggagagtgaagaaagaaagggcaggggagcagggccttcccccctggaactcaccactctgaaggaacggccgacgtcgacacttgcaatgaacctcaatgtgctagccctcgcctccggatgaccggatctgccggcgaggaggtcgtggctgccagatccggtgaccacggcctgccctccaccggatttagtcccacggcgttaaggaggaaccagatgcctctcccttctccttttttttttctttctccgagaaagctcggctggtcaactcaatgcagcacacaagaggtggtggttggtctccgccatggcgagctcatcatccgacccccacaagctcaccacgacggcgagaagaaggcacggcgatccagctgggtgtgagaggagcaggcgacggcgacgcagcgaggagagcgggtggcggcggcggcgctgcgaggagggcgggcaacggcggcgacgcagcgagggcgcgaggaggaggagccacggaagcgtcgtgggaaggggagagcgatagagaggagacaggcgagtgaacggtggcggctagggtttcgggggagacggggaggaggaaagataatgcgaaaaggcccctcagtttccataattcagagcacggttcttttttcccatttttgtctccttcgtctcggatttctcaggactcggagggtctaaacgtaagattatggagccgaaaaagctacaacgaggacgtataacaaaataactataaaagcgagggcttttgtgcaaaaattccaagacgacgcggaggcaggagagctcgcgaaatcccacccattttccagcgccccgtgacgtgtcgcgccccggccgcgtccacgccagcgcaaaacgctgagggacgagcagccctatacctggccaaatgggccgtgccaagccgggccggcccaagcacgaccgcactgtagaaggcccaggcccggcacggcacgccggcctgtgggccgtgccggcacggcccgtttacccgtgccgtgtctgggccgacgccatagcccgtgggccagcacggcacggcacgtttactgtagagggctggcacggcccggcacggcccgcgagcacggcacggcacgggatcggctcggccgcgcacaccgcggcaccgcgcacgtggcgccaagcggccgagccgccgagggcagccgcggggccaggcggcgggaagcgcgcgtcgcttcgttcgcgcgtggcgcgtggcaagcggcgtcgcgacgtgtcggcgtgtcgctggggctggccagctgggaggctgggacgctgcctcacgctgggtcggtcgctcactcgctctcgctgcctgtctgcctgtctgccactctgcctccgtgcctcgttgggagcagccgagacagcgactcggcgagaccccgtacggcggccgaacggctagtcaaacgacgaatgcgagagtgccacgtgtcccccaacggctagtgagctaatccaacgaccagaagtagccgttggagagcaaaaaaaaaggaaaaaaattcgaaaaaaatatgaaatttatttctataaataggacacccaccagagcattctgaatcatccatacctcccattttgtgctctgttgtgctctttcgtgtgatagatcgattttttgatttagacaaaatttgacaaaattttgtgtaaaatcaaaaatagtttgtgactaaaaatagtgcatacaagaggtgtaaagccaagcaaaggtggtaagaaagaagtacgtcatatattcagttttatgtattattttattttatgttatgcgaataaatattctgaaatttgtttatgttgttttaaattttcagaatggatgaatcgaacattccatcgttcacgttaggtgatttcgaccctaactacgtgtcgaggtcattcccaactggtgagtatgatgccaccggatcggctccaacaccaccagttatggagccaccggcgggttcagaagcatccggcactatgagtgggagtgcatcgacgaacaccggctcaaagagatcaagaacttccggtgtttggcaacatttcgatgaggtggccatgacaggccctgatggaaggcaggtaacattcgcgagatgtagaatatgcaaaaataagttatctgcaaaatcatctggtggaacaggacatttgaagcggcatgccgaggcttgtgcaaagaagcaaggaatccaactacgacagcaacaactactactaaatcctgatggtacggtacgtacgtgggagtatgatcctatggtagctcgagaaaatcttgcccgtttaattgctagacaagatttacccttgaactttggtgagagtcctgcatttgaaaattacataaaaaattctcataatcctaggtttcaagctgttagtagacaaaccacaacccgtgatttgaaaaatgtctatgacaaaggttatgaatcactgaaggaattatttagtacatgcaccttttctgtcagtgtcacctcagacatatggagtagtagggctaaagaggattaccttagtgtagttgtacatttcattgatgatgattggcaaatgcaaaaaagagttcttggcttaaggttaattgatgtttcacatactggtgaaaatatagcagagagaattcgagaggttattgatgagtttaaccttgcagataaaatttttgctgtaacaatggataatgcatctgcaaattctagggccatggaaattctacaaccattattttgtatttatgctcaatcatttcttctgcatcagcgttgtgcatgccatatcattaatctaattgttaaatgtgggtttaagagagttaatgtacacatcgacgctgttcgtcaagcaatcacgtggttaactgcttcaaacccacggattgcacagtggaaaaggtattgttgtgcatcgggtgagcccccacgtaagtttttaaccgatgcagaccatcggtggaatgccacttattttatgttaaaggttgtattaccttacaaggatttacttactgttttccttcaaacacgtaatggcccaaaaaacagtgatggccagccaatactgactgatcatacctggcacattgttgaaaggttcaatcaatttcttgaaacgtttcatgactgtactcttctgttatctcaagtatattatccaacagctaatttaattttgcataatattcttgaaattgccactttgttgaaagagtatgaaaatgatgaccttttaatgcccgttgtctttaatatgaaacaaaaatatcttaaatattggaaagacatccccatgttgtattcttttgcatttattcttgatcctaggggaaaattacggggattcctcaatattctttcacttattggagatattattaatgttgattattctacctattatgctgatgtcaaaactaaattctatgaggtatttcgaaagtatgaattaaagtttcagggagatcgcttgcaaagacccccacctgtacctgcagcaggtaagaaaaaattacagtggagcagaatttggggcagttcatcttctagccatggtggtggtaccagttcatcagcagcaagtggggacgctagatcgcatggtcctgccgaagagttgtccaactatttggatagcgatgccatcaggcatgaaacgtcagacttcaacgtactcgggtggtggaatgatcataagatgtcatatcctgtgctatcaaaactagcacgggatgtgttgacggtgcccgtatcttcggtatcctccgaatcagccttcagtctatgcggaagaattatcgaggataggagaacaagtctgagcagcgatcatgtggaaatactattaagcgtcaaagactgggaacttgctgcagaacatgcccaatacactgctgacaaccaagaattggccgcacagttcgaaaacctttatttagatgacgaacaattagggtagctagtttatattttttaagtattgacctgttggctgtactcttttctttgtcatggttttctcaaatatgagtttttacatgataaagtttttaacgaggcagcatgtatcatgtaaacatcaataaaggtcattactcttttttcctcatatttttctaatatttttctaagtctaattatttttctatttttctccaactatccattaattttctcttagcttagttaactttcagacctttctctttgatttgaattgttccactgacagagtgacagcctgacagtgacagactgacaggcaatagacacacggtgacggacagcgtcagcaagtccagcgccaccgccgccacgtgtcgcccttcggccggccggtcgcgcggccccggccgctcgctcccgcgtgccgcgttgaaaatttcagccgcgccgcgcgcgcgccttgtcggcgactcggcgttgtcgcctagccgagtccttcggccgtgccgcgtgcccgcgtccttggctgcagtccgtcgtgccaacgggctgaccacggcccatgggccattgacgtgcccgtgccggcacggcacggcacgacgttccctcgggccgtgcttgggccggggagtaggcacgtgggccggcacggcacggcccgctataggagtcgtgcctaacgggccgtgccctagcgggccgtgccgccggcgtgcccgtgccgtgctgggccgggccgcccgtttggccaggtataagcagcccggaggaggtttgaagtctttagattagatgtggtcagtccgtcctatataattaaggtaggtagatagaggagagggcgggcgcacggcagcaataagcattatatagagagggagcgagggattgaattgaagcagagcgcagcaagcatatagtaggtagatatatatagagatcgtgggcgagtgcgagtaccggggcgaggtggtgttggtgacgccgagctcggccatgccgcggcgctccctctacctctctaacctggacgaccagcgattcctccgtttctccatcaagtatctctacgtcttcccgccctccgccgccgtggccgccgacgccctcagggccgcgctcgccaaggccctcgtccactactacccactcgccggaaggctcaggcaccacgccgacgataagcttgtgctcgactgcaatgccgagggcgcgctcttcgccgaggccttcctgcccaccctcaccgccgccgacttcctccgtgccggtgccaccgccaagccgcacaagtcctggaggaagctgctctacagagtccacgccgccaccttcgtcgccgtcccgccgctcgtcgtccaggtacttatttcattcatttcgtatttattatctcgatctggacgacgtcgctagctctacttaattaattatcattcattcattaacgacgaactcactgatgcactatcaagatactacatgatcgatgctatatattaattagttgagtttttgctttcccttaagattatctatatggctgcagacagtacagtacatcgatcgaactagtgcgtgctggttgagctagctagcattgatattcatcatcgccggcccgccctattgtacgtagtacgatcgatactctactatgtggagataagggagtaattaaggataattattgatggtatgataatctatagtagtattaattaagcacccccacccaattggtccataagagcaagtctaatagtacagcccactaccagctccaattcatctgtagccaatctaatagtcaattcatacaatagttgcttactatactattagtatatggtcccacctgtcatatacacagtgtgtcttggagtacgtgctgcagctggctatagatctgtagcccgctgctcttctctctcatcgtttatatcattaaaatatgtttatagctggctaatagcctgctattgtacctgctctaataataataataataataataataataaaggaagaagcactacttcttgccccctgatcgacctgtgtttgatgatgatgatgagcttgtctgcttttttctgctgctcctatcctactacactagttggtgattaaagtggagcttcctcttaactcctgagaggactaatggagatggaaccagggtttaccttaccgccggtaaccgcgcggttaccgggcttaccgcgggggtacggtaatataaataccgcggtaaactccttaaatacaaataaattttaaaaatattttgaaattttgataaattttgcacggttttgtacggtttttcacggttaccgcggttaccgcgcggtaaccgtgcttaccgccggggcggccccggcggtaaggtaaaccttggatggaactgcaggcttgctgctgatcttaatctattaattagtatatgttagtattaacatttcctttagttagtttgcttgtgaccaccacccaaattaagcagcagcagctggcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttgggccctatctgtagggccgtcacaggtgacctcacctgtgacggcccagagtgctgggcccgtcacaggtggtcttacctgtgacggctccacggttggcgcccgtcacaggtgacctcacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgacgccggcctgcaccaccgccgccgcactcactctctcgaccgccgccatccatctccaccgccatctccaccgtcgccgtctcgacctctccgccgccatccagaccctcctcgccgccgccctctctgccgacatctccaccgtcgccgcctcaacctctcctctgccctctccgccgccatctccgctgccctctctgccgccatctctgccgtcctctccaccgccctctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaatttttaatgcattttgttttctataattctttgataattaaggacctttattaggtgtagggtttgaaatctagttacaagggaagaattgatagattggccgcagatttaatgtagttccgaggttatcaaaccatcacagaatacaaagtgcatggggaattttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatattgtgggctgttttattatgtagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgatcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatggaaatgaatataattgatgcatatttctgagcaaaactgaggccatatctttcatagtataccccgtattacatgattttggtgcagtgaatctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttcctactctaatttcctgcacttgctcttttccttatggataagaaaagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgaacacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcacaggtaacttcacctgtgacggactcgcaaacgtcggaccgtcacaggtgacgcacccggtgccggatgttacttccgaaccgtcactgatgagttaattcccgaacagatattattgctcaatattggctagcctcaggaat

SEQ ID NO: 50706 - DNA, 8052 bp, Oryza sativa
ttttttttctggaattaactcatcagtgacggttcggaagaaacatccgtcacaggtaacttcacctgtgacggactcgcaaacgtcggaccgtcacaggtgacccacctgtgacgggctgttactttcgggcccgtcacaggtgggtcaccctgtgacggctactatataccggggatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgtggagattaaatttattaattagcagctggctggtagatatatattgtttaattagtgctagtagtagctagcttgagtgaagttgaggtgctccctccgtaaaaaaaaaagacaaaccctggtttccgtgtccaacgtttgaccattcgtcttatttgaaaaaaatacgaaaaaaattaaaaagacaagtcacgcataaaatattaaccatgttttatcatctaacaacaatgaaaatacgaattataaaaaaaatttatataagacggatagtcaaagttggacacgtaaacttatggtttgcctttttttggatagagggagtagcatatacaagtacaaggatgaacaataatgcgaagtggtggctggggtggccattgagccattggtaaagttagcagaaaagaaaaaggctagctgagaggatagtgttaggagagatcgactttaatttctttgtgaaaagaaaggcaggcatggaggccatgatctttataccagctagcagatcgaggagattgccacccctatatagacctcatgtggtccgtcctatataattaaggtaggtagatagaggagagggtgggcgcgcaacagcaataagcattatatagagagggagtgagagagagagaggtggattgatttgaagcagagcgcagcaagcatatagtaggtagatatatatggagatcgtgggcgagtgcgagtaccggggcgaggcggtgttggtgacgccgagctcggccacgccgcggcgctccctctacctctccaacctggacgaccagcgattcctccgattctccatcaagtacctctacgtcttcccgccctccgccgccgtggccgccgacgccctcagggccgcgctcgccagggccctcgtccactactacccactggccggaaggctcaggcaccacgccgacgataagcttgtgctcgactgcaatgccgagggcgcgctcttcgccgaggccttcctgcccaccctcaccgccgccgacttcctccgtgccggtgccaccgccaagccgcacaagtcctggaggaagctgctctacagagtccacgccgccaccttcgtcgccgtcccgccgctcgtcgtccaggtacttatttcattcatttcgtatttattatctcgatctggacgacgtcgctagctctacttattaattatatatcattcattcattcattaacgacgaactcactgatgcactatctagatactacatgattgatgctatatactattaattagttgagtttttgctttaagattatctatatggctgctgcagacagtacagtacatcgatcgaactagtgcgtgctggttgaactagctagcattgatattcatcatcgccggcccgccctattgtacgtagtacgatcaatactctactatgtggagataagggagtaattaaggataactattgatggtatgatcatatatagcagtattaattaagcacccccacccaattggtccataataaaaaaaagaaaagaaaggaagaagcactacttcttcccccctgatcgacctgtacgtgtttgatgatgatgatgagcttgtctgcttttttctgctgctcctatcctactacactactccctccgtcccgaaaaaagacaaaccctggttttcgtgtccaacgtttgaccgttcgtcttatttaaaaaaattatgaaaaaaattaaaaagacaagtcacgcataaaatattaatcatgttttatcatctaacaacaatgaaaatacgaattataaaaaaattttatataagacggacagtcaaaattggatacgcaaacccatggtttgccttttttttaggacggagggagtagttggtgattaaagtggagcttcctcttgactcctgagaggactaatggagatggaactgcaggcttgctgctgatcttaatctattaattagtatatgttagtattgtcatttcctttagtttgcttgtgaccaccaccaaaattaagcagcagcagcagcagcagctggagattaaatttattaattagcagctggctggtagatattgtttaattagtgctagtagtagctagctggagtgaagttgaggtgtactagtatatacaagtacaaggatgaacaataatgcgaagtggtggctggggtggccattgagccattggtaaagttagcagaaaagaaaaaggctagctgagaggatagtgttaggagagatcgactttaatttctttgtgaaaagaaaggcaggcatggaggccatgatctttataccagctagcagatcgaggagccttttagccatatgggatgcatccatattccatcatgggtagcctccatctcttgtccatccaaatttctgtcaccaatccactaagctttactaggagtagatcactaggactagctaatagatttagattgaggtcaagcctgtctatctatcaatctagctaggagtatcatcatatatagtacatgcatgcatgagcaccaacgatttgtcaatttgttcgataccccaacatgaccctcttaatgtacatactcctatccaggagtatatgctcctttgctccttgcttcttagtgagtgagagtaatgcttgacaatatatatctagctagatgagatgagaatgggatattgatttctgcaaaaactaaggctctgttcgttccagggtgtttggggagattgagtctcgttttccgcgcgcacgcttttcaaactactaaacggtgcgttttttgcaaaaaaattctataggaaagttgctttaaaaaatcatattaatccatttttgaaatttaaaataattaatacttaattaatcatgagctaatggctcacctcgttttgcgtatcttcccaatctcctcaatccccttcccctcaaacacaccctaagagtaggttaaaccggccggctacctcaaaagtaaagctcaaaattatatactcactacgcccctacaaagaacttgagaaacgactaggggtcttccagttagctccacaagatagtgggctagacgacctgggttcgaagcctcatctcttcatcccctaatattctttgggttcgaagccttatcccatccttccctaatatttgtgtcttttcccacaaagaacacatttttgaattcctgtatctaacgtttaacaatctgtcttatttttttaaaaaatgatttttttaaaaaattacccacatataaagtcttgtttatgttttattatctaataaaaataaagtactaattatattttttttaaaaataagacgaagagtcaaacattatataaaaaactaaaagatgttcttcttgtgtaacaaaaggagtagtagctatataggtaagtagtcttcatcagtttaaaattaacctcattttgaggatactctcacttttcctcccttccaaagatcactgtagctactagatctctgtggatgtgtgcattcattttgagaattgattgattcattcagactagctttgccaaagcctccaacaattaatatcagccccatcgtttggcctaaacagccaaaaaataagccaaaatttgaatttttgaacttgattttgaagttgattttgagatgcttttaacgtaatttttttaatattggcttttaaatcgctacgaacaaatttataaaatttttacttataaattaatttttattttctaataagccaggcaaaatgggcaaccgatgggagcctacattaataataaatgtaatattgtgcaacgtacgatttgagagacaggatatggacaatacagtatgcatcaatgaattgattgatactccctatgtctcatagaaaaccaatctagtatcggatgtgacacattctaatctgattctatatttattttttatgagacgaagggagtatacggtaggagatgcggaacatgttaacattcaaatttgagtcggtcgatcgcttactaccctccactgccaataatcttgattatcactagtaggagtacactcagtcgtcagtcagtgtcctgcgagctctgcttttaactcatcctgtccagcactcgagtaggaaggagtacactacagtctacagtgcagtgcagtactccctcagattgatcgatcgatcagatggtgtcgtatgttcatcacttgtctgcaccaattcaattcaattttcattcattcaaggagatacagatactatactcctagatagaagatggagtaattaattataattaaatatgtttgcgttgcaggtgacacaactggggtgcggaggcatggtagtgtgtacagccatcagccactgcgtctgcgacggcatcgcaaccgccaacttcctccacgcctgggccgccttcgccgcagccgacctggacctcgccgccgatcgtgacgacgacctctccgtcgtcctccatgaccgccgcgccttgcgcccgcgctgccctccgcgcgtcgccttcacgcacccggagtaccacaccagcagcagcagcagcagcctcctcctcatccagccccagctgatgccgctggcccccgtctccctgaccttcacagcggcccacctccggcgcctcaaggcccggtcgctccgcagctgcacctccttcgaggcgctggcggcgcacgtgtggcgcgcctgggtcctctccctcgccccgccgcccccgcccgacatgcgcgtcaagctcctcttctccgtcaacgtgcgccgccgcctcaagccggagctcccctggacctactgcggcaacgccttcgtgctggcctgcgccgaggccacgccgaccgagctggcggcgggtgccggggtgcggctggtgcaggaggccaaggactgcatcgacgacgactacgtgcgatccaccgtggacctcctcgaccagcggcgcggcgccaagccggacctggcggcgacgctggtcatctcggcgtggacgcggctggggctggaggacgtcgacttcggcaaggggagggcggcgcacatgggccccctcaccagcgagatttactgcgtcttcctccccgtcctcgccgaccccaacgccgtcaccgtcctgctctcgttgccgcaacccgccgccgacaccttcgagcaccattgctgcagctgcttcctcctcgacctcgacgacgaccagcccgccgtacccgtactagtggacaagcaggaccacgacaaccagctcgtgcgtgcccatcatcaacatgacatcctcgcctagtagcttcttaattaatgcactactaattaactactatttccatcccaaaatataataatttttactacctccgttccaaaatacaattatctctgctttacaactcaaattttgtccaaaatacttattatcactatggaatgccaattatcatataatcactttctatttctattgagaaaatgtttttaacagttcgagtggacgtccatccgtttattgcatgtcatctaaatgattatgaaaaaaattgaaaaaatatgaacatgatagatcaatatataatatatcaatccacaaacatgcaagttaaaattcaacttctataaattgtaacaaatatttttgttacaatttatagaagttgaattttaatttgcatgtttgtggagcgatataggtacatattgatagatgtcgtgtttgagtatactttgaacatatttgatcgccatcccgttgacttgcagtaaatgggtggacgtacactcgagttattagaatccatctccgtaagtagattaattaatacatctccataagaccgatattataattaatcgatctatcagaaaaagtatgcctcttttcgatcatttccttttctttccttaattataatttatagtgcccatccggctagcttgtccatcgctagcagccatctttgatacgcaaaatgatatgatatgatgcaacatttatcaaattaattaattatctaaagcttaactattttcaactcaaaatttaattaagtcactaacagttaaactagtctgtctgatagctagctccaacatcaccttaataattaattagtaccttttgtgtcatgtcaccggcggaattgaaattagcaccgacacttttacaaagtgtagtcgtggtatctcaggcaaatctgaaacagattatcatcatgcatataatattctactgtatattaactatattgatgcaaaggtgacggacctagctgggctaataattaatttacacaagcttcaattccatctgccactagctttctagtaccttctaaatatattaaaaataattaaggtcatatatacttagcttattccacaggaaaaaaaagaggataaataaataaaaggccatatgtaaaagcgcgcgtccttaattactacctttatctctaaaagagtgtccttttataattatagtcaaaaaaaattatgaacagaggtagtgatggttgggtgttatatttgagatgaagagagtatagagcaaccacaaatttatgaattaatgcgtagatgatgcatgcgcgccacgacgcgttgatgcagatccaatcgagcatatatactagtatgagaggcaagagatctcgaattcacgatcgatatatattcaaaccgcggccagtcaaacatatcaagaaaggaatacccatcaattacaaatagtgagagagatatataatttttaaaacataaataagagctaactacgaatcgcgtgttcgatttttcgtcacaaaatagggtgcccatcctcctcgcggccatgcttctctccgactttatcctggtcagatgcatgctgtcctttgctacctcttcacatgcatggatgcacatcagccatgctcccgtaggggtgtagacacataggcctgtgcccatatacaatggtatataatcaaattataaatcagataagtagtttgagagaatattcgtcttgaaggttaatactctctctgtttctaaatatttgatgtcgttgactttttaaaatatgtttaatcgttcgccttattcaaaaaatttaagtaattattaattattttcctatcatttgattcattattaaatatacttatttgtatatatatagttttacatacttcacaaaaggcatttcattatctggacagtcattctgagaaatcctcaaccacgattccatcaagcatgttgtcccgcatgaatgacaagcataaggatgcacggacgacaaccaggtgcatccatcgtgatcgtggtgagcactgagcactcccataatcccactggccaatgcagacagcgccatgaccatgaaagtatccaaatggtccatctcattctctgcaaccgaatcctccgatccgattccctgcacgacgtgctccaggcgcctctacatgcttccggcaactcaccctgggactgggagggctctacactctagttggtacaaaatcgaaagacaatccatgcatgctctctctctctctctaggcaaaactgttactggcaaattacaaccatgaaacttcctaccatcaaacaaaaatt

SEQ ID NO: 50707 - DNA, 4413 bp, Oryza sativa
atatatatatatatatatatattcagtgcgatttatggacgaactgaattagcatttgtagctatgtaaaggtagagaaaaaaaggaagttgtacgtagctagctagagctttcatttgatatgtagctcggttgctttttaattaattcctgcgaggaaaactgcatgctccatgatcacttgctcgctgctagcttttagttattgtactacagtagattgccgtactattaattgtacttgaactgttaatggaacgaatgccatcgatggatggatggattgatatatgtatgcaatcaattcatcgacgacggaatcgatcggatggatcgatgaaatgcatgacgatctctatatatatatatatatgatgctgatatgattaataaagtcaatgaaggtggggctaaataggagtagtcactaaaagctagctactgaggtcctgtttagatgggactaaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcaagcttttcgatctgcagcttttcgatctcttctctcttcattcaattcagccctgtttagatcatgtcaacaaattttatcctgtcacatcgaatgtttgacacatatataaaaaatattaaatataaacaaaaaaataactaattacacagattgcgtataaattacgagacaaatcttttaaacctaattgctccatgatctgacaatacggtgctacagtaaacatttgctaatgatggattaattaggcttaataaattcgtctcgcagtttacaggcggattctataatttgttttgttattagtctatgtttaatacttcaaaagtgtatccatatatccgatgtgacacaccaaaactttacacccctggatctaaacacagccgacgattagttgatgtgcacacgcccatgtatatatgcatgctcaccaatgactttactcccgtgctgatgaattgaatactccctccctcacatgatataacaacctaataccagatggaacactttatattacaaagaattcgtgcatactttatgtctaaattcgttgtactataaaacatcccatccaattctaaatttatatattatgaggcaaagggattatatattatgtctttgactatagtattcactcgatcctaaatatgtgtttgggttgagaatgaggtgggataaattggacccatccatgtttttaggatgggatagtcacatctatccgtttggtacgagggatgtgatgatcctacttcttaagggatggccaacatatcagccagagaagaaaaaaagtggttagaatagtatgccagtttttgcggggcaaccgggcaaagccaatgcggatcttagggcaatattcctttctagagatcatccttatctcacatatatattgtcacaccctgaagttcttctcccgagcctaaattaattaataaatggtctcgagaaattacctgtgtaaaatcaagagaggaaccctaattgaagtaatgcaaataataatcgaaaatggcatgtgggatttttcttgagttctacatgtcaaaatatgctaacaggatttttagtggaattttcagagctctagaaataattcaaaccaattaaaatcgagcacaagcattattttaatccctgggaaatccttttcttttttctttccttttccccttcctttttccctaatgagctgccagcccatttcctcctccctcccgcgcccttgctgggccggccgaaggccacagcccagcagccggccgcgcctcctctctcacccggggtcgccgataggtggggcccacctgtcgggtcctcccccaaccttcggacgctgccgcatccgcagccgccgccccgcaaccgcccgctcccgcgcttcccgggccacgccgcccacgtcgccgtctcccccgcgcctcccgctcctccactaccaatcccgctcgctcgcgcccacgagatggccgggattcgaatttcgaatcccgcctctctctcctctcccactcccccacgtcaaccggcgattcccgcctctcctggccacgtccagacccctcctcccctatttaagcatcaccgcccctccctctccctttttccccatttcaccgagctctcccatgccctctaccgccctagagccgtgcacccgccgcagtcgccgccttagccaccttcggctgccgctcgccgccgctagaaccgccgccgagcgcgccgttgccaccttcgggttcgcgagcccgagggctaccccgtccaccccttcgccgtcggactccgcccccggaacccactctgcaccatccgccggtgagttcggccatggccgcggcttcggccagcgttcccgccctctgtgctctctttctctctctccctctctaatttctcccattttgttccttaggtcctctcgaagcccgtccacctctcgccattcgccatcggcgaggaactcccctcccatccctctctatctcccgtaccgccgctgccgcttttgccgcgccgcctcgcttcggggccgtgccgccgtgcgccgccgcatagccgccgccgcgccaccgccgtccgccgccgcgccaccgccgtccgccgcatcgccgccgccgtccgctggtgtcgcgccgccgccgcgccatggccgtcgggccggcttgaggccatccaccttgccgcctgagtggccaccgcgtgcccgccacgtcagcaccacgtggtgcgccgcctccttcccggtccatggacccggtccaccatgaaccggtgccccgagcctatgacatgtggggctcgcctgttggcgccgccctctctctctctccgatgacgtcaccagggttaattattgcgcaataaatacattgaggacttttctgtttatagaaaaaacacaatgaatcttctaaaattcatagaaatttcatccgagctccgtttaagcccattcaagtctcagtaaatcaataaaaaaatgcaaagaatccattaaaaatggttttgttctctgtttcagtagtcttatagcctgtttgtattgtttgctttgtatgtcgcttagattccggctctcccgacgctccggtgtactttgagatagtcgccgaggtccctctagcagcagagcaaggcaagtaatgcttgtcacttgaacatattggtcccatattgcaaatgctctattgtttttctttaaatactgcattgttttataatgatactatgggatgcctacctactgtttcagccatgctatttgttaccttgctcctttgttagcttggggatataacatgactagatattggattagggattgcgtagccatgcttagttcaactagtacacaatgggggatctacattaatgcatagatatcagattctagtattgatattggtttagtgccaccgttccggtgttggttaattaaaatatactaaatggtgggctatgggtgcatggttttgctggtcgcacccatggcaattaaggaccgttcgcgggatgccttggaagaacttatcgtacttaccaccgaacgcgctgatgaagcctagaggggggggtgaataggctgtccctgaaaacttaaaaataaatcgcagcggtaaaattcaaatagacccggaacttcctggtaaggaactctggaacttccggcctgccaggcctggaacttccagtgttcttaggacaggaacttcgggtaacagatgaaagatgaaattcaaatttcgaaacaggagactaagccaatcttctcaagatgatgcacaggtattctaagcaggagatagatcacagaatcatccacagaaacatcacagaaagagacaagaacgatttttccccaagttcggatcttgcgatcctactctccgttgaggagctccaaagagctgggtctcaattaaccccttgcctcacttttgcaaaaaccccagaggaaatccacagctttcaaccacaaacaccctaggcaaatttctagaattaagtgaccaccaagatccaactcaacctacttctagaaattcgccacaagtgtaggttgctctacttggaaaacctctagaatctcagcacaagaacttcatt

SEQ ID NO: 50708 - DNA, 1284 bp, Oryza sativa
gatcatctccaagagtaataagcaccgagatgacagcccacgagatattccaagtactcacccaagatcctagtcttcacacctctccaaatcttcttctctccctctcaatctcactttctcacaagaattaggctctagattgagtggagaaggcaagaaacacttgggagaggctagcaacagctctaggttcgaaaagtgaaagtggaatggccaaagaacgagctggaaacgagctggttatgtataacagctaggtgacgtcatctagccgttactcataattttgaactggaaactagacaggaagttccggatgaactggaaactagacaggaagttccggacctggaagacaggaacttccggactacacttaggaaaatctttttctcaagaccggaacttccggacctggaagacaggaagttccggacttgcatttttggacatattgagtatttgcaaaaataactcctagggaaacttgacacttggttcacactaagagcacttgacatatctaagagtatcacctggaacccctcttaatagtacggtttttcctaaaaactcgattgcaataaataaactatcctatgcacttctcgagttccggtccgctttgattttatacttttgggggggtctccaagcatccatcttccacaccttggactaatacacctgaaagtaactcaatgaactcattagtcccttaaccacatttgtcattaatcaccaaaacccactaggggaattaatgcactttcaaccacaagccagcgtgggcaacggctgggcttgtagtatagcttttctctagctgacgctcctaggcaagggtgggcgtgatggagcggggtgggccctgcgacggcctctgtcgcttccggattcacctaggcaccatagggaactgtccgttgcccgctggggacgggggtgaaacccgaggtgtggtgtgcttggctagagagggttatgcgaagggtcctgtcacagcctctttccggtatgtcgtggtggcatgtcggcgcacggtaacgtgtcgtgaggctgtgtcttgtgggtacagttgtacacctctgatcagagtaaaactattcgaatagccgtgcccgcggttatgggcggtcaaccagattcaccgtgattagtctcaccctagcttagtctaatggaattgattagttcaggtggtgggttgggcctgttgcaacgtggtgtagcgttggacagtggatggttactattaattaattacttacaactatttta

SEQ ID NO: 50709 - DNA, 2111 bp, Oryza sativa
ttattcgctctcatgtaaaaatgatctatgcacaaaaattccgctcttattcgcttattttacttgagtcctttattgtttattttataattggatttgagcatgcattgattctccgtcctttgtcttctatagatggccgactgtcccctaatgcaccaaggtcagactatgggaggctttgttgcagagttgtcccgcatggcgtttgtgatcggttttccaagggagccgcagtacaccagcatccaccctctcagtggtgagttcccgcactaggtccacttggagattcacggcatacccacctacctaccctccatggaggtgacagcttgtgggggcacatttgagcatgcttgtgaggaggccgccctcagggtgatggcccatctgagggagctgcatgacgacactctgaacgccaccgcctaccgcttccatcctcgccgcggttccagctccaacaccagcaccttcaagtcagcttggggagagaacgatgtcaccttcggccacatgagtgacgtgatggagggctacgacaagctgcacgccatgctccacaaggcaaccaagaggctcaacgaccagaagcttgtgaggatcgctgagttgcaggatgagttgtaggatattatatacatcatttgtcccataaataatttcctgatcataaacctgaacagttatttgttcatatctattatattattaaaacaactttgaaaggaggcaccacgttcgctgtgggggctagaaattctcacattaatcggagaaaaagaaaaggagagtccaaatagaaatacaatttaaaaatagctgaaattcgaaattaaaaataagcaatattgagagaagagtccatgtaataacccaatacgagattaatcaaaattcggaataaaaataaaataaaatcaaaaattagaaaagaaaagagtccaagtaggaatacaatttaaaaataaatgaaattcgaaattaaaaataagaaatattgagagaagagtccatataagatcaaagaacccaatacgagattaattaaaattcagaataaaaaataaaataatatccaaaattagaaaaattaaaagagacttcaagtaggaatacaattttgaaacaactaaaattcaaaaattcaaaaataaaaatattaaaagaacacttgtattaattaaaatttgaaaaaaaaattctgaaattagaaaaagaaaaagtatttcaattaggaatacaatttataaagaactaaaattggtgataaaaaataaagactgttgaaagaaaaggccatctaaaacaaatgacaagataaattaagtaacatgcttataaaggagtagagtggtggcggttgatacgacatataaaaattgtcaataaaacatcaaatagaattttaataacgattaaaaggagggatgacaggcaggccgtgaagcaaacgggcaaggcggttgctgggacttctagaaagtaaaaaaataaaccccattgataatcatattcgatttttaaaatctcaatgacaataaaaaggaaaaacaacgggcggggtgtataggagtatagttgcagagccgacgacggttggcgggacttatagaaaataaagatttagaatcccaatgacaataaagagtaggcagtggatgggccgtataggagtatagtggcatcgtttaacaggatttctaaaaaataaaacccaacaagacagtaaactctaaaaactacaaagtccaatttttaaatgttcagaacttctaaaaagtaaaaaataaacccaatgataatcatgttcgattttaaaatctcaatgacaataaagaaagaaggcagcgggcgagccataaaagagtacaattgcaaagggccactgacagtttggcgggacttctaacaagtaaaagaacgataattatgttcgatttttaaaatgccaatgacaataaagagaaaatacagtggacgtgtcgtagaggagtataatggcagcgtttgacgagacttctagaaattataaaaacgaaacccaacgagacaataaagtctaaaaactagaagctccaatttttaaaggttttaaggagaatgaa

SEQ ID NO: 50710 - DNA, 12793 bp, Oryza sativa
ctaagttaaacttctcatttttcacccgaatttacggaaaaaataaacacattgtcatctataacattaaattagttttattaaatccatcataaaaggtgtcttcatagtgcattcaattattattatagatattgatatatttttctataaactcgcttaggacaaaacaaaattacgtgaaatatgtaatgaagggagtacgttaaagaaaaaaaatactgtagactgacaacaaaaacccccagcccagcccagcccagcccagcttagtgaggtgaacatatgttggaacactagtgggccgaatgatgagaaataggcctatttatatgttctttgctgtcgggctctgcaaacaaatcctactggatggcctacttcagatgacgcatctaaaaagatcaatcaatttgacagaatttattaaatagagaatttgaggacgtactttggcagcaaatcaacgtcagatacatacaaacagtgttactatttaggagttaaagtaggcatattctagcttttaacggatcgctgtctcgtggtctgctttctcctgcagtgcatctgcacatctgcattcagataataataatggaagagagcatcttaaggcaaagggggaaaaaaagaagagaaggatgtggagaatggaggggacaggtgagctgatgtgaatctgatccgatccgatttgatctagaagcaagtaaaatagcagtagggccggagatattgatgaatctgatgctaccactagtgaaacagtgagcaataaaatagtacttcacagcagggttcccttaccgttttggcggggttatcacacccccacggtcaggtggttaccccgctccacagtatactgccgcagctagtatggagtagttgagttttgtgtgatgttgtaatccgacaggcagaaaagtcttgcgatgcaaatatatctttgcacacaaatacagtacgtagtacgtccgcaacacaattaaccaacagcagcttgtatgcaatgtacgtagatgcatcacaagtaacagtatcacacacacacagacgtgacatgttcatattcgtaccgggaccaaattttatggatcaacaacaaacattccaaacaatgagatggctggattattacagagctggaccaaacaaaacaaaacacttagctagggccagtcgagcgaccacacctgccggcccctccatcgatcagaggcgcctcttattattccataaacctccctcactcatatgtagagatagacagatagatttgatttgatcctgcatgtatgcattgcatgttatgagtttaacgtatacttgcagtttgaaattaccaacaatgtttatgtagctagtgagattgtctgtttgagaaagaagaaaaaaacagagcagagatagtgtctgagaagtataacttacaccagggaacaatcttccagcgctggttgtcaccctcgcaccactcccagagcaccagggtggttccgtcgcgcacgccgccgtggtccttgtctccatggagcgcgtcgaagttgaggtagatgttgttcaccatcctgatgcaccgaaacccactcccaacgtccctgctctccgtccacagcacagactcgtccatgtactctggattgtagcgcaccaaacggacctgtccatccatccatccatccatgacatattatatattcctcctagcaattcttcactgcagtacatactaaccagagatcttacaacacttaacttattgaacgggagttagcgagtgattttacttaactttcgatcagcaggaatggtacagcttgagatcccaaaattgtgttcatggcaattgcatactaataattctttttcacatgacagacaagcacatggacaccccaccccaccaacatgcatgcggcacatggatcatggatgggtggatgccaatcccgaactatcacagatcttaagttgttggttgcgattgtaaggatgcagtaacagagtctcgcaatattttctagacatgacaatgaacatgcaagcatatactattaattgtcccaaccaaaaggaagataaaatagtatcaatggtgcgagcgagtagaagacctcagactaaaaaggatattttaatcctagtgatacagtttggacaagttgtgaatagaaatgtgatattttagtcctgtagagtagcaaatccttaaattaataattcaattccaaactggtttaatgtaggcaagctaatttggacttgcacggacggggtgacacgcacgtctctggattggtgttggttggcaaaagattgtaagagaggcagaggaaaagaggaaatacgtacagggtgggattggccgatggagtgcttgagggcgtcgccggtggccttgttgacgagcgccatggcagggtacccttcctcgtctttcactctcgtgctgtacttcatgtccttcacccagtgctgcatccatcatcacataaataattactagcaattgttttgactgaagatgagggagggggatgaatcgcgcgcgaaattgaacaagtagggagggaggtaggtacctgcgtgtggtcgtcgcgatcggagcggacgaggcagaccttgccatctctgacggcgaggctgtagttgtcctccccggccttgcagtagatcctgtgggtcaccggtggggctcctccgccaccgtggtaagggcgggtctcttggacggggctgatgtactcggatccaccgtagtgcggcgtgggcctctggtggtcggagacctcgtgggaaacgtggacgacgttgccgtagccccctcccccatacgccggaggaggatgagcgtagtcgtgggaaggcgggtggcgagcgtagggatcagccggaggaggcgcttggccgtagggacccggcggaggggctgagtcgtggccgtaggcgggagcgggagcgggatggcggcggcgatcgtcgtcgtcgtcgtcgccgcggtggccgtggtggtggtggcgatgagggaactccatgatggatggatttgggggaatggaggagatttattagagtcaggaggtctagaggagagatggccggcgcctccaatttatgattgggtctcccgtcccgtccccggccccgcgcgggtacccacggcccataatacccccggtaatcgctacagttacagtgggctcaatcacaaaaagttcagagaagaaatcaatcaatccctcaatccaagcatgagctatcacagtgctaggatggagatcgacgagaacgagacacacgatttacaaataaataggactagtttactttgcatgcgtacagatacagatgtggagtaactagctagctagtctccttgcttgaagaaatagacgtacacacaggctatatgtgtgtgagaaagataggacccacatgacaggcaggcagttaccgggtccccatccccgctcacccgatgggtatgaatttcgcccgttaacatccccatggggattatttctctcctgttttggcaccctagtagaggaattccccaccgggtgacggggaacggggccccattgccatccctgcaacttggggttattcacaccatcaacatctaaatcaatccaaattcacccctaaacacgtctaaaataatcagccattcgtatttcctcgattttaaatatctatgctaccctttctgtactcctttgaaattatgtagtgacgatgacagccaatctaccgtcccactattgcttttgccgcttgtacaaattgtcccacaatatcttttaatatcatagagtactctaacatttgattcaaacgagtgaataacaaataagcaaataagtgatactagatattttttatgatatatatattatgatttttgttgttagctagaataatttattgttgagccattttgaaaagaaggaactttgtttaatagtaaatggttgtgagaaatattacattatcacacaatgaaatagaaaagtgatttcagacgtttaaagtcgatctagacattcccatagtgagttgctggttttcgtatcttttaagcatgtgttattagagagatgtatctgggtggagtatgcgcgtatatgtcttatatatgtaactaaaataaaatatacaagaatttctgtatgtaatttcatgagtaatactagtagaaactagggtaattgtgttcctaccattattttatagtttaattatgattttgctcctgttttttgggtttgtgattttgcccctactttttaagtgaagcagccgtctgcctctactctgttaactcatggtaacggtgttaaatgtgtggtgaatggacaaatatacccctactattgaaatcaataattttggcatcaacactggacatgttccaagttaaatttgtgcgtatttcaagttaaatgttgacaaattttgtaaaagttgacagaacacaatatttaggacaattttcacagaattttagcaataattttaacacaatttattatgttaacattttgaattgatgacagaacttgtcctcacagatatacaaaccgaaagttcggttaatcgatacttcggtctcgatcatcggtctgaccgaccagactgaagtatggtatgcaacacggcatgaaggtagccagcttcgatccaaaataacaaatcaagaagatcaatcaaatgaaaatccttgcaaacgaaagcccccaaactagaactcacaagtcaatacatcagcggcccctcgtcttctgtatttccatggcaatcacaaatatagagatagcaaaagggagaagataagagagacaaagatagccatgaactcagaaacgaagagaaattatacacaagtataaagtgttgttgccgtgtaggattagaagctctgggcccttcccctcgaggatgagttgctgctgctcgatgaggaagctgccaccaccatgtttgcggacaaggacgtcgacgctgccgcggtggaccgtagcgcttgtatacgtggaggacgtgctggggtggtgacaagtcggtgcgcgcagcagccggcggctggacgccgggcagtggcgacgacggctgacgagcctggctgtgcgcgcgcccgccggtccgcagcgcgaggatgccgctcctcttcgccctccctaccagcgcgcaaagcgccgccgtccctctccaccgcacgctggcccgcggggccgccgcgcctccctgccgcgccctggccttcgcgcgccgccgcttctcgctagggttctagatcttttcgatttggggaaatcgttccagcaggttggctctttcagtgaaccaagggtaggatggtcattgacaaattagaatatcactttcttttttcgtttaattcgaaaattctaggcccacctaactaccgtcaaaaccagaggcagacggctgcttcacttaaaaaaagcagagacaaaatcacaaaccctaaaaagcgagagtaaaatcacaattgaactgtaaaacaagggaaaaacacaattacccctataaactaacgaaatcttagatagaaaaagaaaatcaataaaaggcaacacgtagtacgttctaccgatcgatagcaaccttcgtgactgaatattcatgtagtacagcgtgagtgtgaggtggcattaatttggtggatgaagacgccaccctcctcgaacgtacgtgaccacccccaccaaattacacgtcctcatatatcaacgatcttctcttctcttctcttctcttctaccactgctctcccagtctagtactccctaaaaaacgaaaagttatggttaaaatactatagataataaagtaagtcacaaataaaataattaataattttaaaattttttgaataagacaagtagtcaaatgttacaattaaaaactcaaaatcccttatattatagaagagagaagtactgtcacaacaaaaacatacacacaccaaggacagctcattgctccacctgatgaaaaaaaattctctgcaacaccccccagactagtggcgcgtgtccgatatctgctgcatcggaccctctttggagcagagccgagccgagcccatcctgctggcgctgattagagccaagctgtccaggaccaggagtacatcgagccgcgccgttttggctgtctttttgcttctgcaattcagaccaaatgaatttacatgatgctgtacaaatatatatggtgttgtgaacctctcgccatctgattttaaatctccgaaacaacaaaaatctccaaaacggatcaactgttggtaactttttttttcattctgccaatcatgaccaatgcttgcataaaaaatgccctattaaaaatctaaaccggctaaaggacactatacagaaacaatttttctatacgaaaacttctatagtttgcaggcagacaggcgagcggcggtagccggagtggcggcgggcctcccccacgtcgctcgtgaatccagtggttgttggatgttttatttcttttgatttatgtaggtattggtggcataaaattggcatttaacagccgccaacagcgatgccggccgtcccccacctagttccgacggtggcagccctctctcgcccggcccgcgcggttccgccagcggtggcgagaggagcccagagaaggaggggagggtcgacgacgacaatggcgggaaagtccctcacctagctagggttttaattttgggggatttttattttttttttggattttgatttttgcgtacgcataagcacttgcacgcgaaaattgaatttttgcgtgcgagtgcaccacccgcatgaaaaaataacgattttcgcagaaattttcaggcatacggacgcctcaacagcacgcaagaataggttttgctcgtttggaaaaatgtttttttagtagtgggagccgatttaggccttgtttagttcccaaaaatgtcacattgaatctttggacacattcatagagcattaaatatagataaaacaaaaaactaattccacagtttgcatggaatcgcgagacaaattttttttgagccaaattagtccatgattagctataagtgctataataacccatatgtgctaatgatggattaattaggcttaataaattcatctcgtggtttccaggcgagttgtgaaattagttttttcattcgagtccgaaaaccccttccgacatccggtcaaacatctgatgtgacacccaaaaattttcttttcgtaaactaaacaagccctaatacgaaataggataaacatccgtctcgtgaatagaacggaaggtttttgggacagaccggacgacttacaaggcaaaccgacgaagatggataaaactagactaaaacttggtaaaaagtagatgcgatatttaaaaagaagttagaccagccgggtcttttcaaattcgatcatacttttctattcccgttctatttgtcaaatttagatgttaacactaatatctgaatttaaatctccaaaacggtggaaatggttgataatttaaatctcgtgatggcaagacacctctgtccacttgaccctagaaaaatccccagaaatattatcaccaatgcttgcataaaaaatgccctattaaaaagtgaaattattcagactttatgtgcagctggtagatgctgctcggtggctttttcaacgatcaagtggacagaggtgtggggtaggagatcggacatcggctcggctccgaagctagactcggctacagtaggaatattggacacgcgtcactagtctgctcggtgtcgcatgggtggtgtcgtgcactcgtgcggcactgccgcagagaatttttttcccacctgattgcattcgattttgaatcttttttccctttttctaattacacggtaggcacccacgcccacacactattacacacaccaaggaatatgtctcctaacacgagacaaaaaaaaagcagcagtatatctttgataacactagaaacccgccgaaagactatgtgtatgtgtgtaatattagtgggcaccaggatttaaactatggctggtgatgccacccactcatgactctgccacaccattagtgcattcgattttgattttgattcttgttcttatttcgactttaattaatttccattcttgctcatgtcttctccagcctaaagtcagtcatctaagaaaggaataagttcactttagatctctcatcttgacgtcgagtttggattacatcctcgaaccacagtaccagatataacaaattcctaatcttataaaaccaggttaaacgaagtcccaagacagtatcaagggtggttatgactcacgtggcactagaaacaaaaatacaaaattaaaccctatgaaacccacgtgtcagtgaaaacaatatattcttccttattactctctctcccctatctagaggaggagaaccaggatgacgccttcaccgacagcgggctagagcgaaaggacgcacagttgctcggcaagtgcgttgtacaagtcgcgctgcgggatgctcggctcgacaccatcgccaccacctagctcctctcccgccgattgcttgtgcgctgcccttttccttgtaagccatcacccaaagatggaaaagagagagaaagagaggtggaggaaggaggaagaaaaaattggtagctgatatgtgaggcccgtgtggtccccgtcgattcagtcaaaatcatacataatactgtcttgagatctctgttaatttagttttgtaaattagagaatgcgttacatctcatattatggttcgaggatgtaaaccaacctcgatgttaagatgagggacctacattgaacttaatcctctgatacatgatctatgtagcgtgtaaaggccaggccggcccactattcgttcatattggcccaggacgtaatacatggagtattcttcattgtcgtctctcgcgtcgcggcattcacttggcccatataagtaaatggagtatacggtgttactactaggaaaaagtacatacaaggtccctcatcttgtcatcggattacaaaatcgtcccccaaccataaaaccagatatacatcatcccttaacttagaaaaccggttcacttttggtcctcaggtggttttgaccccggttttgtctgacgtggcagctgagttagctcaagccccacatgtcagtgaaccctcatcctcttcttctccctcctctctatcctctctctcccctgcaaatgggcgacaggacggagtggcggcggtgggcagtgcggcagcggcggagcaggtgggcagagcaggccgacggggcgcccccaccataaatcccacctcctctagcatcggggacggctttatcagtgagaccgccgccggtggcttggccatgcgccgcggtgtccatgtcggctgccacacggcgaggttctgcgccgatgggagctgtggcggaggcgagaagtggtgggcgtcgctgctggggtggtcgggacaggcggactacatcaacgcgcagccgacgtcgaggaaggaggcgcggccgtcgatagggaacccggcggcggagcagcagggtggtgggaagaggttcagtgtgctgatggaggagaaggcgtggcagccgcaccgacttgctggcatttctccccatgcgccatcatcgaatctgctggcgaatcaccgctcgacgacatggaagtgggggcagcgacgaatggtgttacctgggaggcgctgccggcgaggtagatgacagcctgcgcgcgagatgagtggatggcctccaccaccgtgcggacctagctctccattgtgcagtcgcaagaagttgccactactcctacggctgaactcccccgtcggcccgccttgcccacgcgcagccatggtgcccccgatagcccgtggttcgacggtacgctcatcctcccttccaccacggctataaagccagcacgcgcgcgcactccatgtcgctgccaccatgctctacatcaaccgccgtcatctgccatgtcacatccaatgtggattccacgtatggcagccacgtggcttggacgatgcttgtcactagccagctggaaagcaattctgtgacgagcacctttatcatggatagaagcatttctatgacgaaatctaccgtttagtcatagataaacttatgtgacgcgagttctacgacgaatcctatttcgtcataagttcatcatagatgttactttacgacgattatcacatcttccatgacaaaagtagattgtcatagatgtgctgatctctactagtgcatcttcagtgttcaatcgaccaagctgccaccaccaccaagctccttgtctctccatgaccccatttcactcctcgccggcgcccaatgaccaccaccattgttttccccaaatctggccaccaccgccgccccaaatccccaaatccaaagttccaccgcctccacgctgagagcccaaccgctgctcttcctgccgtcgctcgtttgcacttgagggccacttctccaagccccacccggccaccgcccttcatcgctggagccgcgaccaccgttgccttgccgcgcctcacgttgttaggcgcgagtgagaagaggagcacgaaagagacaggagaaaggagaggatggtgacgtgtcatactggcatgtgggtcccacgctgactaatctgccacactagacaaaactaggttcaataccacctaaggacctaaagtgaaccggtattgtaagttaagggatcctgtataactggtttttgggttgagggacgattttgtatctcggtgacaaatgagggacgtcagatgtactttttccttactactattaatttcaccatgtacgtactgccctatacttagtagtactgcatgtcttcatagtagatttaattatagagagattccatgcgtgcacctgatctgcttgcttaattcctcagtacgcacgtatacaagcgcttgtactgatcagctgtcagcaagcaattgatacctatatataccttacatatacacttgctaattattagcttgattgtgtctttccattcatatatagatcaatatacatcatcatacatataaattaatggtttgtcatattcaggttcgacatcagctatgagctagatatatatatagcggatgcgtgaggcaataacaatcgacaactaacgtaccaacacaagtatgtatgtacatatatctcaaattaatccacaccctttttaatttgctaccttaattatttcgttctcggcctataggaagaaatggctttgattactaaattaaccttgcaactggccggttggtcaaacatgcatttggttgagaatattctccttctcatataagtatatcaatcggatcgatgcatggtttaattaacaactactagctagcttgattctactcctagctaggtaactttcacaagcaaacggttaggtaacagtacatgcatggtttacgtataaactcagtcattctctttatatatatatatatatatcgatcatcgatccattattgttacgtgtgagaattctctatctatatgatgcatatacatatatgtaacgggaccaattggcacgtaattaatatctgtcacgcgcaagttatttactcctaattaattaattaagctcgatcggtgaaggctaatcaatagaaaaattaattagttaccctagctaggacaataacttacaaaagcttctgccccatcgcggttcttgtgttatactcccctggttttagcgtaggaacccattgattttgtgcatgcataacatttgatcatttatcttatttaaaaatttagtataaatatgtggaagtataagttaaggttataatttttctgatgataaaacaagtcacaacaaaataaatagtatttatatttttttaataagacaaatggtcaacgtcacattaaaaatcaatagcatcgggcattaaaaaccaagagtaataaaaaactagagttcagaaatccacaactctcaccctagctagttttttctttaaataattcacccttagctatatatattatgaaatttatacataataatatataataattccacccttcattaaggttgtggacgtttagttcacgccaaaatttaaaagtttagttgaaattgaaacgatatgacggaaaagttggaagtttgtgtgtgtaggaaagttttgatatgatggaaaagttggaaatttgaagaaaaaatttgaaactaaactcggcctaattgctgctggatactcggacaacctgtgatcgagtatgcagtattgagccaaccgtctaactttcatggaattgaagaaagccaaacctttagtacggattctgaattgcaatatgatccatgctagcatgcgtgtatatgaggatcaaactagtgtaatatattaagccatccgaatacatatatatttgtgttaattcccagagacaattaatttgttgtaaaacactgctatatatttggcacatgattaactgttacttacaacgacttacaacaacgtatataattgacactaattgctagctatgtactccagtacacatgtatgtatgtatgtacattcctgacaattaatctattaattaattatctatcagtttgtgatgaacaagaattcaattcaattaaatccaacccctccaataattgtgaacaagcttgg

SEQ ID NO: 50711 - DNA, 2614 bp, Oryza sativa
ggcctccttcttcttgtagattctgcacagcacccactcgtccagctgcgtacgcgcatgaatataattgcgcatatatatatatcgatcagtggatggagtatatggaagaggatatatatatatgtagttagcactagcaccgtagcacgtacgtaccctcatgctggcgctgctggagctggacgatgatgatgaggccagctgcttcatgttactagtataggaggaggaggaggaggcggcggcgttggcgaggcggtactcgtgcatgatccagctggtcttggtgcccttgggcgggcgaccgcggtagaagacgagggccttcttcacgcccagcagtaccgtctgctgcgtctccgagatggagatgggcttgtcggttccggtggccttccagtagccggagccggcggcgcggttgggacggacgccgttggggtacttgcggtcgcgtgggctgaagaagtaccactcgccatccgactccccgaacaccgccatggccggcagctcccacgggttgtacttgtaaatgtccacctcggcgatcaccggtgccgggcagggcgccgccgcggcgcgcttgccgaggtagtggaggaggagctcctcgtccgtcgggtggaaccggaatcccggcggcagccctgcccctgctgctgtgtgatgatcaccgcacgccgccgccggaagctgcaggtcgatggtcatcatatatatatggatatcaatcaattaatctcgtgattgatcaatatttgaatgcaatcgatggaagaagaagaaaaggatagaaatttgagagttgtggatgggggcaggccacctatatatatacacctagctcgatcgatcgatcgagagaccattttattatatataattcctgagtacatacgttaattaattaattaattcttcctcccaagtgaatacataaagtacgtatgatctagtacagtgatacaaatgtcaataccatggggttaattttgtcaacagtacgttgtatatatctattgtccgaaattaattacttactagtaaagttttatatatatttcttccgacccggccgtaaaattcaatggtaagagattgagactcctgttggagcaagtttaatagtatagtcaactactagctccaaattatctatagccaatgtaatagccaattcatataatagttgcttactatactattaatacctggtctcacctgtcatacacatattacgtattagagtccgtgctgcagctggctatatccgctgctcttttctctctttctttatctttttaaaatatgtttataactagcttatataacctgcttctgtacttgctcttaagcagcagcaacagcttgtgtatagtatagagaagccttcgatccgcacgcccagcctctagtactagattggtaaatacagtcctacacacttaattacttcctccgtaaaaaaaaaaaagacaaaccctgatttccgtggccaacgattgaccgtttgtcttatttaaaaaaattatgaaaaaaattaaaaagataagtcacgcataaagtattaatcatgttttatcatctaataacaatgaaaatactaattataaaaaagtttcatataagatggatagtcaaacgttggcacggaaactcagagtttgtttttttcttgacagggggagtagatttttagtacagttccggccagcacccatgtaggagtatattcgatctacaagctaaataattgttatgttgcatgcatggtagcccaaattcgcaggaacataagtaggagtatattatatctttgacagaaacacaagtatttcttccgacgcgcacccaccgcgccggatatacatacgtatatataccggcagagtacatatatatgtaacgtgactgattcgattcgatcggtcactcaaccggaatcgacctccaaacgtgactaaattaagatgcatggaatgacacgcaatctcttagtaatttatactgttcggttcggttcaatcaccatcgccgcgcgtaaatcgaattattcctactctatctacctgggccagcaaatcaggcctctcttaattggctcatcagtttgatctatcatatcacaaaattcaataaaataaaatcaaatcaaatgaattgagctacaccaccatcggctaatcggctatgcaaaacctgcagaccatgcaacatttccaaaattatgtggctaaattcctgcagaaacatcaattaggctgtgttcgtttgtgtgagatagggtgagaaaacacctcgttttccgcgcgcacgcttcccaaaccactaaacgatgcgttttttataaaaattttctatagaaaagttgcttaaaaaaaacacctcgtttttcgcgcgcacgcttcccaaactactaaacgatgcgttttttgtaaaaaatttctataggaaagttgctttaaaaaatcatattaatccatttttaaaatttaaaatagtttatactcaattaatcatatactaatggctcatctcattttacgtgtcttcccaatcttctagactaataaactagctagctgtattctgcacaagtcaaatttgc

SEQ ID NO: 50712 - DNA, 934 bp, Oryza sativa
attcctgcagccccacttgtcatccaattgtttttgtagaaagtcgagaaccgagagacgctgcaaaagtattacagtacatgataaaagtcagtcgtcgagagcaccacaaataggagcgcatggatgaaaggcagtacacaaggataagtagtagctacccgctgctcaagactggcctctccagattccagcttcaaattctcaaggcatttaattgcttcctcaaaaccctcaactgccatgctttcgttcccaagatttctatcgacatccgcaactttggcaagagaagttgctacatcaatgacctatatccacaagtagacagatcatgaacagcaaaagaaaaaacactcaagaatatgtctgttccatgtagcagctaaagcctaccacaatcttacaaaatgctttgttatcttcttttggttctactgacattaaaatttagagaagataaagggcttgtttggtttgcaaccattttgtgtgttgtacaaatttctgtgaagttgttcatttggtttgtagccaatactttttatgtgtacgcgttttaattggttttcattaccaaaattttggcagtgccaattttttggccacagactaagtaatgaaataaagccatcatctcaatggtattgacaattttattggcacggttgaattgggaacaagcataaatataggttaaaagatctgtagccatcatttatggcaaattgccaaacttcctagtatggtctggcacttgctaccacagacttcagacaacaatttgcttcagagaaaggaatacaaaaattctgtgtaggaaccccttttttacatccatttttctctgcctactagtatgtattatgtgcaatgtcaatcagtaccaggaccatgaattatgggataaaatagctactggtccatgtgcaat

SEQ ID NO: 50713 - DNA, 1748 bp, Oryza sativa
catcagtatgctggctggtgtagggcatggttaaaggtttcccacgttttccgagctgtgaatatacttctattcagacgaattgcgaccagtcataattggcatcactatcagtctacaacctgctagacaacctctgtggtctgtgcatcagtattgtagaacacgctgaggcacataacagtttaatattttaatggagaacaaacgttattacaacaagattcacctttcccttgttcggaaggcaagttctatgcctagtcaaaacatagaaaattcaggtattagaacacatgaaagataactaggccctgaatgagcagaaagatgaacgggccaaggctagaatgggccctcgtgcacaacagatacaaagcattgagcatctctcttcttttgaggaaagctacagacatttcaaagttaagaactgttctctcaattagaagaaaaaaaaagcatgcaagaatttagctcaatactccgttcgtttttaaatgactgatagcaggcacgattcacttttgaactttgaccactagtatttttgttatatatttacaaacacaagaaatgatgccatgctattaaagtgtgttatgtcctaaatataagaatcaaacttttgttcaattaggtctaacaacttaagagcaaataatggtcaaagtttaaatgggaaagtcaaacatgtaaattatttagacacggagggagtaggagtaggctataaacgtatcaatagcaggttcacatatatcctccagtccccaagagaaaattgtcgtaccagcagtccccaagcattcctaacacagctccaagttgagaacacagttcttggttgtcttgtttagatttcaattcttccctgatgtcttgtgcacacatactgagccttgactttgcactttcaatgttctgtgcgcgaaaggcctggatatgtaaaagtcagaggtattatcaaaatatatatagagagcattaataaattaatacagagcagaggatgaaggatatatgcaaatttcaaaggtaaaagaagctgagcgtaactgaccctcatcgcttgctggaccagaaaagcccctctctccatggagacatcctcgtaaatgaccttggtcttgttgtcacttgcggcttccccatcgcctgcagcatgtgatctcttgattcgggcatggccatcaatgaagcggtcgacaaggccttgaagctcatcatcgggctcgatcccttggatgtcagcaccacacaatggacagtccttaaagcgcaatatgcatgccctgacaaggaaatccagtgttcagaaggtatatactattgacggacggaaggaattactagtagaaagctagtattgaaatatgatactacgcacttgcagaacttgtgggagcacggggtgcatttgctgctttgatgtagcagagcgtggcagaccatgcagctgagtgggccaagcttgaaggtgttggagtcatagccaaaggggcactttggtggcaccacacgaggatcggtgttagcattgccagttttttcattgtcgtcgtcgtcgtcgtcggtgtgattgatggtggttttgttgtctgatgatgattttacggggcatgtggcgccagcggaggcgagtttggcaaaggggcatagagagctcataatggggttggtcgtatctatcgtaggtggattatttacctgcatgaaagaaagattggtggcaagcagttgagtga

SEQ ID NO: 50714 - DNA, 2712 bp, Oryza sativa
tacatcttcttcttcttcttctacactcgcacacaaatttatatataaaacaagatttctttttttttccccgccacctacaccctttcttcggctacactttctccgcacgaccatgtaaatgtaatggggataccattagtatattattaataattaatttacgacctgtgttgtgttcatcctcatgtctgtcacaccttcttctttaacttcactatactctactgtgtccttgtatcagatgccagggttctcattattcatacttactaccttattattattattattattattattaactgccacccatttctctgcagcatcatgccctgatggttggcaaatcactcctgctctcgacaagtgtttcatctacatacctacacccctttcttgggacagatccgaggctctctgccgcaacaacttcaccgctcatttggctgccctatcatcacttcaagacctcaatcttgcaaagtctctctgtggaccttccccctctggatgctgggtcggaggtcatcgcaacaacactgcctcggcttttgcttggaaatggtccgatgattcatcttcttggaatgatactgccttccctgctgacccattgcgcgccaactgcagcactactgggtgtgctcttgctaccaccaatgatgcatgcactttggttaccaatacccatgccgcacttaccgcaaaaagatgcagcgactcacatggactcatctgtatgatcaatcatggtgagtatcccttttgctaatactggtgccatctgtataatctattatctctttatcacaaatcattatttcctctcaccatatgcaaatatgtttgttctgtactgctgatcaactctactttatgtcagaagaccgatgctaccatgatcactgccacaaggagtatttcatagtgctcgtcgttgtaagcggattcattctcttgaccactctagcagtagtagtttggctacttgtctataggcgaagcaagaggaggagaagatcgcgtgaaggttccagtacttcagctaccgcgttagttccaccgctatggaaagtgttcaccagtgaagaacttagatcaatcacaaagaacttcagtgagggcaaccggcttcctgggaatgcaaagactggtggaacctatagcggaattttgccagatggatccagagtagcaatcaagaggctgaagagatcaagcctacaaaggaaaaaagatttctactctgagattgggagagttgcaaagctgtatcatcctaatttagttgcagtaaaaggatgttgtacgatcatggtgaccgctttattgtttatgagtttgttgccaatgggccgttggatgtttggctacatcatgtccctagaggagggcggtgccttgattggccaatgaggatgagagttgctacaactcttgcacaagggatcgcgtaagtcatcctagccatctgtacagaatctttgattacttgcctatttttcacaaacatgttactctacttcttactgagatgtttaggtccctctaacatagatccatgcataaacctagcttgcgtgcactcgtgtgcatgcagatttttcgtaccgcttgcatgcgcctcctgcactaatttatatccagacctatttggaactcatttgggttaccattttaggatggtttgtctttgcattaaatttcaaggtttcattcagagttttgttgtttcccgtcattcagctcccatggttgatcattatatgtttttggttgcttattaattgacaccggtgggctgcataaatgtacgtggtagcatgcatgggaaaccactaagtatacttacactttaattatgtcataataaagacaattagagaagccacctgttgtcttacggttctatcgctgcaggtgcatgattctagagttctcgaattatattgatggcttctacatccatataatcttttaaagctatattactcaagagtgttgtttgggttcccgtggaactaaaattaggccaaatgcgtatacgtcaatgcaagcccttatggcgttgtgttttgttttgctactattagttgctatttacttaccagtgctcattttgatccagatttttgcatgacaaggtgaagccgcaggtcgtgcaccgtgatatccgtgcaagcaacgtgctacttgacgaggaatttggttcccatctgatgggggttgggctgtccaagtttgtaccatgggaagtaatgcacgagaggactgtgaaggctgcaacctatgggtaccttgctcctgaattcatatacaggaatgaactgacaacaaagagcgatgtctacagctttggtgtgctccttctagagatcatcagtggccgtcggcctactcagtctgtcgagtctgttggatggcagactatatttgagtgggcaacacctctagtccagtcacaccggtacctagagctgttagacccactgattcaggagttgccagatgtaggtgtcatccagaaagttgttgacttggtctatgcctgcacccagcatgtcccttcggtgcgaccaaggatgtctcatgtggtccatcagctccagcaacttgagctaaagtcagcagcatcagaacaactgagcggcacaagcactagcgctacatctccaatgttaccattggaggttcggactcctcgctgaa

SEQ ID NO: 50715 - DNA, 4558 bp, Oryza sativa
ataatatttccattagcaaaccttagataatgaggtttcgatcaaattctggacttccttggtaccggtagagttgcaaggtcgactcacaactgggagaggcagtatctcttcagatccagcaagcctctacagcatgatatgctcttactgttagaaccaagcaaaagcaaaccacatacacttgcaattacggtaatggatgttcatggactaaacaaacagcataaaagtgcagtgcggtgtgccttgaattattattgcaatagagcagggcggggggcgtcgcctgtaccctcagaagcatcggtcccttctcagatggttggagaagataataacactcaagggatcctatcttcatcgtttcagtattgcattttgaggagcacacaagtccctgatcaagcttgaaaagtgtctcacatagaccatagaaaactgcacagaatatgagaatacacactatagatgttgaaatgtcacgaccatttaagaagccaaagacatattgcagatataccgttagacctacgttgggtgttctgatctgagcactcatcatcaagagcaacctcaacatcattagagctgggaatcacaatatgaggcgtcccaattatgagtcctattaacagagtttgccattaaattttgtacggagaagatacagagcctctaaagactaactaatgtaatgcctatcacaatagctaacagtgttggttaccttcatttagtgaggctaaattggtgcgctcaatcacgtcaaaagaaatggaggatgaggctcgtcgcaagcttgaaacgccttctgagtcaggaagaaacagtactgtctgttccccaattttcacagcagtatcagtaacatcagaagctgtgagctgtcggctagttattgggcacatccattttgccttatttgtgttagcaaggtcaatagggcgaccatggcacctgcatatctgttcaatatggtctggattaacataggtaacataaacctgcaagaagctacaggattgcttaaagtaaagtgtgtagacatgatagttattgtccgaagtaaatgaaaagctaaaaaaagggcatgatgaaatcaccaaatccatatggcaaaattccttcagaaacttgcaaggacaagatgaaagtgaacgtcaaaagaaattaaccaccataatcagtacagttaattagtaatatgtgacacgtataaattgcttcacctgacatgatggaaaaccatcaatgatgtgatttgctgaagcatacatgctgcaagatatttgattaacagtgctgataatgggaactctgaatacaaatacagcctgcaatgcctcctccttgtcatcctttagctcttctaaccacctcttgactaatccatgcaaaacttgagtctctgcatttccaagtttgtagttacaggatgacactattatagtttgcgttaatcaagagggttgttttacttgtatataaggagataaacaagaacctcaccaggactgtatcttcgtaccacacagttttcaaggtcacaaattgtgtctatgaaaccattggaattttcagaaacaccatcacatacgaatgcagctcctgtttccagcaatacaaactccactgtaatacactgttctgctgcgtcctgatgatgtcaaaagaaaaggaatattaagcgggttacttgatcccttggaaagaaagttgcaaagacaatcgtccacaccatgagagatcttcggagagcttgtgtgttttgtgcagacatacataaagcaatcacttttttggaggtatcatcagtggcccaagaatagatagctcgattgctaaaaagatttgttaatgacacatctgcagaggagaaaaattgagtaagataatattttttgtatttgaagagcgtgcattgtactcagttagagagcagagattcagtcgtttatgttgcctagtaagtttggttatggaaatgatcaaacattgaacacggagatcatccctagttagcatgaatataattattacctccagtagtatgtagagatccatgttggttaggacgaaaggcatcgagaggcaaattgttgacagcatgatggaagtctcgaaggttaaatttctctccaggcctatacaccaccttgagctggtggaagttgacatgttatgttagtgagtttgggaaattcacaaaagtgaggggaggaatatgtatttggctggtttgagattagtgagcaccgtaaatagaaatctacttacatgagcatgcagtaacacattttatatggtgagtcggtattggttaagttgttcatgaaggcagcttagtagtttcagtgagggatatgattggcaatcaatcgagatatgaatgatgcaataaaaaacagtagtaattccacaatgagccacagacttagtcagtgtatattggccatcttttacaagtaaaacaaacagctcagatttgcaaagcatgtagagtgaaaacttaaagaaaaacagagatgaatccagagtgcaaacatccagcatcgcagtgagaaacaagctcattatctaaaaattaaaaaagaagaatagtcagaaacaagggcagttacagataatagagattgtggtgtgtgatttactagtgatggtgccggttggttcaatcaatcatttactgctagtccactagggagtgaagaagtatggcaatcggggcagttaatagagagagagagagagagagagactaaaattcggaaaagtgaaagtgcaggcaagagaaaaacgaattaaacctgaggaggcgaggaggaggcggcggggtggacgtagcagagggcgaggcggtcggggaggtcggcggaggggatggcggcgtagaggttggcgaggtggagtaggcactgcatgcgtagcgtagatatatagagcttaattaattaatttgaagtttgcttgctcgatcagaagtagccgccatggccgccatagccgccaccaccaccaccaacacgaggtagaaggaggaggtgacgtcacgtcacctgcttgaggaggtggaggagcggaggggggatgttccgcatgtcgagcaggaagcagagcagcgccatggatctcgatctcgaactctcctcctcctctgcttctccttgtccggccagatcaaatcaacaaaaccaaatcgatccgtttgaatttcggagacgccgcgcgagccaagccaagccaagccactctttctttttcaatatgcgaccgactcaacctcactgacctatcctttctttttcttttctttttttttttgaatacaggacaggagggaggaggagtataaggacataaatcataatgctaatatacacatgcgtaaggccatattaccaataatggtagcaattggatatgttttttccaaattattaaaatgagattatttatcccacgttttggaaaatacgttttctaaccacacatttttctatcgcattattttaaggtactagtaacatactcgtatgttctaacgattatataattagaaatgtcttataaggacaacttttttaaaaggaaaaggaacttacatcgctttagctaataagtcctcgcacacaagatgcgagataaaattataacttccatccaaacacacggcaggagaatgacaacttcaggtaaaaaatattagagatctgttaagtttattttttaaaatatttattacctccgcctcaaaatactcgtcgctttgactttttatttgcaccgtttgaccattcgtcttatttaaaaaattagtctaaataaaaaagataaatcttacttaaattacttttgataataaatcaaatcacaaacaaaataaataataattccatattttttttaataagacgaacaatcaaacgttaaaaaaatataagtattttgacggaggtagtactcccttcgattccattttaattgacattttggacattgaccttatttttctattataatatgtacaataaataaatgcatgttttacttttattatagtgctttaaaagacaaatctatatatgttgttttagtttctttaaactaaatatttttaaagttattgatggtcaaagttataaaaatttgatctcaaccttgtccaaaacatcaattaagagtagtatttaattattcttataaggaaactgatctgttttcagggctggacgccggtgcgccctgaggagaggagagcacacctagaagaagtgacgacgctggcgaagtcagctcagctagctgctcccagtgccattatcatcatcatcatcagtggcttgctgcatgtcatatatagtaccaccataacacaaggggcgatcataaattagccatcactcaggaagcacaagccatgagcacttgttgcctcacttgtactagagtgtctactacagtagtatatagtatacaaaagaggaacttggaatttaaatagtagaaatacaggaggagcatcatctatctggcagtagaaatccccagaacaaat

SEQ ID NO: 50716 - DNA, 2289 bp, Oryza sativa
ttcctgcagcccatcaaaaatgagcgttgcaaattgcaaaacaaacactactagacttcaactttacatcttgcattaaaaaccaactgtttatcccaccaattcacaagacaaaccaaaacgcctcattctattatatgttcaactacaactgaatgatccaagtcaaaagctcaggggaattacctttgaatatgtccaggtgcactacattttgtggagacccatttgaaagcttttgctctgtagatttctttgggcctgtgatcacttttacattgaagagtgatttatccacctcagtagcaggagcattgttcccaaatggagatatactgaacccctcatcaagcgcatctggtatctccacgtaggtttgagttgtaacgatttcatctgcgctgaacccaaaagatgccctgtatgcttcaacctcctcaacatcttgtttgtcctttgagacactaatcctcccaccattattatatggaaatgactgctgagcctgatccaggtagaactgggcagatgcagctggccgaaagaagttattatctaacatgtagtttctagaggcggctgaatcaagcccaaaaatattggacggtgaattcctggaatatggtgtgtcacaggcagacctagaagtcttccaatgtgcggtgcagacctcttgctcagggatgggcgaagccctggaatatggtgtgtcgcaggcagacctagatgtcttccaatgtgcagtaggcacctcttgctcaggtataggtgatgaaagaccagtccttggagttgctgaagcaggtgatatgaggctgcttgaagggctttctgggtaaagcggataagatgcctggagccctgaacctccagaatatgctgtagataagtacggcatgttgtgatctttgccagcagttttcagatccatagatgacaaaagaaaccgcgcatatggaacatctggagaggagggagtagttgcatgagctagttcaggtggaggggtcagtggtgcagtggaaggctcggtcgtgtaagttgagaagacaggtggtgagacaagctgaggctcgttagcatatggcccaacagcaaacatattagatgttggcccacccggagagtttgcagatattgacaggaagcaattaggtgattgggcagtcgaaggaattgcagaattagagaaggacaccggagaagacggtggagcaagaagagataaattcagagccgcactttggttggaattggcaccagattggtgtgcatttccacgactagttgacgcattcccatcaggtacacgtgctgcaggaactatacgcttcccacccttctgtgatccgaaacatgacaagccagacaaacagccagcccatccactccgctgataaatgtagaaagttattagttgttgcaagaaatagggagggggggggggaaatcatccagcattccagcttgattttatgaagatacataaagttaactccaggaatgaataatgaactaatttacagttcaaaagcaacatactaatccgttcaaggctataataatttttatagggctatttagctcttccctgtcatttttatgatctgtgtagacaaacagcattattggctaattattaagcatggaaactacaattagagtgagctgaatataacaacaaataagcataaagagaagtgtgcggttaacaaaagtaagacaattaatgttgtcgtcatatcatgtaattgacaggaatgtcgatggtcttgaaatgacataaaacatccttgcatgctacaacgagtttaagatggcccaattgcaagttgcaaccagcacggagacagtacgaacagttggtactgagtgagtaggaaaaggttgtaaggtcgacaggaggtagcaattgcaggtaacaagtagtacgaaaaaaagcaacagaaaagaaaagatgaagcaattgcatgagcagcaagaagatatagtaataccctatcctgctgtggtgggtgggagtggaatctggcctccgtcgcagcagcagcagcaacattcgctggcctgctgctccctggtgtagccgccatttgtgataagagaaggcgcggcgcggcgcggtcacattctccggaaacacaccgacgaccaagcttgggtttgtcctacggatccgagctgagctcctagtagaggtagaggaggagaaattagaagcagcaatcatagaagcagtaatggacggaggaggagatctcgacaaactggttactagttgtattaagg

SEQ ID NO: 50717 - DNA, 846 bp, Oryza sativa
agttgtatggtagggaggaggaggtacctgctgtgaaccgccgcggtcgccggggatgcggttgaggagggaccagtcgacgcgcgcgacgtggtcgatgagcgccgacagctgcaggcccagcaccatgggaggggcgtcgccgtcggtcctcccaacaggggtagggggagcgggagcgggagcgggggagggagacatgcggtgctctgcctccgcgcccatgattttccgttccggcgacggcgagaggcgggcgagggtgggggtgcggcggctaggggccggggagggagaaggagaacgcaccgctcctccaggtccaggctccagctctcaaggaaccaatgcccccattttatagcatcttccttcctcaccactgctccttccttccttgcatcaatcttgatgcaccacccatccctcccaactcccaacgagaaaattgacatttaaccattgtcaaaacggggtttcgctggaatgccactcccaaaagtggtttcgttaaaatgccaccctcaaacaggggcaacttgttgcaatgccattccatccatttcttctcagtttaatgttttttgtaatgtttttcttgttgagatgaccaaaatacccttatcctatctcatctctcctctctgtcttcctcctctccgttcggctcggcggcgcagctagagacggagacggcggcagcgcggccggagacggggaaggcggcggcgcgcttggggatggggaaggcggcggtgcggacggggacggtggcgacgcggatggggacgggaaggcggcgacatggctggggatggggacggcggcgactgggacggggacggc

SEQ ID NO: 50718 - DNA, 21499 bp, Oryza sativa
tgcctcgccggcgtcccctatgcctccctcccgcaactccccaccacttcaccacgcttgtcgcctccgtcgcgcgcacggcgagctccgctcctctctcctcgccctctccgtcacgcccacggcgagccgatggatgttggcgtggtggtggtgacgaggacgaggagccggcggccaccgactcgcagctacgccccgtcgccgccgctacgctccaccgccggcgactggatggggatcgatcccctttcttctttcccctgcaaagtcaacaaaatgactaggggcaaatatgccagagaatgatggaaaacatttggaaatcagttaaaatggttgaaatggcattatagtaagttggcttcatttgacaatggcattataacgaagccatattcgggagtggcattccagagaaaccccatcctgaagatggctaaatgtcaattttctcactcccaaccccaccccacccctactcctctctttttcccaaacacaatcatacactactaatacacacatctataaacgtatgctaggtgaaacccgcttattgctacgggagttttgtttgacaataaatataaataacacttaataaaacttgtaaaaatacacatcaaacacaatgttgctctcaactcctataatatgggatttatgtataattttttggggaaactcctaaaatatttggctcaagatttctcttcacttattctccctattttactcaatttgcagtcatacaacttgcttatgcactttatacatgagataatcatggctgagatcagtattgtcgaagggtgaactcctcgagcgggggaccgtgaggcccctccttcgttagttcgggcgggggcagcgagtgtagatcgaggaactgagaagattggaagggatcgagggggttgggccctcaatgaagaggatgagaccaaagggatttatacaggttcggaccgctaagaaacgtaataccctactctgtgtatgatgatttttctgagttttgaaagtctctgaatctctggtgtacaagctaggacaaagcgttctcactctagctccctctcccccctccctggactcgaacctccttttatacttcaaggggttctcacatgcaccaggtgtgccgctcggtgaaaagggggggtaacaattccctatattaaatgtgtgtcttgcgctacagcttggaagccacctaggcatcggctgtcgtgcggggcccatcaaatcatgccggctgacgcaggccgacacggggaggatccccgtcattcaccatttaatagatgtggatttggggtgtggaagtgccaggaacgctatcccgggtatgttaagggcggtcaagccagccctgaacggttgagaggcactgtacctctcatcatcttgacgagacaaggcatacccaccgcatgccgcctgacacccgggcagagtgcgcgtggcttgccgttgtctcgtctgtcacttcaaccgatcacgcaccggtcacgattaggtcatgcgagcggcacgtcgcattaaatgcggcgtggcacacccgctctgccctcactaaatgcggttaggtgagtgtcaagtggcgtccacctagccacccccgcatgacggccacatggtgactgtcccaaggggtcggggtggcccaacccctcaggctagagaggggcggctacggcccgacccctcggggaaaagccacgtggatgtcgagagcgacctttcccctttaagcatggtacccccggggccatatcatcgacaagtatttaaccccgcatcatatgttaaacctatctactgggaggagggagcagagggttggattctaatcccttgaggaaatgtctccttagtacatatggtatttatagagttgtatgtttaattgcacgaatggtgtcgtattcttttttaacttttcattgctatttagatagtatttgagcaaacgaggaaacttccctcaactcaaggaattaaaaagtttaccattccattggtcaatcatgctggacatttggtcctttttatctagaaaaaggtccgaggtatgtttttttttttacaattcttatttgaatgagtttattaaatagaacaacctcgctagtggagcgaggttgcatccaatgttcccctttcattcaaatggtcaaggctgctcttctctctctctcacgaatggagcattgtttggcgtctgaatgatggcacgatgcatgcctaaaaattgctagttcgatagtcatgtgttttgtttactgaattcagcggcagtggtggattgaaattattgctgtttttctttagattagtggcagataatgagtctgacgaaagaaagaaagggctttttgtctgcagccgaactgaggacatttttgctaggaaagtgcaaagaaagcaggcggcggaaatggcaagaaaagccggatctttatataaaagatactaggcactagtgaactttgtgcatgatgatgattatctgctgaaaattcagtgcaagtagcaacattgtccattctacagtgagtgacagtgaaactgcagagcagaagaggacatgtgatctgttggttggccattggccatatggcctgcatcaggcatactttgaccatccgcaactatagattagaggaccatctgcaactagtatgggatgtgaatttctgggtaccttcggtttaagttactagtagttcgattataggtgaccagccacatcggtagttgcttccttgagctgttcttttactgatgttggctaggatatactccggccgagtttagttgcaaactttttatttaaactttcaacttttccatcgcatcgtttcaatttcaatcaaactttcaattttagtatgaactagacacaccctccgtatgacaattacatggatggaaagaacctccatagagtaaggtttgcatggccttacttagggatggtcgtacatataaatgtgttgcattgacaagcaaaatcaatactgataatgtttctgtacagtgtcaatgcccaaagaaagaaagaaagaaagcatgaagagatagtaacgagtgcagagaaagacagaggaggaggaacagtgagaaagaggaagaaagaatctaaggaggatccaagcgggccaatccaacaacacatccagttccaatcggtgtgcgacaccaccacatacgtacgaaaccatacatgatcggacaaccacatggctgattcagtttgcagataattgacaacctaccggcctagcctagcctttttatttatttattttttaatttatccggcctctatatccaaccggatatataccgccattataatttaggaacttagcctatcaaatagggaacttagtcctaacctatcaaatagggaacttaaccctcaagtaacccaatctgaaattcgctcctatagagatttgaattcaggaccttggggagctactcatgtcactgcaaccactaggcctagcctagcctagcctagctaactactcccttcgtactcataaatgaagtcgtttttgacagcgacacggtctccaaaacacaattttgacttattatttctataaaaatatttattaaaaagtgatatatttatacttttatgaaagtatttttcaagacaaatctattcatataatttttatattttcaaactcaacaacttgagagttattcatgatttatattcccaaggtttgacttaaatattatcttaaacgatttcgtttatgagtattaagggagtactatgtaattatgtctaggtccatttctatacggaacgtctcatttaatactataatggtttttggtggtacggatggagtagctacatgaaacaagcatataagcgtgtgtgtgtgtaattgtcaaaaagtgtatatataaatgtgtactctgtataaattgagtgagctctcatatccagatatagctagtagtacattttaatcctctagagaggtagagagaaataacagagacaaccttttgcgtgttgttaaaaattaaaatatatgacagatgcatcaaagacagatgttggtatatgctcgattatattgattctgacatgcaagcattgtaatgtagtactccctccgttccacaatataagggattttcagtttttgctgataacgtttgaccactcgtcttattcaattttttttgcaaatataaaaaacgaaaagttgtgcttaaagtaccgtagataataaagcaagtcacaaataaaataattaataattttaaaaaattttgaataagacgagtagtcaaacgtagcaagcaaaaactcaaaatcccttatattatgggacggagggagtactccattcgtaatctagatgagaatttaatatcatgtagaataataaatctgaacaacgtcatgtcaaaatttgttatcttagaattcaaaactagaagacacaagagaaaaacactgccattacagaaaaaaacaaaagaagaaagggagtgagagagtacaggtattaacacgtgtgcagtagagtatagtgtattaatggatggattcagatttttacctaaaaataattggatggattcggacgcagcctgcagaaacaacaaagagccaagacaagcaagagggctcaggggagtggcagcgcatcgctcagcatccaatcatggagaccgcccgccgcccgcctgcctgcaatctgctgctacgtgtcctgtgctgtatgtcgactgctccctccgtcctaaatgataattttataatcttttgaataaaataaataatcaaatattataacaaaatctcaaaagtcaaaacgatgatggagatagtatcattatctatttcatatttcatactgtaatactaacacttctaaccctatactactctaaaaaaacaaatctaaaatagtagtagataagttttctttttatggaagaagcgctccactgctacttcatttaaacaatgtagtgctccttttagcatcaataaatttgtaaacacgtattctaaatcaacctttcaaaaaagggcgggttttgctaattttttttataaattttctccccaaaatgtatcgaatataaatacgatacagtaatagtaatagtataattatattgtaacttatatataattacgatataacatataattacgatataacttgtacgtaacatttatataatattcaatcgttagatatacttcaatattcatgcaagcgggaagaaaaaggtcacagtgcatgcatgcacaggtgagtagatttggttccccaacctccgcttcacaaaaatagcgtgttacgtcaggatttttgaaagctacatacaaggtataggtataggtatagtgtaattatactacaattttattatatttacatttgatttttttttaaagaaatttatcgacaaacgtattgatagtaaaaaaaaaagagaagtattatgaatctcactattagggtgagttccatgtatactaccctagctctatctcttctgtagcaccgtttcaactctaccaaaagatgagtgttctcaagaaaatgaattatagacgcgaagctgggtgtagacaactccatttctgatccaacccttaacagttagagaaaagggatatgtgtaactgcaacggcccatgcatgataaatatgaggcagcccaaaccaacctctctctctataatgtatagaagcccaaaagaagagcgaggcccaataataagtccagcagtagtaggcttcgctagtagtgttgtccaaagacacaagtagtaggaggagattagagagagagggaagggaacaccgacccgcatcgcatctgatcggcatcggcatcgtcctcgtcctcggcatcagcagcagcaagggaagggaaggattcgccgcccgcgaggtcgtcgcctccccttccggcttccgtccaggattttccatggacggcgcggccgactccggcacggcgggcgccgcggcggcggcggccaagtggcggaccgatgcctcgcgggcgttccagtactacctggaccgctccaccccgcacgccacggggcgctggatcggcaccctcgccgtcgccgccatctacgccctccgcgtctacctcgtccagggcttctacatcgtcactacggcctcgggatctacctcctcaacctcctcatcggcttcctctcccccatggtcgaccccgaggcccacgccgctgcctcctccgacggccccgccctccccacccgcggctccgacgagttcaagcccttcatcaggcgcctccccgagttcaagttctggttcgttacccccatccccagatccagattcagatcactcctgaccttttttttttcgtctccttctaattcgcaaatctacctcttcattctattattactattgttattatgttttattcatcgcggttgacataggccaaaccaaaccatgtggcctcaaatttcacatgcttccactattcttctttatattattattattattattacatcatcaatcaatgcttgggtctgctactactacccctatcatcaaccccatttaattccatctcatgctgccatgatgtgttagctatactgtccatgtcacctctaatccaactaccctcagccctcctcaccctttgatcctgtctgctcaattcgtcctccctatcttatggagtatcttgttatattattgtgtgtgctatgtgccataacacttatctgtgcacaaacttcaattgtagtgccacactaccggaccgcgtgaattgtaattggtgtcctatggtaatacacatctttaagtttgttagtgcagcaaatgtgcgcacactgaaaatattgatgctatatagaagaaggaaattgtggtcatatatatcatcctttgcttacctcctaatgcattctatgcctttagtcagtggcatgttaaccagctaaggataagtcctaacagtacctaacagatttatatgaatttgtattccactggacatgtgcccactgccaaccatacaaattggtcttggggtcccgtaatgacctcctcaacaaagtcttgggatctcttctcaatttgcccatatctctccctttggaatttaataaatggtactggttaatgacacaataatatttatacatgcctgtatgcaattatataacctatggttcagacatgtgctatgtttcatcatgagtgaatttagatgcagaactgcgtactgcatactctcgtgaaaataaatgtttcagcctgacatgtccatggcattcattgatctgtcttaaattcagtgcagcatacaactcatgtttaactatagccttagcattccatactgtgactttgtatgcaggaaagcatacctcttatctttgcatgcagtcgctaatacgtatttcactattttctgagctaattcctttgtttcatcaaatctgaacattggttttgtgttttcaacctcagtatccacaccatattattaacattcatttgcttggctttcaggtatgcaatcacaaaagcttttcttatagcttttgtgatgactttcttctctgtatttgatgttcctgtcttctggccgatacttctctgctactgggttgttctttttgtcctcacgatgaagcgccagattgtgcacatgataaaatacaaatatgttcccttcagcgttgggaagcaggttagtttactgctcaatacatggtttatgttatctgatgagtgttggtacttggtaccatgagaattacatgttttaccacatactgaaacttgaaagaagtgccattatatatccatgcttggggccattattaaataccatcaattgtgcctttttatttgtgatcttgaacaaatgcttttacagtatgcgtcatcatgtactggtgtaaaataaatacctgtggtttcagcaattgttttgttcctcaccatttatcccaaattgttctgctagaaatatggcgggaagaagagcgcaggcagcagttcttcgaaagactgattggcagcctacccactctggtaggaaaaatggaaggggcaagaagatacagtcgatgatatttgatgtgctacataccaattgtaatatttcattcatatctagagctagaaggatattcacttgtatttcagactctggttcacggtttaaattgatattgtggtagaatgctttcttggatgggtatatagtgtgactcgttaaaaatatgacaaaacggttcagctactctttacaagtggtacggcaaattgtagacccaattgcacttggcggtgagctgctttgttggagcaacagggcactgtctgcttgcgtggatgaaaagctgagtcatctgaagctagtgaacattttttcgctggctcgctgcgtgtgttttttctctgattgtggcccggttgattatgaaaatgaccagtaagtaaagtcatccgaccctgctgatttgtttgttttgcctaacctagctcatgctcggggtcgtgaatcgtgctacacttgttgcagctttcgttttcttgaagagttggaaggtgtcagcttagcttcctgtgcgtactagtattgcagaagaaaacgtaaaactgtaccagagcaagaagactttgacataaatttgtaacaaggcagataggtggtacaaatcaaggcactcagctgaacagctcaactgaaatgcagaactgaattgaagagtaaaaatgatccatgcatgacagacaaaccagtggacactgactgaagatggagcaatgaacaaaataaaatcaagacttgtttttattggcgcatgcatatttagggtgatatgatgcatgacgaaatgaattagaggagggtgttgagatattcgtcaacggttgtatattggatttccgggtagagctgagtggcctccacgtcctgcggatcatccagcggcgagctcatctcccctctacagtaggccgcgtgcgcgatcgacaccaaaacgttcttcgggtactctaactctgcaattgcaattaattagcaatatatatataattgcgtatggtttattgcagtggagtactccatacatgttacgtacctttgattttggtgagcacggcgtcctcgggcacgtacactctctccagcttcttccccgtcttcttctcccacatgctcaccagctcgtcgtgcgacatggtgttcgccggcggccgtatgtgcagcgtcttgttctccgcccggggatccaccgccgccagcaccgtgtacgtgccgatgtccccctcctccacgaacaccaccttggtgtgcccctccccgaggatcaccacgctatccacgggtgccgcctttggcatgaactgcccgatcgacggcagcgcgaatccggcgaagtagttgcacgccacgtacgtgtgcgggatgcccgccgcctccacggcgcgccggatgcccaccttgctgccgtacatggacctgaccggctccaccgccgcgctggcgccgcgccccgggtccatgccgaactcggaggggatgaacctccggacgcggccgccgccggcctccttgatggcgtcgatgagcctggtctggtcggggacctgggtcgcgcgcaccgcggagatgacgacgtcggcgtcgcggacggcgcgcagcaggctggcgtggtcgtggaggtcgccgtggaggagggtgacgccggcgtcgcggaaggtgtggagcagctgcgccttggcggggtcggagggggcgaggtccctgacgagggcggtggtgggatgacccagccgcgcgctcgcggcaacgacatgccggccgatgtaccccgtgccgccgaccaccaggatcctgctcttcgtcgtcgtctggtcgccaccggatgccattgatgaattcgatcgatcggtagcaagacaactagagctaatgcaaatatgcaatcgagcgtgtgtgagagaccattgcgcgcgttgatggccttttaatttggttagtaacgtaacgctatcaccaccaattaagcctcgcctccctcgtttcagttcgcacgtcactagctagctatatagtatcatgcacactactgtttcagtgcttcctagctactcttggtgattctctttcacgtacaataaatcattaattgctgtaactttgtacgggattcgatttacctggagacgactaattgcctcctgtatgttcttgtagacaagaattaaagaaccagctgccaccaattttccgcttggtgctttcccccaaatctaccttggactgcctcttactacggggaagttaaagctggtccatttgcagctggtaatggacaaaatcagagtaaggatggggggctggaaaaacaagctagtttatcaaagcaggtggaaggttcttgtgcaatcagttctcagtgccattccaacctacttgctgaccgttcttaaaccaccaaaaggattcctagatgatgttgacaaagcgcgacgaaaatttctttgggccggagactaagaaagcttgggcaggaaatgtaaagtgaattggcagcaagtatgttctctgacaatacatggtggattgggcataccttgtttggagaagttctcacgatcgctgaggctacgttggctctggtatgagtggacaagcccgaaaaaaccatggataggaaccccgccgccctgtgatgacactgatcgtgctctgtttgctgctgccaccaaagtatcggtcggagatggacgaaaggcgaaattttgggaatccaactggataggagaccagccgctgaaatacttagccccaaacctcttcaagcactccaaaaggaaaaacaggtcggttcttgaggcaataaccaatgatgcttggatcgaagacatccgcggaggggtgacaatacaactccttcaggaatatatatgcgtatgggaagtgctccacaacgcaggagaggtgatccatgaaggggctaaggacacaatcctctagcgatggtcggccagtggctagcaagatcatagatgagcttcatttgtgggaaatggtaggtgccaagggagtgaagtgtattatggagattaggcttttgtttttttagggagtgtaggcaggaagaattcctccgagaacgtctcccctgccttctgttctgtacagtttctctcacttcttctataatataaaaccagcttgctgggttctttcaaaaaaccaattttccgcttaccagataccacccaaggatcatacatcttcatcactagctgcttccgtagaagtgaaccattccactgcatctcattctcagctaagacaccgcatttctagaaatttgatgccccgtaccaaatataaaatgaagccctattttttttaaaaaaaaagaaaaaaatataaccaaagcataatacttcttaattatacaacatccaatacatcattgtacatgctatttctcacaagaaaaaatttgattacatggatgacacatatgaacacgcaacccactcatgagcgcacacctaacagacagagaccaactaacctcatgcattctttcgtaatttcacttcaagttgatgtacattaggccagagcttctttactgaaagtataaaacaatctgagcctacattaatacttcctaaatcgacgatgaggaggcaattttgttttcttagtctttgtatatcgctcgattagtcgtagtcttgactctcgactcttgccacttccttccatcgaccatcgtcacatagcagtgacctactttttggtggaggtttgcacggtcgccgccccgatctaatggttttcttgcaaaccactgaagtatctttagtttactgcataattttcagttttttttggaagtcccgatctaatgtttctttaattttgtgcatcattttcgctgattaggaaggactgatataacaattgccatcgttttacctacagcttattataaatgatcacgcttatcaaccaaaaacataaattcataggtacaacatttatgcaagtattctgaacgacttaaaagtcaatactgaaaaataaactacaataaatggtatcaaaataaactctaaaattagattttaaattttggtacgtaccatagcaatagggtttagcataagcaggtctggtagatataacgcatgatttagtattggttgagacatggtaaataggtagtacaatgttaggttttgatctctggctaacaggccagagaaaacgtagtgggttcggtctaccccgagccacacgcgttcctatgatggcaccaagataataagactcgcgcgcacgtcccctctgaattacacggcgatcggattgtgcaactaatcccattgactcgcattggctcccgtagcgctataagagggagaaaactccctctacatggttcttttcctcaaaacccttaaaagtcaacaaattataatcgtgagttttaaagagagaccgaaggttgaactctacaccaattatcccattcactggcatgtcaaggttgctggtgacaaccatcactaacatttgctgcctcactgttaacgttaaaatttggtaagctccgaaatcgtcatcggcctcagagttctagaaatggcttacggaaattgttagttgccagtcgtcgacatcgactagtatcgctacgatggcatattagctggtcggatctttgaccattaaattatctatcttgcagtatcaaactgactggcacgtccgcacttcattaaaatttaggacctgcacttaaacagatatcctagaccttcgtgtttcaggacgaaatttcacgtcaacactcactgacccaggggcacacacccaggggcacacgtagatcgacgcctacatgtgtacaacaaacaaagcggcgtggtagatcaacgcttacatgtacaacaaacaacgtgattgaccagcggcacatggcttcttcactatctcaattcgtcgtaaaattatttaggtgatcatgtataaccaagatcataccatactaataaaaaaacacggatattagggaatgacttaatatcaaataattagaatgggtgaggctttgaacttagatcatctagcccaccaccttgtgaagctacccggaagatccctggttgtttctccatatcatactaataatgtttaagcaaataaattcattaacatgcaaatcaagccctgaagaagagctgaactgagcacagtgatccatgacagattaaaccaagacactcactctcaccgacggtgtgaaatttgcaggaacatgtacattactaaggaagagacttaattattttattggcacataaaagatgatggatgtatcgatgtatttcagaggagcctgttgaggtagtcatcgacggtggtgtactggacgtccgggaagagctgggtggcctcaacggcggtggctggatccaacggcgtcgtcgtctccccccttatgtaccctgcgtgcgcgatcgacagcacgatgttcaacgggatctccgactctgcaaccaaaccatgcaattagccatggacggataaaaaactaacttaatattggatacgattcgttgtattagaatttaggatggagagagtacatatggaacatagtacgttaccctggatttgcttgagcacggcgtcctcgggcacgtacaccctctccagcttcttccccgtcttcttctcccacagcgccaccagctcctcgtgcgacaccgcgttcttcgccggccgtatgttcaccgtcttgttctccgcccgcggatccaccgccgccagcaccgtgtacgtcccgatgtccccctcctccacgaacaccaccttggtggctccgtccccgaggatcaccacgctatccaccggccgcgccggcggcaggttctgcccgatcgtcggcagcgcgtagccggcgaagtagttggacaccacgtacgtgtacggcactcccgccgcctccacggcgcgccgcacggcggccttcccggtgaagatggacctggccggctccaccgcgcccgtgtggtccgggtccagcccgaactccgacggcaggaacctccgcacgttgccaccgccgccctccttgatggcggcgatgagcttggtctggtcggcgatctgcagcgcgcccagcgtggagatgacgacgtcggcgtcgcggacggcgctgagcaggctggcgtggtcgtagaggtcgccgtggaggagggtgacgccggcgtcgcggaagctctggagaagctgcgacttggcggggtcggagggggagaggtccctgacgagggcggtggtgggatgacccagccgcgcgctggccaagacgacgtgccggccgatgtaccccgtgccgcccaccaccaggatcctgctcttcttctcctcgccaccggacgccattgttctagcgatctacctagtacaagtagagtgttagtgtgtcacagcttgcatcgccttcatcgattccggccccttttatacttttttccaagacggggaaattaagtatttcttattcaaatttctcttcatttttgtcccaatcagaatgttgtttctagaacgtctgggccaaccaccacgcccgtgtactagtaattcgtaccgttaatttatttattaatcgacgtcctcccaatcatgatcttgacggcattacacttggttcagtgcacctggacgcgattgtatgcctcctgcggtgcgagcacttggttcagtgcacctggacgcgagcggacaacgaacttcgcctaggtttccagcccagttttggatccaccaaccaaatagtatccaccagtcaggattcagagcaccattttccgctcacacatcttcatcactggcctggattccaactttacccaatgaactctttcatcatttcatttttaaggtgacataaatttattttaactgattaggtaccgtcttttctaagctgtttccggtatggtggaccaaccaaattagggtgcatgacgcacccatcagcgagcggccattatattcagcttaccaacaccgaaatatcacaaatctccatcactgcactctacaggtggactgtcacaccgcacctaagagccttgctatttcattctttgttttaaaatgtagcaaactttctcaaaaacctctatgtatagatgatggctatgccattacaccgcccatatctaccaacagattggccaaatttggcaaccaagtgttgacgaccattaaatttggtcctaattagaaagatgatcaaagcattcacgcaaaggccagtcatatgtaccgatgtttactgagctatgctgaccgatccaaacagaggtacgcctgtctaaccgatggtctaactggcaagcctcgaatcgaagtttaacttgattattgtttcgcctttgcttgcatgagaccaatatttctcgacttctaattgatctctgagtcagtgagtgtgtgtgccaataaaaaaaaatccacaagatagtcccttggcattcattcagacaaggtagataggcagtacagatcaaggtctgaacagctgaacggaactgaaccgagcacaaggatccatgacatattacctgcagacgactcaatgaagatggaagaacacattaataaagatttgagattttattagcacacacacatagtaactcgtttcaatagaaagcacactactgctatctctagaatgttgtttctataacatcaggtgaaacaaccagtactagtggtaatttgtattcgatactgctacttcgtcagtgaaaaaaatatgtgccccaatttcgtatgacacattggatcaagcttgggcaatagtcagctaacagatagtgaatttcctaattagcgcaacatacctatcttacataaccatgcaaccaagcaacccatgtagttttctcagttgcagataagccacaaaagaagggggctggggctctctcccagattcagataaagaggaggaagaagagggtctccagtctttattttataagatgacatagatagagccaccttcgatccattcaatcgataaatcctttggaatgaaggagggggttgtgcagttttaccttttgaagggctgatctactccatttcatcctatctttatatgggtgcatgaatcaagcaacttggcagctgtcgtggttgtacctgatggtggtcagggtaggaccgagcttaggtatggacacaggagtataggatctttgtgcctaaccattttcatatctgatcatctgttcagcaaaatacaagtcagtaacaccaaaagaattaattcataagtgactttctcctcgacttccgtggctgcaaattgtaacatctgaaaacaacagcctggcgtaaaacagacctagtctgtagtaagtgactttctcctcgacttccgtggctgcaaattgtaacatctgaaaacaaaagcctggcgtaaaacagacctagtccgtagtaagagccatgtatttgaaggactccctgctgcaatttctgtccattgatattccacgatttatgtccattgttattgttattccctcttaaaccaatcacagtgtacctgtgctgaataagaaaatcatcaaaagtgtcatttttactcaatcaagcaattcatacaaataccaccacaatagactccacaaaagaggtgaatgagagccaagagaaagccaaaaatcttctagtatggcatagtgatatggaatggcaagatgaagttattgcatatagtatcaaattatcatgaatgaatacatgcagattttactaaagccaaaagtacattagcagaaaacagaagccatgacatacattgtttctaacagaataagcaagctctattgcgagggatagacagagattaaaggttcattaagtcactagtgtaaatggcatataaataaatacatggacaatgagcacatattagttaatcctagaggagaagaacacatgagctgcacccatgatcatcaacacgtatagactgcaattgttcagagttagctcatgctccaaactagaatctacagaaattctcaacacctgtgatacatggtacacaatttctcatactacaagagggcagatagacatggttgactcgagatcaagtttatgttttacaagatacaggcaagtaagtacaagacgataaagctgaaataaccacatcaattcatacgtgcaagttttaagcattacatctcttaacaatacattgcagaagtgttgttgtttcaaatggattcagtcgttagaaatgaaaggccaaccaaacattatagaattgaatggtattgaatattctaaaattgaatgcactgttttgtaagaaattctctgaagcactgatataaacagcaaattagcaaccgacggcaccagagtaacagggagtcaagggacaacaacaatgtaaatttcactgttacaaaagcagggcatatggattgatattacaagataaaaccatgaagtccacaacccaaccccagtgacaaaatgaagatagaatacagcagctagaacaacctcaccacaccaccttcaaaaattctggaacagcttcaatcagaatgggctgcactaaacctaaaatcaggaccgattccgcggcttcttccttgtatgctctacttgctctttgtcgttgtcggtatcatcagctctctccctcttcttttttctctttttctcagtggctacagaatcaccagcactaactattatccctttcacaactgtcttcacctcttcctcttccggatgattctttttgttccttttcttctccgggctggcaaatctttgctcgggagcaccaccgttttgtttcacatcccttgcattctcttgctgactctcatgcttcttcttcttcctgttcttcttgctcgtctccttgtccgtttcttcttccgcgacgagatcagcagcgaaggccacttgttgtgcctcctgctcctgcttcacatgagtggctgcttggtgatggtcctctgaacgcttcctcttcttcttgtcggaggcggaggcagtatccccacggtggtagtagttgagtaggtcgaggcggaagcggtggtggtttttggtggcgtcggcggcggtgtggaggtaggtggcggcgtcggaggaggggaggttggaggcggcggagtcggcgaagaggtcgaggatgcgggcggccttggcgagcgagcagggcttggaggagaggacggcgccggtgatcgccctcatcgcctcgccaccggccaaccaccgtctctctctctctctctcttgtttgggtttgggttggaggcgagggggattgctctgctctcgattattagggttttaggagcaggggggcgccttctgatgggcctagtgggccacggcccatcatcattctctccgcacggtaaggcccatctcgtgtgaaggaagcaggccgggagattgggtgggaaatacaggttgcaggattcatcggattcaggggatgaatctgattaaagtttcagttcttcgcagttatactacaagtgattccaaacttaccttgtaagttacgttgtcgcaattgcctaagcttgtcatttcacatttggatcatctcaggtttggggactaaaatacatgtatatacaccgcaaatttaattcgattatcattatgatgaggcgaaggcaatcagatcagtacaaagcacatacatacattagtatgtctgcagaatcacttgttagctgcaccggcgggcttgttgcctttggcagcggcggatggcttgttgggtttggcggcgctggtaccagcctccttcttctcctggctgctatcgggcttcttctccttgttgctggtatcggcgacgacattatgctgctgcttctccttgctcttggtcttggacttggacttggagtttgaggagagcttgagcttgaggtgcaccccgaggtcgccgccgctgcaggagctgtggagaagcagcgagttgttgatggactgcacgttgctgttgatcatcgccttcacgccccccttgccatccgcactgcttctcttgtcgtcgccggcgcccttgctgcctggggcgggggaggatatcttcatggatgcgcccttgttgtcgccggccagcgtgatgatgcttgtcccttgctggccgtgggaggcggcgctgagcatgccggcgagccccgccttgaggtccttgcgcaggtcgcccttcttctcctcctgatctttcaccttgtgctgctgatgctgatgatgatgcgtgggtggtggttgtttgtgatgcagtacggtgtcggtggggatgacgacgacgtccttgggcttgggaggaggctcgtgacgaccatctctgcttgctggtggcggcggctgctgatgcaagcggcggttggttggcccgagcggtggtgcggcgcgggcagctgggatggttgggtggggatggcgcgatgagggaggtgacggcggcctgtacctggagctggagggcggtggcggtggcggcggcggaggcggtggagggctggtccagtacgggaaccagtagcgctggggaggctgctcttgctcctcctcatccatggcgttcatcgatgatctagcctaccactagcagtagctgacggacggaatatggattgcttgaaatggcgggaataacccacagaaatctatatatacaagacggaaagaagagaggaggatcctattcgtatctttcgattgctttcagcttgcggaaaatgaagcgaaacgaaacgattctctgccgcatttgcaatccaagtacagtgcaggagcaggagcaggaaaatgggtgggttgtttaggcatctgattcttcttcctcattgccgtggcgtacgtgcaccatggcttgccaatcaaaacatgatacgtacacccacacttccatactggaatatgatctttcatctatttttttcagagctctactgtatatagtctatatatacactactgcagtgatagtattttctatactattgtaacgggcggagttgccatccttccatctcctcccattgcgcgtccactccacttgcataaccaccggtatataaattcaaaatttagtgacaatgtttaacatagcttatggtgtcatcgacagctgtataaaaaaagttaagaataaatttcacaaaactatatatattttgttcaaactatcataaaactatatatttaataatgtgtatcataatatatagatttaacataattttttttacaaaagcatagatttaaagtatcatatcagaaaactacagatataatattggttttattacaaaactacaatgtttctgacctcaatatattatggatataaactctataatgtatagttctttcataacttcatcgtaaaatctgtagttttgtgttatgatactttaaatatgtagttttataataaatttggcattaaatctatcattttttggatacacatttttgaatatatagttttgtgatagtttagttaaagtatactgtacgtagctttttttttgaaaattactcaacagttaatttaaaatacaaacgtatgcaaataggaaacgtaagatgtaatcaaagagtaaaacaagtcttcttatctgtggtgttgtaaaataaagtaatataaaacatacatgccactgctcattatataatgagtgatgttaattgtattatataattttgtattgttgtaacccctctatcccaaaatactggttatatattatcgttatatttttaataacttatgtgccgctgagaaaaaaaatggttatattgattatcgttaatcatacatagaagtttagtaataggtgttatctctttctttagtttgttattctaagtagttttattgcttttataatcaagctatgaatttgtaatcgtgaccgttcgatttgcaatatcggtagtaattggatgtaatttatttaagcaaaaacaacaataaattctattataaaagggtcattgtatgtttagtaaaaaaattggaagttgtacaagaaaagagaatagagaggatagaggcaattgtatatatccctactatagaggtagtagcggtattttatactgatcgaggggtagggctcacgagtcggtcaaatacctatggtgcagaaaagcgatcagcctcgatctcagtctcggttagagatggcagcggggaattcactgtcggggtcacacatctacgtccttgtccacgcggtgttaaaatttcaccatctccacccctgccatccacgatagggctacatttcatccatcaccgtcctctgcg

SEQ ID NO: 50719 - DNA, 2136 bp, Oryza sativa
tgaatttggatgttgcctgattggttgattcgccccatggactcgcccgcaggagggggtgaagctgctgggcacctggctgcaaggcgaccgcgccttctccttttgccgcctcctcgcccgcaacaccgccaacctcaagcccgcccatctccccgcctgtctgtctgtctctcccatctactactgctactcctatgtacaatacagtagtatctcatgattctttcgtgtttgttttgcagccgccacatggcccttcctcatcatggcgctcaccaaatgcgtcatcgccgacatctccggcaagaagcgctctcccaagagcgccgctgccaggatgctccgcctcgccgtccagtgcgctcaagacttccgcctctcaggttggttacctttctttccaaacaacattttcctgctctctgccctccttttcatccactttgtatttctatgtatgtcacggtcacggaggttgctctctaactttggtacaaatgacaacctgccctgcgctgctgattttaatcaatcttttgtttatacatctatcttcacaactagttttgatgattctgcattctcactagttttctcacgcaatgcgctgccaccattttatacactgcttgagttcacatcgtttcatgcatggatccccacaaacttgggcagcctgctgcctactccctccgtttcatattataagtttcctagtcaaatttgaccaactttatagaaaaatatattaatattttcaacacaaaacaaacatattatcaaaatatattcaatgttagattttatgaaactagtttggtattttagatgttgctaaatttttctataagctttgtcaaacttgattaggaaaaaactcaaacgacttataatatgaaacggagagagtactcaataatgatgcacaaacacacaacataatcttctatcgtgctcaccagatacacattttgcagctacttgcacattccatgacttatgctatgtgtacaattaccccgactcatcttgcctacctattcctaacccaatttaacgtttattttatccgcatccgttcctttttgtcaaatgtctactccaacatgacagcattaatgttcactcgtaaatttctgcgtggaacttccaataaagaatactgctgagggctgaaaggaggtgctcaggcattctctttcatgcatgcctgctagtaatgctcatacctttggtgttgggatgctcctgattttcatgtactcttgtttatttatgcatcttctcacttgccacttgccagacacccagcagtatgcttcgcgtttaaccagatatgcaaacatccttttcaattgctttgaagtggaatattttacattctgtatgacgataaacaagaggttcattgtctctgcagggcggtcgttacttttgatttccgtcgctaagaaacttttcagtcatatatgggaggttgtaaaagatgctcccagctttctgatagagtacagcataattcttaggcagctttaactgttaaggagtaccggtatcagatgaaacctcgaacatatagcagtgagttcccttgccagatctcctatcttttcatcccattgacacttttgttcctttattattcttatattttttcaggttttgttgtgctctacatgaagaaagttgcgactggttttgatgaaaaaatcagtaatcaggccagctccaaggaggaatccttccgttgtacactgacccttcacgttctacttgaaaacccaccgggtgattaccctgatatcatgagggaggaggtcctttgtgggttttgtgcaatatgctcaaatattaggcatgtattgtttgctcatgtccttttgacgctcctcttgaacccacttcctcctaagaagaatggtttgcatttttatattttttgtctcccgctgcttttctgagttgcaactgaaataaacttaatttgtggaatcagggaagagggaaagctgacccgcaaacttatagaatgcgttaacacctttctactgaaggatgggccaaacctgggatgcaaatctgttgatatccataatgctgttcaagattttatgttccattcttggcctgtga

SEQ ID NO: 50720 - DNA, 12207 bp, Oryza sativa
  unsure (1)..(12207): unsure at all n locations
nnnnnnnnnnnnnnnnnnnnnnnnnnnnnnnnnnnnnggttttgcaagataaactgtaagatgctgcggcctgtggataatgtgcacactgaaaagagagcacaaaaattggattgcacagatgaaacttacataagcctgagtgtgtggatattccctatctctttcggtatgttaccagtcaagttgttccacatgaaatccctttcaaaagaacaaaatatagcagttaggtaccaaaattttggaaatgtaacaaaagaaaaggcttcacgagactaaatgcacaataagagtcaaccatgcaagaaacaattcctttatgtcccagttattatattatgtaagtttcttctttcttgtgagtcagaattatgtttttttgcttaaaatatactaaatgtagtaccccatgagatacaatattatctttaaattcagttaactattccagctttctatcaagttggtacttacaatgttttcaattgagatagaagaccgatctctggtgccaaagtcccagaaagattcatcttaaataactgcctgcatccagaaaaaagtatgcaatttcaagagaaaaaaaatagcatgatattggcaatccaattatcatattgcacatcatacagaatggacagaagtagataataaacagatatcagaatgcaaaatggatttcattagagaatgatcacggctttgaccaaaacatgaaaatagcaacttaggctaaaagtaactagaggtatgtgtcattgatgatagcgaacacaatgggaacttgaattattttacccagtcaaggctgaggtattcttttttttttcagaaagacgcacgagggctgcgcattttgcattaagaggtagaaaactcatagtacaggtgatgaacctgcttaaagaaaaagagagaaagccagaacctctggctggagctaagacaattatacaaacaacaattgcagagggctcactcaacaagtacttgggaaagaacaaaccaccgttaccactaaaaaaagagggagaagagtaagcgtataaaataataaggttgaaagattatcatacaattctgttacatgaagataattatttattggtatattgtcacagaagactcctttccaacttgatgtgcatggatctccactattccaattcttaagattattcatcggatcaattaatcttcctttgatagctctgagagcatttactgcacataagagggaaacagttcaattcacagcagttttaaaattttaagtatctgagtcaatattactgtttaaactaagcatcacacatctcagcaacaacaaaaaaactaataatgattattcttactttgattgcacagctatcttcagattatctattaaaaaactattcttcagatatttctttggaagaactactgggaagcaaccctttcaaatagttattattctacttctctaacaaagttgttcataccagattaactaacataatgttatgtaattgccaggcaatataatgttatgtaatattgtaagtttacttacaatattgtgaacttctttaatttaaaatctgtaatattatgaacttctttaactctgaattaaaaacatgttatatcatgaactttttaaattaccacatgaatataactgattactggtgtgacaacaattgagtgtgcggcaattgatggcatgaacattgtagaaacggacaattcacaacaggttcagatgggggggacgggatcttcgagatactttcaaaacatagcactacttacaaaaagatatgcttaaatccgcacagatgggatatgcataattgaaactttgaaagcttaaagcccaattctgtcttcctgaactatagaactagtagctattctgagctccggcaattcaaactgcctggctcaaaagtataacagaaagcaagcaagcaaatgcagtacagcacatgtcctactagagattactgtatattaccttcagcagggtcagtgctctgtccccttacgacattcacatgacaaatgcacagaacaaccacgatcactgcgcgccgaaaacctctgaagttcgccatgtctgtacaagagaatcaggagcaagtgatcagcaacttagtcatccctgcacgatccagacatccagcacgcttgctaccattctaaatgatcgattagtccaaaatggaggcgcttatcctacccacagaagactagcatccagtatctaaggtgtgaaagcgtgtcaactccatatgatgcttaacgcgcctgacctaaccatggtgtgttcaaaccaacaaccatggaaaaaatatggcccgggcacaatcaaaatcaactctcctcttgactaaagaaaagtaagcgagcttgcaagttacttaagctcctccacataaggtgaaaacaacctattaacactgacagcaagagccacatcacaaccagcaactgggacttcccaactaagcctgcagactgtacggcacaagagcacagtacacaaggttcaggacttcgagctactaatggttgtcaacgttaggtaaatttttatggcgacaaatatgcccttttccgcataccttctccgtcgaatattttcaccaaaagtaccaaacttttatagcttcaaaggtacagatacaaagaagagaagcgaggagccgaagaagaccaagaagctaggagaacaacgaatagggataaaaaaaaaaatccaagccttcttttttttttggcaaatagcgagaaaactgtaatctgaagtgaaatttcaatccaagaaaagaaaacaacaagatcgaactcacactagaaacaaatcctgaacaaaccaaccgcacaatcctcgaggaatcgaagaagcgaacctgcaatcaaacgcagaccgaccggccgctccaatccgaacagcgatttgcagcagccccccgatcggggagcaccagccgacgaggcgcccggccggagattgccctcaccaacgaactcgggaaaggcaggcgagagcgagcaccgcaccttcacccacagcgacaacccccgcggcgcggggggacatatactactactgctgctgcaacttttcagcccgtgcagctgtcgcattcctcccccaatcccatccgcaccccactccctttcctcctggatcgcggcagctacagcgacgaaggcgaaggcgaggtcgaggcgaagctctgggtgcggtgggttggtgggggaaggttgtgctttggcgaattcggggagttattaatggcggcttctgcttcatgcggcgcgctaaaatactttggattagtaggagagcccccccttggcgccatattttattcagtcaaaattgcatccaggacctcggaggatagagtatttacgcgaataggtccccgtgctcgtgtgaaagaaggaagcgaggaggaaagtagagttgggaaggagtccgccgcggttcaaccatcggcgaccgcattcgcctcgtgcggccggactgagtccggtgatctcctcctctgacaaaccgggcccacaggtcaggtcttattattttttatttttatgagaaaataaatgtattcaatacatcctaaaattttcatctagaatgagatgtaacataatctaagtacaacgaatctaaacagagcttccattaaaattcagttcatatccgttgtactaaattatatcccattttattttaggttgattttttttttgacggatgtagtagaggagagtgacctggcttggttgcttatcatgtttattatacggtgagatgatgcaactgatggttggtacttttctggtggtagtttcgattgttctgtgctttggggggtgttgacggatgcatagtgattattttgtaatttagtagcaattgtctaaaaatcgcacaagagaattgtcatttaagatcatgaatataaaatgattgattgtaaacagccgtcactatcccgtagcagcatcgcaataatttgttcgtagcatcgtacggtggcacagacaaatggaatcaagaacaagcataaagtacaagattatgagattagcttgacagaagcacttgatcaactctctagctaagtctagagttgagctgaaaacgtcctaattctgaattttcctgacagtttcaaatgtagccagtgcccttctgcactagttgagtttatttggaattaaaattacccaaacaaattaagaggtcaaataatttgaccggagacctactcctttacctactttcactatctcataaattactgtgtgtttaccaagctgtgctcgatttgacactgttcatctgtagtatttgacactatccaagtgaaaaataaacgagcagactgcttctccaacaacctgtggaacgacttcactaagaacactacctatgatttcataccgaacaacttgggacttagctgacaaaagtccataatttcatagcaacttgttaattcgtttcgaaaaataccaagttggtaacaagatgatctagaggatatgataacaatgtccacgcggctcattagtaacccccaaaaaacaggggtcgactaacaaaaagtcagagagacaaacacaagctgtagttttcagctccagttgaacgtgaccagagaaaaagaaattgccggccatgatctgttcggctgatatttttttctgggagccatatcgagttgctttctagtacgggtcgcattgatcagtccaagataatgacacttgtgtctgcagggatgacactttgacagatgttgaggctgcacactaaaactgttcccctcctataaccaaaaaaattaggaacattgacataccattaatatactattagaccagtctttttcaatctacggaggctgtgaacagtgtgaccatatgatgacgaactgatgatgtggtcttgttgtgaggctcccatggttttcagaaaacaagactggttgaagtgttctagttccgtgcacagaaattatgacatgtttgtagtgtttaaatttggttctgtattacacttatatgggctagtaacatcttgtgttgaaatgacattacagctgaagtgttggatacgctgcaactagagtacaacaaatgttcagaagaagagtagcttggaagatatttcaaccgtgtagatgtttcatctccctcagacagatgtttcatttcgttttcatggtgcagatttgataacaaccgtgtagaataaaaccaagattataagtcaattttttattaatactcaagatggatacgtctgtgtttcgcagctgcttctggatggcccgggttggttaacttacctcaactgcttaatatcttcggggaaactgatatgcttctgaaacccaactgttcttcagagattagctattccatttttcacttgcgaagcttctttagagaaaaaaaattgttcacttgcctatgatccatggcacggtatcttcactgattggtacatacaaccaacacaacgcgactaacctgcgactaacataagattggagtgcttaatcactttaaatctgtcaaagagcacgcgagtttgactgcagattgcagcttcacaccgacgacggtaaaaagtgcagactttaccagttttgtaagtggatttggggcatctatctttcgcctcttcaccttttcttgtagtgagatacgcgatgatcttgcatattctcagcaacagaaaaaaggcagtaaaatataacacttgtcctccaaattgggtgatacagccaagaggaaacggttctgaagatgattatactaatcctgatgtggtgatgatatggtcagatcaatgtcaccattagaaagtagctaggaaattgaaggtagggaacagaggaagattgtggctggattacttttaaacgtcgacgacaccggtgggtctgatgctgatgttctgctcatatttttgctggcattatcataatagagcagttactgctaaaccgctggtatatagctgaatgggatcatcccagtgcaacagcagttcacacttgccatgcccattgcaatctgcaagttagtagctgtagctttcagttaagaggaatcatattataaccttttaaatgcttgatttaaacggcaaaccaagtgctagtttacacaggcataggattttgtacttctgatgatctgacacggatgcgtcaaaaaaaaaaagatctgacacggacagctgggatattcagatgttcatcaacacagtacgtgcacattaggacaaagtattcagatatatgtggcaatgggttttgcattggattctctctctactttgtaacacagagcaagtgttctgttttcagaggttaaatgctacatggacatgcttctctctaagataatcacaagttctgatatggccacctatcgcaaagccaattgagatgaacatgtcaacaggccaaaaaaaaaaaagaagaaccggaatgaataggattccattaatcacaagtctaaggtttgcctttacaaatatctgatgatatcagtgagtttaaggattgcaccttagctgtcagcagagacaacgtaatgtcgccaatgcctctctgaatcgaagcctgaaacgagtgctctgacaggcccctggttctggagctcttccaagttcactctacaaaataatcacctttcttcccctcaaagaaataataataatcacctttctaatatcgccctatgagtttcaatcaagaacacaacgcagaagttcagtgagaaaaatgatgaaaaggatggtacgaggttgcattgccccatcccagcgtgtactcggactagacggagcttcaggtcgtcttcttgcacggcggctgctcttcggttcttcttgctgaggtcactattggaagcggcggcgaggtgcaaatctaagccataatcgcagccgccggcggccaggggggagggggacagtgcgccggcgaggcggcgacgagaccggcggcggctcagagggcggcgcggccggctaggtcgcaaccagtggtcgcgatcacgagccgttcgattagcattgggcggttatgatagaggcggaattcatgtggtttccagataccgttttgcaagaagacccctcgtattgttcgctatatcaagtacatccttgtttcaaatagaaaacagaaaaacgaagtacatttcgagtcttggattgctaccaagggtagcgattctagaccgttagatcaatgttgagcggatatgattgagggggaattggatgtggtgtaggtgggcactttttttttgcaaagcactaccattatatggtttgccttctttttatacagttctactctctcatagaatgagttgtatattcttttttaagaagcatgaatagttatatattagtaattatgatagtttgttttacggtaaatctagtcatcaatctttatgattttgctgacagtcaaagtgttgatttaattacaatttaacatttatatttgtggacagaagaagtagcttggaatggtatcccatattgttcacactggcatatactataatttgtaagtcgataactgtacctttcaccttttactattttaggaataattaggcctttaaacagttaagtaaacagaaaaccctatagcatgtgctacattacacaagcacatgatctttacctctggtctgagagaccgagacagatgagatataaagtgatttttgggaagcatttcaagaaacagtaagtagctagcttcaaaaattttggagaagctaggaaacttagcttttgacttctagtttttattttattttatttattctgtataatctgaatgaaaacaaataaatcgtttgtttgaggtagcttttgttacctgaagcaccgcaaacagacctttccaccaaaacagatgagattttgacaatccatgaccaacattctaggacgccaatcacttcacagttcacaatggagcaatagtgtttcaacacaatcagatgtttgaggggagcttgagaaaaaggaggatacacgttctagaagttactacatgttagggaatgaagatgtagaagaggaagatgtttttgtacgataaactcctggaactacaactcttgttcctccacctgaactcccttgggccaaaagcttttggtgggatgccgtaccggcccaatctgcaacctttgtggagtacttaacaccatgcttatctctgttgaaaggaatgtgatttaagcaataattatgacctgataaatttccctcaaaaagaaaaatatgacctgattgaataaaattctattcaccagctcaatatagcaagaaacttagcatggttggtaatggtgcaattcgaagagtctatggtttttgttatacatatgcttacaaattttgtatttgtaaacttaattttggagtcgattttattatttttttaaaaaacagtactattactatataaaagtgattaatgttactaataaacggctataagcgaaataatgattcccggttcatccgaacggaaggtccacagtccaaacgtacgacgagctgggcagagggaaacgcagctgccgttaccttgtcaccctcaggcagagggaaacgctagctggccagtggccacgcatggcatgggttcatcccgggagtaagagtaactagggtcggaccaccgggccccgggccgggtggcacgcatgtaaactcgcgataagatgtatatcgatcataagatgcaacggcatgcatgtgacagcgtatgcgtgctgcgaccacgacgaatgttcatgtgtgccactagcggattgctcgaatgcatcaatgcgtgtcaactcgatcgagctatagctacatatccgtgcttcacgagagggcgctgagccctagtaaatgaaagcccgatcgatcgatcccgccattactaaccattacaaccggtcgttgctcttacctgccctgctcttaataaaagccttaattgattaactaactaaccccaacgaacttacgaacgtacgcacaaaactgtagcgtccccgtcctgtacatgtgtgcgcgatagataaacagccgcatgcatatatatacgtccaatattttctcgtttagttcttcgggctaattaagcgctgtacgataacgttcgcctccgtgtacatgaaaactcgccgcgacgctgggcgacgccgacgcatgcgggatacgacgacgacgacccatcataagctaactgagtactagtacgtgtctcgtgacgcggcagctaccgatttcgatcgatcgccaccggccaactaccgtgcgtcggtgcgtgcaatgcgtatacgtgccctgccgactcgctcgcttcggttcagccgtggacacgcggccatgcggctatccaaccagatgcgctgatgtacaaacacgtactccctcctaaaaaaaaaaaaagtttccgtgcccaatatttaaccgtacgtcttatttaaaaaaattataaaaaattaaaaaaacaagtcacgcataaaatattaattatgttttatcatgtaacaacaataaaaacacgaattataaaataaaattatatcagatggacagtcaaagttggacacggaaattcagggtttgcttttttttttacggagtaaagcgcaagcctaccaaatgcaaaatttacgacatgagaacctgtgttcgtttaattagttgaacaatcaagtcatgcaaagcaaccgaacttagtacatttttgttgcgtggggaccaatgctttagggcgtaatcatccatactcacgaaggaaatcgttctggacaacgacacgtctctaaaacataacttttaacttcttgtttctataaaaatatttattgaaaagtgatatatatatatatatatatatatatatatatgcttttataaaaatatcttttaagataaatctattcatataacttttacatatattttcaaactcaacaacttaaaagttatttatgatttatatttttaagatttgaattaaatattgtcctaaacgattttcttcgtgagtacggagatactgctaacctaaacaaccgagcgaatcatctttgactaatcatcgccaccagataatggcaaaccttgaatctttagattttgggagtttttgaccgtgagaacacctgagcccggccgctcggaccagcgatctgatctatacaatggttgttaatagtgggttttttagcgttgttaattataaatacttgttgatatggaggaaagagaaaaaggagagacaaaacatcgttgttatgcatgacaacagcttaacaacgactcttagtcactataatatagaaatatggttgcatgaggatataaatataaaaagaatattaataaaagaaatattttttgagttaatgattagagcctttatcgtctcaactattataaaaacatggtctctaaaatcttgtattatttaagagaccatacccgtctctaccattgaacatgccctaatctaccccaacatcccaactttgaccgggcctcgatgctacggcacgtgggcccacccactgacaagtgggccccaccatgacgttatctccttcaccactccccctcgcgatgcgacacgtcgagcccgacacgtctcctctatccgagcaacgacgccgccgacttttccagacttaccgcctattctaatcccccacacctcccacctctcgcccactgacggccgggcccacacgggcggtgggcccacgtgtaagaaaaaatcgcgtgaaggtcacggggggcccggtgtttttaccgcccagcgtttcgaaagcgaaagggacaaaattgggaaaaaaaaagaaagaaagaaagaaagaggagaaaatttcacgccgcggctcacacgcattcctcttcttccctcctcttctctccccgcctcctcgcggtgtctgcctctctctctcgcgcgcgcagcctaccgccacaagcaaagtccaggagggctcgggcacggaagcttctggaagcttccgcgttggcgtgaggaaggaggcggaggggaggggagggggactgacctactccctcaccgcggtcgttccaagtcccgcgccgccggggattcccatcccctctcgcggcgcgccgcttcgacgggaggtagggagggtaggagcaagagcaacagagtgatgtcgagttcgggtggcttgcggttgttatcggtctcatccggttttgcggttgcaggcatcgtcgtatcgcatcgatctggtttggggggttttgggagtctgaagtggtgggtttgagatggaggacttgctggacacggagatcgggaagcatgactacgactggtaattgactggtttctccttacttatttggttttctgaattttgcgtcgatttcatgtttgctgcaattggtgaacccgttgtgctaagttgggtaagccgtttctctaatttggagtagctggtggcaatgccgcgtttgaaatttattttgggggcgttttattggttaaacttggacgacgttatacttatcgtgcttgtggttaggtgaatgaatggtgcttgtttatccgaggaatcagtggtgtcatcccagggaaatcatgatttggtgtatttaggttgagttctgctgactgcgattgtttccggttttaagattggccatgtacggatgctacttggtttagttagggaattagtttcgttgacagcaaagacaagtaggtgactgtattgtttggtctgtgggctccttcctagcttgaagagcaaagcgttggatctcaagtaatgtcttctctatattggaaagggaaaaaaattcggcaggcaaatagcattgctaactttaggatgttttatactggctcgtattataggataatttcaatagttcaaatgaattctataactcttttgtgaaatttctgaaactgaattacaccagcacccagccacccactgggaattacaatgaccagacattttaattgcaagtttagttgaaataactactgttacactttagttgactttcatcacattccactattgtggtgataaggccgatttggatgtcacgtctatgggcttgccacaaaacgggagtgc

SEQ ID NO: 50721 - DNA, 1011 bp, Oryza sativa
cttgcataagaggataatgaagtaatataactctgaactggaaagtggaaatgatttttgatgtttgaaaaccctaccatgcattgcccaccaaaataaactagttgaaagaaaattatgttcgccagagtgattttccaaattttagaatgcacctagtcacattataattgcaataactgtttcagtgcacatcgcctgcattggtaggttgttaggtgctgcaactagcgctaagaacaatacttgtttgaattctgtttaggcaacaatagtagaaaggcatggtaatcctttaacttgcctttttattgacaactgaatgccaatcttacgtttcatgcaaaaggagttataagaaaaaggcttgatgaaccaggtgatctgtcaataccatcataggatgttgaaaacagatagtcaccaatgctaccgtgatttgctgtattattgggttgtaatcatgtaaatttggagtatttcacgttattacatgtttgctcatattcatatagtgcaaagtgtacaatctgcagtagtcagtaatacattttcgtctacaatgaattgtaatttgtttttgggaagcaatcaagttccatctagttagcaatataatattgtaataatattgcaccacttatcatataaccattgatacatgctttagctgtatgacctgtttcttcaaatctactatttgctcagccaggcatgtgttgatgctcataattaacagaaatgtgctgcatgtttattgcagctttccattcctgaaacagagaatgggcattccacagtaccaactaggccagcacggagtaactctgtctctcgcccttcaatccaatctactcttatttccagcacaacaggtcatcagttgtcaatgcaagcatttcctctgtctgttcgccacctacaactccaagcaagaggactagcactctttcttcatcaaagccatcagttccagcttcacgtcaagtaccaacacggccctctactcca

SEQ ID NO: 50722 - DNA, 2533 bp, Oryza sativa
tatgggagacaacagcgcagccgaagctactggtatccagttaaagcctggaaatgctggtttacttgggtatgttgcctatgttccaatcactatatgcttgtttcatttcttgatattggagcctcatagatttataggctatcctctatcttacatgtcaatagaaataaatatttctttaagttgattgtcttgatttgatccagtcgtttttctaattactatttgaatactgggacaattatagtgaagtttctcatcctatcactaatacatttggctgcctcgtataggatgtgcatatggccagccttatataataaatggcttggtaacctctctaatactccctccgtactcgtaaaggaagtcgttttggacagcgacacggtctccaaaacacaactttgacctcttgtttctataaaaatatttattgaaaagtgatatatgtatacttctatgaaagtatttttcaagacaaatctattcatataatttttacattttcaaactcaacaacttgagagttattcatgatttatattcccaaggtttgacttaaacattgtcctaaacgacttcctttacaagtacggagggagcatttgataataataaataggaagctccttctctaagaatatcccttcctgcgtcatagatttgtatctttaggtcacagtacaacatttttttatgcctctctcttacacatgctgatgctttatagacatttatgctaccttccttttttatgactatttttcataatgtcttgtcctaagttctgatgcttcgtttacaagccaatagaatctgttatgtatgatcctgaggtccatggttgtcaccggccattgttcttgttgaacaccaagttttggaggggccaatttgtcaaatattctgtgctgtgctgtgggatcccatttcatgggccctgtaatgtaggtttttctctagtcagtatatacaaaagaagaaaagaaaattgtaggtaaattcgtttctagttagccatcagccaaaggaattcataatttgtttacgtgtgtggaagtcatcttatgcttttgcagtttattatgatcctgtatgcaattgaattacttattagaaacatatccatgtacaggtgggctatgagttctcttactcagaagggaaaaggttctgaccatggtccggtttctagtgcaaatgctagcaactctcaaatttcagcaacctccagtgtcacatcaggtattagactttttttcaaattgctctaatcatgagtattaagctcagttttcatcactagatagggatcacgggctataaatgaaagaggaaaaatgtaaatatcttaaaagaggattaacaaagtatatgacgtgttacagttgaatgtgagctcttatcatttgtcaattctactgtcacagataatagatcttccaccgtagcatatgcaccatccacttctagctctcttgatcaaactgcaccagcatcagcaaggtcctcggtggatgggtggggtgaaattgaaaacgataatactcaggaagagaatggtagtgataaagaaggatgggatgatgtagatccgtttgacgagaagcctccaccatctcttctctctaacatacaggctgctcagaaacgtcctgtggcgcaaccaaaacaaccaggtaggctttgtttttgttactgtatctgttatatacacatatttgctaaaagagctgaaaataatgccattactttcttttatttattcaaatttgtcaactgtagtatcaaattcgtcaagattaaatcaaccaaaggtgcccaaaccagaagaggatcctctatggggttctatagctgctccagcacccaaaaatgcatcgaagtcttcagacatcaaaccttcaacgtcgcacaatgatgacgatgacctctggggttcgatagctgcacctccaccgaaatcagctgggaagcccttgaagccaccagcagcagcaaacagtgacgatttatggggtgccatcgctgcacccccaccatcaaccaaagctagacctctagcttcatcaggtaggggtcgaggaacaaagccagctcagccaaagcttggcgcacaaagaataggcaggacgtcttcaactgggatgtgaagcgccatcgtcatacaagtgttgtacaaggatgaatttttcttttctttttttttctttcgctttctgtcgagaatattcccattttgtaaactagcccaatcatttatatggacatgattatgcccaatgtattatttcacaattgtgtattacgatagcttcaggatatatgtacatcacaggagtgaccttcaattgttttcatcaatatattggttttgccttttgttctatctccagttcgctatcccagttgtgttggggccttgggggtggaacagataaagcagtttctacagttctctctgctattaaattatcgagcttaaagtcattctttatcaaatgtttatgctatcggcagccatgtg

SEQ ID NO: 50723 - DNA, 1518 bp, Oryza sativa
cctggaaaacctggcgggcaagggaggcgccgccgccgccgccgcgcgcgtagacagacacgaggcagttggccacggaagtgttcgcggcgagccccgatcgcgccgcgagggcgtggagctgcggcacgatgcccaggggagcaacggggacgagcgccagcagcgtgacggcgtcgaagcggacgccggcggccacgcgcatgcggcggaagagggagaagcagccggccgggaccccgtggagcgcgcacccggagatgagggagttgaacgcggtgcgcgccgtggcgggcggcgtggacgcgaggggcaattcgtcgaggagctggcgggcgagcgggaggaggcggaggcgggagtaggaggagagcagcgcggagaggaggtaggcgtcggaggacgggaggaggccgcgcttggccgcgagcgcgtgtatctgggcgacgcccgaggcgagatgcagcttggcgcaggagatcaccgccgccgggagcgccagggcgtgcggcggcggcgaggggtcgccgtggcggaggagggcaagggcctccctgtgccggccgaggcgcgtcagggtgcgcacccgcgcgctccatggctcgagggagtcgtcgccgccggcgacggcggcgggggaggctggtgcggaggtggaaggctcggtggccattgccgcccaagagagcgagacgcagacgccacgggtccgcgaccttggagaagcaggcgcgcttgcgcgggcccaacgaatcacatttcggcccaattaaaattaccgcaaccccgtgcctcactttcgtcaaattcctggcccatttggcagagaatgacacaacaacaacccgatccttgattgttctgaatagatatggtagattatctgattattatgtgtgacattgaagtataagcaaattaattaaatactattacaaagtaaaaagcctgtttcaaaatgttttctaagaacttatatatacacacgaacgtactttaggtgatttaggaacttgggaagcatatgctcctgatgatctataatagtatgtacatggtgaaatgtgatagggttaactggatctgcgccaaatgtgatagagagtacagctgtacattttgaaccaacacaaaaaatcgccatgttaacaccatacaattgtatgaatcaaacaaacacactgaaacacacacaaaaagaatgaagaatcgtttacaatttttacaatgcaattgtgtatcaaaattgcaatgccatctgataaaaaggacagggaattaaaaaaaaaatcaaatcaaaagaatgctcagctcagtgttgctctccgtaccgccggctccggaaaaccgagctcaccgtgctgtacccgagcatgcggtggagcggcccttcggccggcgacgccggccatcgctggtcgccgctcaagttgctcctcgcggacgcgtgctcctcccccgcgtcgtcgtcatccagccggcgaacggcgggctgcggcgcggagaatatcttcttgg

SEQ ID NO: 50724 - DNA, 1417 bp, Oryza sativa
  unsure (1)..(1417): unsure at all n locations
ccctgaacgcacccatgtcgccgctcatcggccgcctggttctccgcgacgtcggccggagttcgctgacgcggctgtgcatcggcgagccacctctctcttcccccgattgctcgccgcttcttgaaccagccctaacgctgccccgatcaaatgctgcgtagggagccgagctggtccgcaccggaggctgctcgccgccgccgtatgcgacggaggacgtgcggctcagcgtgtccgggtcgtcggagaacacggaggcggtgtcggcggagaggatctcgagctgggagagcgcgtactcggcgtcgtccgtcggctccgggttcttgcctgctcaagccaacgatcgaacacctcgtcaggtactcaggaacacacccgcgccggcaatggccgacggcgccgggaagaatcgtgcggcgtgcgtgcgtacctcggatgggcgtgcggcacttgctgcagtagtagatgatggcgttggggtcctggtagatcatggcgcggcagtaggggcaccgcccgaaccgcctcttcacctgctcgctctccatgctcgccggcgaccggcgacgtcgccgatgctacgacgccgtcgacgcgcccgcgcccacgcccacgtttgccctgcaaagagacgatagcttcaagatttgtcatccatgaacttaatccccatgcttcttctgcgttctacagttttgcagcgctatgtgtccatgttcgattggtgaatctactgaacttatcaaactcatttgcatctagaattcaagatggttatcccctaatctcctccctaacctacattcctacctggntaattcaagaacatgagcaagaactcctaggcagaaattgcaaagaaccgagtcatacaaggccacagaaacgaacagattaactaacttacctagatcagatgccaaaactctcaaagctcttcccgaattcttcacctaatcatcaacacgatcacacggattcccccaaacccaaagttttccgaaacgtgaagcaacaggcgaaagcgagcgaggcgatcgatcgtggaagaaggacaagaacaagaaaggtttcttcttttttgagccaccaccgagccaagcaagcaaaaagaatagaattttagtatgcggaagacgtgtgcgaaccgaagcgttcagcgcttcagctgagcacacatacaccccgctttttcagaggaagcgtttggtgattatactacgtaatagaaatccttggaatcaaaacgagtcgggagcgtgtgggtgtgctcggattgctgcttccaaccgccgttgactcgagagaaaactgaaatgatggagagtagcggcggttggctgcacgagcattgaaggccaaagaggagacccggtcctgcttccccctgtgcagagttgcttttctatta

SEQ ID NO: 50725 - DNA, 1109 bp, Oryza sativa
aaatctccctccactgtacgtacgggggggggggggggggatggtctctgctcgtgtaatcgtgtcaactgcctcgaggtcaactcgtgatcgagctcgactgttgctttttgtattgtctagtagttggctcgtccttttggctgtttgtgtttctgctcatgattaatggcgctgctgagtgagtgagtacaaaagaaaaaggtggcccatgcaggtctcgaacctgcgaccttcgcgttattagcacgacgctctaaccagctgagctaataggccaccaggttaagataacctattattatatatttgaacctacaagagcagcggagtacaactttccaacgaaggttaggggcccttgaatcaaagcaattatggagaaatttcataggattaaatcctacaggaaatttttctatgtagctctttgattttaaggattgaagttttccaaatcctacaaaattcctatagaatggcttgttgcatataggttttggaggaaacttaacaaaaggtctgtagtccaatcaaacgattattcctgtgtattgcaatcatctgttttatacttacattcctgtcagaattatatgtttttcttattccttaatttttttattcctacgattcaaaaaggccctaaatggctgacaagggcagcagcgcggagatactgatgctcacgtcgtcgcgactagcttggaaccagaatcgacggtccgcaacgcgtcccggtcaggaccgagcacacgcttggtgaaaccgtggacgtcaaaacgtggatcagaagaggcaacaacgaaattacctttgataaagtcacactgttttctctgtaatcgtttgcatcaacgagaacccgtgcagataccttcctcacgagtaacattacatcatccatcggagtacgaggaatcccagtccccagctacgagaaaggcacagctaggcgctattgtggcacatgagagaaatagcatcaccaccataccataataatcacggcaagcatatgttatctcattatcgacgggcaatgatcatatgttgatgttggggctacgagacacgatgctacatggatctgacacacacgactggca

SEQ ID NO: 50726 - DNA, 1721 bp, Oryza sativa
ggcatcaagcttgccaagcgtgtctgagggtagcgggccaaatagccctactgctggtaggcgtagtgttcgcacacggctattgactggtgtgcaagtcaccccaacccatgaagtgcagactggggctgcagagctccagttgagcttcctgccatgtggcagtgaggcagcaaatgcaagaagagcctgcttgtcggagttcagatcagcactcttggcaggaggaatgcatgcaaagaggagagaaacacccagaaaagctgtaagtatatgatcttgcatggttgatgcttgttggaaacaaactggtccaacactagaaaccaatctttcccatcagctcttcactcctctagcatgagaaaaagaaaaagaaagtaaatcaatgtggtgcgtaacagcaagaatatagtaaagtgcaagtagaaagaaggaataaaaggttaggaaacatgaagcataaactctgcccttagatatactttcagcaccaattgccaaatttaaaaaataaatatgctaaaatcttgaagatgaggagcgactgttttgcacagaaaataatctaacactactagagttgaatgaacaagatgcttgctactattaacatctagaagtagtgtttccgtgttgatacttttcatattgggattgtcttagataatttcaaggacaaattcctaggccagctaaccacagcaaatatttataatatatacaagtataactgatatgacctgacaggggtttgacacatcaaattacacaaatggctaaataccagcagtattaggtccaataaacaacgtggatttgtacaatactacaagaattgctttagagtttcagaacagagtttaacagctctctagtttgtagctagccatcacctcagaataaccgctaataattcccatgatcaacacttgatgctgatgcaacctctttctcaggataaaagaaaaaaaaaaggagaaatgctcacagagtgagtcaactctatgcagggcacatcacatttctcaactgctacatggtaatctcccgtcccaaataaaatacacgtggctcatgttctcttcctctagtcaaagccgtaggactcaccatcaggctaatctgctttagtttattttctaaacggggcagttgggatcatctgcatatgacaaaagcaaccacccaaatcacatcacaaggcagctatcaccactcctctcccctgttttaataaaagcacacacccaattatcttaacaagaacttctactaccctttgccactgtgccctaagcaccgcacttacacttaggactgacaaaccatcataaagaaaaacagttgtcagacaactccaagaaactgtttcaacaagaactgccaacgggagatggcaagattcccttgcagccgggcgatctccttaaatgctccagcgcatggcaccgcatcatagatagatatctcacctaacattacatctgcagttctgcacccctcatgcggctgccttcgaaaagaaaccaaatatgctcaccagcagcgcagatactgatgatggttaaggccatggcacaaaagcaaaagctgcgatgcacaatgcgagacaaccaccaccagggaagagaaggaaaggaaagaaagacgatgcctttggacttttggggggggcgaggtgggcgccgggatattcatgggtttcatgagcttaccct

SEQ ID NO: 50727 - DNA, 2391 bp, Oryza sativa
aaaaatttagggtttgtctttttttttaagcaagtaggggtgtccgtttctcgggatttgtggagggttgacggatctgcccctgaggtgaggaggctgagagtgaccgaccgacgtcgacgtcgacgacgacgacgagatcagccgctgctgcccctgcctggctggtggtggtgccctgcagggcattgactcagatacatatgggtcccacttgccggtgaagtggtgtatggtacgaacatcgttgaccaagcattacgtgatattagtccctcgaacgctaactgaaaacgaaaacgcagtgcatacgacttgctccctccgtgaactgtattaagatctaagtgtgattgctaactaatggtgagttgggtctggagtggagttgtggagtagcctaaacccagccacatctctctagtttattttgtgagcttcacccagttccgcttctattttaggtggtgttggaactcttttactaggcttcgctacaggaaagatgaaactagagttagagccattccaaataggcctctagttattagatccaatacttacgggatgccatgtctaacatcatatgtacccatggtaacatcagcatgatatctaaatactagatctaatatctacggggtattatatctattattgtgttgagttgtgatccaaattcatttgcatataataaaggccagcttctgttggagcgaaacggaggcccgtcgttgccgtagacttggaccgaagcgaagcggaggctgaagctggcccattgggttaaccaaataacgttatgcacctggggacacccgggggtgtgggagcggagcctccgcggtacagatcgttatccttttaaggtttcaccttcatatagacctcttgtaagtcgccgttcagcgttgtaatctcaccctgatacagtgaagatattttgctggctagcgcacgtggttttttctctcctgttgtgggagggttttccacgtaaaatcttgtcttctgttattgatttattgttttttatcatttatttgcctatcgtttcttaacattattaaaggtaatataggacctgttcactttgatatcatttttaaccataccattttttagattagatgccaaaaaatatctacgtttagtttgttgccaaatttattaaatacataagaaatcctgccaaaaattttggtattatcaaaatttggtaaggcttattttagctacattctgaacatgcccatagtatttgtgacccgttctaacgcactggcacatgcttggagagtggcggaatcaacttctgattcttggctagctcaccgttcatgaacacttcagcaatggtttatcagccgcaataattgaaacatcagcagtaattgagcaatggctttttttttatattccattatctaaaaaaaaatctaatcagccattgtatggcctccggtctgcattacatatgccggccagtacatattgtacatttttgtaccgtcggacaattcaagccactgtacactggtacgtcattcctgttgcacaaatcgcgtttgatcaatgcaacacaacgacacacgcattgctcgtttgctcctaccgccttttggatctgtagctgagctcctaccgagtgagcttaatttcagccatttgagcacggcagaataaaacgcatccactagggccgtgcttagttttccccatatttccaactttccatcatatcatatcacatcaaaaactttcctacacacataaatttttaattttgttttcaaactcctaactttcttcaaacttccggctttttttcaagaactaaacacacctagacaaagcggcagagcctgcgcccgagttggtcgggcaaccactcaggcttagctagtagcagatcagaatcctttgctcaacccaaagattatcaggttcacatgtcagtgatgaaggcacgatgcagttcactatagaggatctcaatccactagtagcctagctaatactgatatttattgtcaattttcgaaaatccttatgaaatgttgctgagattcggaaatagtcttttatcatctgaactcagttgtcgttggttctgccggccacttacaggtgttcatccttttcgggtggtttgtgtatcaaccgcagtgatttttttttcactgacagtcttgctgaggttctcgtgtgaaccagctgggttccatgccatattgtcaatttgtcacctgctaccgtattgaccgtctagccagagaacagcgtaccaattggcgcattctttgatttcttcccccttttcatcttgagcacagttattgctgggaatcatagaagcctacttcaacaaatcaagtgatttaccatcac

SEQ ID NO: 50728 - DNA, 1592 bp, Oryza sativa
aattattacgaacacaacggtgtaatcggattgtaaatcggatgagtaatttaagagaaaactttatttgaagcatagatgataggaatatttcccctacttgctcaatcgattaatagcaaccaaaactcctaaagtactagcacgtgggtgtctctggttaagactaattggagaggcctctccaattagatttaccgatttggaaaactttgaaaccatatttttttaaaaaaaatattctaataaataaaattaaaaaaaatcccataatctgccgaatcgcaggcgaccttcgctacggaaaaaaattatgtgcagaccggctgcaaaacccgcaccgtgtatacccgacttagatgggcgacgcgtggacgggcgagcaatccgacggagcccttgcgcggatccatccgctctaggagaaggctcaactcggttcgctcgtgtcgactcccacaaccaaaagcgcatcgagccgagcatgaggaatggacgggttcatcagcgcctcactcctgtccttttcttccacttttctttcccccgccgccgccgccgctgcgatttccttccctatctcgcctccatctatcgggatcgcctcttctcggtgccgtcagctagccgataatcccctccgttcaacaaccgatgacctctctgttaggttctctcgaattcactcaaaatagcacaggattatggcaattatattggttgtattgctccatttcaacaaaattgagcctccaccgccttcgcctccaaattgccaaagccgttgttcttcgtattcgtttcagtatttaacgatacaagccaactcccacacgcaactctctctcacgggtacaactcacgcacgccagttgtcacgccacccactctgcgccatggtactttgggttgggcttcttgggccttgctagacgtgtcttctgtgcgtcatcttccttagtctgagtatcctcctcgcgtgccaccagctcgccctcttcagttatctgctcttcttctccatcatcttcagtaagcttttcctactcttcttcagccagcttctcttcttcttcttcagcgacatcatcgtcaggtggaacaggtggacacctgacaatcccctctccttgagaaatggcttgtccccaagccattgctttagggaaccttgccttcagctcctccagatcttcccaggtggcttgttcagatgcagtacctgatcattgaattagcacttgcataatggttgaattattcttcctggtcaacctgtgatccaggacatgtaaaggatattgaggagtagaggagacataagataagtgagtttgccattggcttgtcaaatcccttggctggctttagcaatgagacatgaaaaactgggtgaacactgcttccaacagggagaagaagcttgtaagcagctgtgccatttttgagatgatctgatatggtccatagtacttgaaagctagtttgtgattagaacgaggggctactgagctttgcacataaggctgtagcttgaggtaaacccagtcacccactgcaaactccctgaaagttctctttttgtcagcaaa

SEQ ID NO: 50729 - DNA, 3310 bp, Oryza sativa
gccggaaaaggaaaggagcggccggattggaaagcgggggcggcggcgactaaactagggtttcggccggaggaggacgacgatcccgacaggtgggacccacctgtcagcgaccgaacgcgcgcgcgcgcggctgcggactgggccggctgggccgaggagagagagaagggttttgggccgactttcggcccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctggccccattttatattggaatttattaattaaacttagatcttctcttcaagacttttaaaataaattctagaaattccaattaaacaacaatttatatattttgaattttcagggtgtgacaaacctacccccttaaacagaatctcgtcctcgagattcggaagaactggcgaacagatgcggatgagctgacttcaattcatcttctcgttcccaagttgactcttcttccgagtgattactccactggactttgcaaaaacggaaaactcgattcctggttcttctctcatttgtttccaagatacggattggtttttcaacataggtcagatcctcttggacttctatctgttcaagattagcttcttcggtaggtacccttaaacacttcttcaattgcgacacatggaacacattatggactcctgccaaagattgaggtaactccaactgataagcaacctctcctcttctactgacaatcttataaggtcccacaaaacgcggtgccaattttcctttggtgtggaaacgatgaacacctcgaaaaggcgtgacacgaagatacacgtaatctccttcttcaaaactcaaatctctacggcgattatcggcataactcttatgacgagattgagccactcgcaatctttcttgaatgatctttaccttttcttctgcttcccttaggatatccgtcccgaaaatctgacgttctcccgtttgatcccacaaaagcggagtgcggcacttccgaccatacagtgcttcgtaaggagccatctgaagactagcttgataactgttattgtacgaaaattctgcatagggtaaattcttatcccaacttccaccgaagtctaaagcacaagctctcaacatgtcttccaaaatctgattcaccctttcggtttgtccgtctatctgcggatgataagcagtactaaaattcagcttagaacccatctcttcctgaagtttcttccaaaaatttgaagtaaactaactgcctcgatcagacactatcttcttaggaacgccatgcaaacacacaatccttgccatatacaattccgccaagcgacttccagaataggttgtttttaccggaataaaatgagccactttggtaagtctgtcgactatcacccaaatagaatcatggcctgatgatgttctgggtaaaccagtgataaaatccataccaatttcttcccatttccattcaggaatcttcaaaggctgcaacaaaccggcaggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacaaattctctcacccaaccatacagttccttgctcatcttccaagaaaccgatagcttttcctcttctcatattcttcttgatctattgaatatcaggatcattaatttgggcttctctaacttgatcaattagagtgggcttcgcttctaaggctgcaacgaaacctctactgacaattcccaaatttaatctttcaaattccttgcataattccaatggcaactgtcgtccgtctgtagcattgcaatagccttttctgctaagagcgtctgctacaacattagcctttcctgggtgataatgaattcccatgtcataatccttaattaattccaaccatctccgttgtctcatgttcagatccggctgagtaaagatatactttaaactcttgtgatcggtgtacacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacctggaaacccttctttggatcaggtaaaatcaaaataggagctgatattaagcgactcttcaactcttgaaaactctgctcacattcttccgaccacttgtacttcacatctttctgaagcaatcgtgtcatgggcttagcaatcttagagaaattctctataaaccttcgataatatcctgcgaggcctaggaaactgcgaatctctgaaactgtctttggttgcttccaattagttacggattccacattactaggatcgacggcaactcctcctgctgagatgacgtgaccaaggaatttcacttcagacaaccaaaattcacacttgctaaacttagcatacagttgatgttctcgtagcttctccaatgcaaggcgaagatgttcttcatgctcttctttggttcgagagtagataagaatatcatcaataaagaccaccacaaacttgtctaggtattccataaacaccttattcatcaaattcatgaagaaagcaggggcattggtaagtccaaaagacataacagtacattcgaacaacccatacctagtggtaaaagctgtcttagatatatcttcctctttgattctcaactggtgataccctgatcgaagatctatcttggagaaaacagtggcacctttaagctgatcaaacaaatcatcaattctgggtagcggatacttattcttgatagtcacatcatttaatgcacgataatccacacacattctctgggtatggtctttcttttccacaaaaataactggagctccccatggtgacgaacttggtctgatgtatcctttctgtagcaaatcatctacttgcctcttgacttctgccaactcattggctgccattctataaggtctcttatggatcggagttgggctgcag

SEQ ID NO: 50730 - DNA, 1149 bp, Oryza sativa
caatggaagcatatgccttgacattcttaaggagcaatggagccctgctttgacaatttctaaggtgcttatatgaaaacttcactagttttcttttattatgtataacatagtaatgaataacataaacgcctggtaacacatttatcttcttcatgaagtatggctcttattatttcattggttcatctcatacagtctcaactgctactctttgatctttgttttccaaaagttggagctgttattttttttctacttggtattaaattacgcctcatgtaataatattagttttatagggttctaaattattagtgttctgtatgcatagtatgataccggaggacaataatagcattcaaatggtcttgtttatttcattgtggaagtggggaattggcagaatgttaagtgaagcctctgttcggtccaaaactctttgaaatttctctagaaaccgtaaaatatgtcaagaaatagcgaggttctgtttagcgcattattcatttctatcacagagtaaggtaggtggacaccttcattttgaagtgtgaacattacatttgagtaaattacactcatggtgcatgaacttgtgaggtgggtgcaaatagataccacaacaatgctcattccggtacaataacttgcccggcctgtgttaacctagtccaaaacaatccacacatgcaaaattgatctgatgtgtagtaccaggacggcacctatgcatgctagcagttgcttgtagttgtgcaggcctgcacacactagctcaatttcgtatttgcagaatatagcagtcagcaataataattactatgttgcaacctcttgtaggctgcttgcactactggaataccgatttgatttttcaaaacaagcattttatttttcaaaacaaaacaactgctagcttgcaaaggtgtcatcagggtgcaccacgtttaatcaattttgcttgtgtggattgtttttgcctgggttcgcacggactactcaaattattgtaccgaaacgagcaatttacctatttgcacccaccgccccaagttgatgtaccgtgagcgcagtttactcattacattttaatgcttattcggtaactgcatatgtggctatcttacattttgattgcatttacca

SEQ ID NO: 50731 - DNA, 746 bp, Oryza sativa
caagctttgcttattaactttctggcctaactgtcattgcacgattcattagcatatggttttcagagctaagacatctttgtgcattagatgtacccatgcacaattgatcgaaaaaatgtcctgtatggatatattataaaagttgatatggattgaaatatgaattaacagacaagacagttaaaactaacatgggagatttttgcattgacaatactactttctttaagttataactgtacgatgcatcttattttggtctttcaactaaggcatccaatggttttgtagtgatgtgaggaccaaggctttccaggctactgatcaattcttgcaaatagcaaaacaacatcatgaaaaggtatgcacatttagtcatacagtttatttgcttataatatatccactattctggaccgtttgttacactactggtttgctctagatggcatgctaacacaatgcatgtgtgttatgaccataatatgttggtagataacttactgtcactgtaaaatatcttttgtttttcattttcttttgctactaattgtatcatacgttttagatatgccattacttttatccggttgtcatttctccactagtttagaaatgccagacgacttccaatggttttggctgttagaacaatgtcaaaagtctgaacaaatacctcctctggcacatagagctataccccacattctttttgcaacactagtctaaatactccaatctgt

SEQ ID NO: 50732 - DNA, 722 bp, Oryza sativa
aggagaggagaggagagagagagagcgtgttgggaataaaaatcacaggagagagagagccgccgccgcccgacgccggcgccgctccaagtcgtccgctcgtcggcgccgagatccgcccggccgcctctccgccgggtgccacgccgtggtggaaggctgcctctccgtcccgccgctcgaccgccccctgcctctccgcccggcgtcgtggcccctcgtgccgccggcgaagtcgccgcgggatctgcctcaccgcccgggctgccccgccggccgccgccactgctcgaccaccccgcccgccgccaccgctcacgacgcggaggccggatccgagcgtcggcgcgccggccgcctctccgcctggccggctgtgctccgccgccagccaccgccgctcgaccccgccatcgccgctcagagagctcactagtaccacttgttgagagacagagtagttgtcacaccctgaaaattcaaaatatataaattgttgtttaattggaatttctagaatttattttaaaagtcttgaagagaagatctaagtttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaggttttaaaaag

SEQ ID NO: 50733 - DNA, 1051 bp, Oryza sativa
ccaaattcttcaccagtagtctctgcaggagcaggccccattctcgaagcgatggaaccggctcgcgtccctgacgagaaacgctctatttgtcaactccgagatcgtcttcagaaacgagtggcagtccccgcacacccgcaggttcttgatcaccacgatctcacttcccgcctccgtgttcagcaacccgaacgccaccgccagcttctcgctgtggaaccccaccaatggcacggccgccgcctccgctaccgccttctcagcgcgctcctcaaccacatcgccacccgtcttctccttcaccatccgctccagctcgaccacgagctcgtagatcctcctcgcctgcgggtgcgagtggtcgtcggccatgaacaggtggaccttccccttgtgctcgacgtagctacacccgggctccttcctgagcccgcgccgcctcatcgccgcccgcaccttcgccacgccgtcgagctgcccggcgtcggcgtagatgttcgccatgagcacgtagtaccccacgttggccggctcgaggctgacgacgcgctcgaaggcctcttctcccatctccacgttcttgtgtatcttgcaggctccgagcagcgcgccccagaccgcgccgtcggccgccatcggcatcgacgcgatgagctcccgtgcttcgtcgagacggccggctcgtccgaggaggtccaccatgcaggtgtagtgctccagtttgggccggaggcagtaatcgcgctccattgttgagaagtacttgcgcccttcgtcgtacatgccggcgtggctgcacgccgacagaaggccgaccatggccacgctgtccggcgcggttgcttccgacaccatcgtctcgaagaggtcgacggcgatgtcgccctgtccgtgcatgccgtacccgatgatcagcgtcgtccacgagacgacgctcctctcgggcatttcgtcgaacagctcctgcgcctgggccaagctgccgcagcgcgcgtggaagttgatgagcgcgttgcagagcggcaggttgtcgcggaagcccgggatt

SEQ ID NO: 50734 - DNA, 17089 bp, Oryza sativa
cagcaacaggattatcaagttgcttgagcccagataacttctgtcctatgctagcatccacaaaggaatgagtgctgccagaatcaattaacatcaataattcaaaaccctgaatccacccccttaatttgattgatttactggattctatcccccacatagcttgctgagatatagccataagtgtctccttggtgtcattttcatcatcagtttcaaacacagcttctactgacacagcttccagaagttcttctactacatgcaactgaatggtggtggcacatttatgttcttttccccatctttcaccacaagtaaaacacaaccccttagatctcctatatgctttaagagctgccaacttgtcatctcttgccctagctgcatcagttcctctcctatcttcagaattggtgatactgagtgttctattgttagaagaagagattgggcggtggggtctggttcccacaattaggtcagatttcttgtatgacagagacttacaaccctctaatgcctcctccagaagtaaggccacagaacaggctgcatctaaatcagggggtttctgtaccatcactacagttctgatatcatctcttaacccttcaataaatttggtcacaaaatagtctggtatgtcagagttgccataggccatcagctggtgcataagattatcaaatttttccacatattcactaacagtcccagtttgattcaaatgaatccactgcctgatcagttctctttttctgtctctagcaaagcgattacacactatctcacataggtccggccaggaaattcccccaagttgtgttctgacagattgtaaccaaaaagcagcgttgcccacaaaattgagagtagcaatttttacccaattggcaggcaaaatcccatacagatcaaagtattgctcacagttagctcgccacatttgaggactatcaccactaaattgagggcacaacattggcggcacagcaccactgaaccccacagctccaagatcaacatccaattgcttatggccaagatcaagggaatagtgggcatggggaaagagattggaatcgggcgtaccggagaactttggagatgatggccccgaagcggtcccaatcttcccattgccacccgatgtcttctcagtcttgatttgccgctgaagagtgctctcgatcagatccactttggtattcatcgcctggaaagcttctccgatatcctcgaccttcctctccacggctggaattctagattccaccatcttcttgagctccagatactccgccctagtgcgctcatccgccaccacgcgcttcttctcgttctcctccaccattttcagcagcagatccagcttgctgctatcctgcgccatctccgagtctcgatgttagggctagaccaaattccgctaacctaggggaggcaagttgccttttcgcgggattaatccgaagaaaaatcccaatcctccctcaggattttgcagcagaattcggtagaactagcacaacggggatgaggctctgatccagattgttaggttctctcgaattcactcaaatagcacaggattatggcaattatattggttgtattgctccaattcaacagaattgagcctccgccgccttcgcctccaaattgccaaagccgttgttcttcatgttcgtttcagtatttaacgatacaagccaactcccacacgcaactctctctcacgggtacaactcacgcacgccagttgtcacgccacccactttgcgccatggtactttgggttgggcttcttgggccttgctggacgtgtcttctgtgtgtcatcttccttagtctgagtatcctcctcgcgtgccaccagctcgccctcttcagttatctgctcttcttctccatcatcttcagtaagcttttcctgctcttcttcagccagcttctcttcttcttcttcagcgacatcatcgtcaggtggaacaggtggacacctgacactctctcgcctgctaccgtcgtcgccgcctcccctgtgttcccctccgcacgcctccctcctgactacgggcactgttggtgacggcggtggcggctgggtcaggtaaggtgagcacgaggcgtgtgccctctgcctccctcctggccacgggcaccgggcgtcttcggtgaaggccacagcggctgggttggcgaggacgagcagaaggctctggaagaaccggcatctggactgcaatgcaacgcgtcgccggaaatcgggtcaatgcaagtggagcaccattcaagcaactaagaaaagtagtagttgctatgtctgatcatttgcccgtgtctttctgtctttcatcaaaatgttggggtgttggtttctgcaattctgctattgtttaaccaaattagttcctcggacctcagtcttgctaaaagtgatggggtgtatgatgtatcgctcacacagtcacactgggtagactgtttgcagcaatgacaaaggcttatgaattagtatacggcatctttggtgttctgaaatctagaatgtgatgaattgatgtgtaaaaaagattgtgattgtttgtctgaggttcatttctgcaagatatattgggtacaggggtagcagcaatcctgaaagaacacagcattaccacaagtgcagttgtgagcagcgatcatagcagaccatctcttttatttggctttgttcaatatcatcgtttctggacgttcacatttatcatatttccatgttctagagaaaaagacaagcgtgcatggagtttctatgaaaaaaaaggtaaaaagaccgaatgaacgtacagatcttcagaaatgttcagaaacgtgcagtgcaaatgttcagaaatcaacacattgtttgcaggtcttgttgaatttgcacgccaaggctttgaattatgtatgcgctagtgcgatccatggccaaaaagaaagtctagcggaatgtgtttttcgccggcaacaggctgtgaattgcaatcagccaatcacttctatctctagataaccaagctcctctggtcgccggcgtctccggcagagatcttcccagccttgatcgacgccgacgagggggcagctacaaggggaacgatgtggatgaggacgagagagcttaattagaaaggcggcgccgcggcggcgacggcaaatgcggaaggaccgctgctctgcggagccgatagaggcgtgcgagccgaaccgagttagccgacgtctgtgtccaagtcacgccgcctggagccccgcggggagcgccgtccgatccaaatgtaatccacgtggcattcatcgggcagggctccacagccaccggtttgcatccggtctccaccaaaatttttttcctgctacccgctgtgtcccggtttcacggcagcatatcaaacttatccaggccactggttttcggatccaacggtgggtgtatctatagtacacgttaccgtgcatcgcagttgcaggctttaaggtgcaagcagacaggcagagcaattcccacatggagcaaaggaacaggaaaaatcatggtgtaccggccgccgcggccggctctactccctacgtataaaaaactacggacctatttagattgtagccaaaataaatcctatcaaaatttagcaatttaataatattgttaagttttgacaaaatttcttatgtatttttcaaagtttgataaaaaaactaaatggatatatatatttgacaactttatcaaaatttggtaaggttcagtggtggatctagaacttttttttttagccgaggcaaacctaacaatagaaaacaaattaacacgtaaacacaaatacatgtagcattttatcatggatagaagtaaaattgagcgattagttaatgactgagtatgataattagtgctaatctaatggtgcaagtacagctaggctaatggctaagcaccatagttagttctaatgcttgaatgcatgcgcggagcccgggcgtctgcctgtgctggccggaccttggctccgccgctggtaaggtttatttcgtatacaatctaaaccggccctacatcaacctgatcgatgcatgccgtgtgcccatgtgcatcagcgagtttgcgcgagaaacctctaaaatgattttttagggataggtagggagctcctgcaatttcagtatagaagaagagagttgatccagtttataaggaaaatcgaaaaaaaaaacttaaactccataatgttttcgtttgcgtaacccaatcgtacgtctcacgtccgtcaaggtcaggaggaaaccggcacgatcttacgtgaaacagccaaacaggcggctgtacgtgctcggcttgttcgttcggttcgatgcagccagcagccagacctgtgcgcgcaaggttctcacgaaatcctttcgcgatgctgcaggaagacaagcagtgcactagtgaccgtacgtgtggctgtttcgcgtcgccacttgcttgctttcctagctacaacgtgaagttttgtacgctacctatctcctgttgggagacatacttgcatacatgagttacacgctcatactaacgacactattgatatttataaacgaaaaataatttataaataaaatttttatatttgtgttcttagcggtataaaagtaaatgctgaaaaataaactttgataaaaaaacccccaaaatcagctccaaatttaaggttgaaaattcaagaattggctgataaccataagcataaatgaaaagatgacacgcttgctcttccacttgccatcaaaattgttcgacatatccccaacgagcgatcgagaagacaaactccaccaaatactttctttgttttatattataagtcatttgactattttttaagtcaaacttagcaaagtttgactaaggcccagttctttttctcaactcctcgttttccgttaacatgctttttaaattattaaatggtgctttttgacaaaatgtttctacgtagaagttgtctaaggaattcaaataaacccatttttcaattttataataattaatacttaattaatcatatgctaatgagctttctcgttttgcgtgcgctgaaaatctgtctctcaactcagagatcgaaggggcttaagtttatagaaaagtttagcaacatctaaaatatcgatttagtttcactaaatctaacattaaatatgtgggactagctattcagctgtcgacagtttttaatagtgaaaactttcgaattttttgcacctcacaatctgcaatcaatgggccacacgaaacgggtctgaaccaactgaaagcacgaaaccaatccgtttagagcgtgcagacctgttaagaaaccctgaactaacttgtcagggttatgaataccacatacctaatagtagttgactaaatctcggcaggacccaccacataccatgtcctatacagaaacaacttgcggatataggaggagctccggataagaaaagacaaccagagttctacgtggaaacgacaaggactacttggattgtatccatattggtttccctagttctacttggacaaggggacacctatgggtataaatacaagaccccctaggaggagaggggacacggacaacatagacgccacaaagccacaagccaacatacgccaagacaagccgtcggatatcgacatcagagatatgcctggatcgaccctatctggtacctacagaggccggccgtagggatctagcgttgtctatgatctcgctgggcacaaactcgaggaggaaggctaccctgttgtcgactacgagtcagaccttcagaccgccatatcgacaacagttagataggctaccccaaatattgtactggtgtgattatggtgaataagagcaatattggcttcggccaacatgatatagggttattacctgacaatttaagggcccgaacctgtataaaaaccctcgtccccatctcttttacttcagtcttgcatataccttaataccaacgatgtccatactatgcaaataccagaatcgcgacatcaaacgtcgacataacccattttaaattagcacactgtaactagtctataagttctatgtaactgtaatataattaaacttattttgcatagcgcaataaaaaattaatgctctatgtgtagatgataattgacggtgactgtgcaaccaaacaaatatatcacatataagcaacagtgcaaccaaacaaatctctcacgaatcatggcgccagatcgaacggccagaaaatcgaatgtttccggcattcaaaactgttaacagctagctagcaaaaccatgaatatattttgataatatatttgttttgttgaaaatattactatatttttctataaactttgttaaactctaaaaagcttaactaaaatgttaaacaatttataatataaaacggaaaaattactatcttggtcataaaatggtactgatcgatagaatattttttagcataacaaattcggacagtgagtaatattttaggacgaagaaaatactgacacaagtcaaaatccaactcccatcccacctacccagccaccaacaaaccctttttttgcttttttaccatggtagtatcacctaagagcaggtacaatagtaggctataagccagctataaacatattttaaaaagataaaaaaagagagagaaaagcagcgggctacagatctgcagctggctgcagtacggactccaagacataatgtgtgtatgacagatgggaccaggtactaatagtatagtaagcaattattgtataaattagctattacattgactatagatattttggagctcatagtgagctatacgagctcactatgagctctaaggcttcgttcgttcttgggcgatctgggggattgagagagaaaagcatctcgttttccgcgcgcacgcttcccaaactactaaacagtgtgtttttttttaaaaaaaattatataggaaaattgctttaaaaaatcatattaatccatttttgaagtttaaaatagttaatactcaattaatcatatgctaatggctcacctcgtttcgcgtatcttcccaatctccccaatccctttctcctcaaacacaccctaagagcacccacgatggttatctataggctctctacaagatatctatatcagcatattttcctacttgaaagagattaaatgaagaaagagagcaaagctatctactaacttagagatagtctatagagaaaaacgaggcaatgcattagagagctatagatacccatatagacatactattgaggtggtttactattaatctaatctattgctgagatgtacatgttttataaaaagcacattcctttaccattgcgagtgctctagaggaccaacaactctagccagaaatatgaagaggactggacaatgaagccttgcaggccacaggatttccacgcactcgcacaccgtccaccgtgcgtgtactgccgcgcgcttgcacgctgcagcaccaccaccatggctcactcacctaacgccgtcacagttcacgtcgtttctcaagatcaccaaatgttattagatcattcataatgcgcggacgtgtcgttgagcgctaggaacggaatatccgacgtcacgtcctctgtcagcgttgccccgtaaagaacacggagccaaaactgatcacccattcttcggcctgaccgaggggaaaggggcacagctccacgttgtggaggtcggagcctcgccactcgtggctttgcgtaggcgtccacgcaccttttcccctcccgtgctttcctttctctcgtgcaagagcggtggaaaggagaacgagaacggcaggctggcaacacaagatggcagtggaagcgagaacaagcatcgggagagaagaggagcctactagggtctgtctgccgtcgcccacccgcccgccgccgaggccactcaaccacgttgccggcaagccgccaaaccggtgtcgatttctccgccaaatccgccgccaaggccactcaaccacgaaagttggccaggagaggagggccgccggttggggagatgatgaggagcgctggccgtgggaggagacggggttgccgggtgcaccgccccttcgatccgtgtcggtcaagctcgccgaccacgccacccggagctcgctagccgcctgcctctcgccgaccacgcttggactggtgtcgacattggtggagagaggaggggagggggagaggggcgccgccggcgagatagccgaagccggactgccggtgtagggagaggaaaagggagagaggggggaggtgaggggggattttatatatttgtttttttagatttttggggtgttcagtgtgaattttggacctctacacaaattacgaaaaatattagaactaaaacaaaaaatttagggactgaagtataaaaattaaagtcacttctaaagccacttacactgtgacactgtgaaggattaagattttagaccagtgatcttaatttatgtggcactctgagctcctcaaatgagagggacgcatgaatggccttagcaaccaaccaatcctccgccaccaaactcccctacctacccacagccgtcaactcttcaacggcgactcccctatataacacgcacagtcgcgtcgcgtcgcgtcgctcctccagcaacaacgaaccaacggctgagagtagagtacgtgaagttaagtgaagtgaagagacgctttgcattgcagttgccaccgcttcccacgcggccgtcgtcgtcgccatggacctcctcttcgtggagaggctcctcgtcggcctcctcgcagccgccgtggtcgcgatcgccgtgtccaagctccgcggccggaagctccgcctgccacccggccccaccccggtgcccgtcttcggcaactggctgcaggtcggcgacgacctcaaccaccgcaacctggcggcgctggcgcggaggttcggcgacatcttcctcctccggatggggcagcgcaacctggtggtggtctcctcgccgccgctggcgcgggaggtgctccacacgcagggggtggagttcgggtcgcgcacccgcaacgtggtgttcgacatcttcaccggcaaggggcaggacatggtgttcaccgtgtacggcgaccactggcgaaagatgcggcggatcatgacggtgccgttcttcaccggcaaggtggtgcagcggcaccgcgccgggtgggaggccgaggccgcggccgtggtggacggcctccgcgccgaccccgccgccgccgcctgcagctcatgatgtacagcaacgtgtaccgcatcatgttcgaccgccggttcgagagcgcggacgacccgctgttcctccgcctcaaggcgctcaacggcgagcgcagccgcctcgcgcagagcttcgagtacaactacggcgacttcatccccatcctccgccccttcctccgcggctacctcaggatctgcgaggaggtcaaggagacccgcctcaagctcttcaaggacttcttcctcgaggagaggaagtgagtactcctccatgagcgagactccatcaattagccaccagaaatcctctgctcacgtcgcatggtgggtgtttctttcttgtgtgtgtgcaggaagctagcgagcaccaaggccatggacaacaatgggctcaaatgcgccattgatcacatcctggaggcgcagcagaagggggagatcaacgaggacaacgtgctctacattgtcgagaacatcaatgttgccggtacgcgtgcctcggttcagttaacagtttcttcttcttctttttaatttattttcgttaaccatgttgcttgcagcgatcgagacgacgctgtggtcgatggagtgggcgatcgcggagctagggtgaaccacggggagatccaggagaagctgcgccgggagctggacacggtgctcggcccggggcgtcagatcacggagccggacacgcacaggctcccctacctgcaggccgtggtcaaggagacgctccggctgcgcatggccatcccgctgctggtgccgcacatgaacctccgcgacgccgagctcgccgggtacggcatccccgccgagagcaaggtgctcgtcaacgcgtggtacctcgccaacgaccccgggcggtggcggcggccggaggagttccggccggagaggttcctcgaggaggagaggaacgtcgaggccaacggcaacgacttcaggtacctgccgtccggcgccgggcggcggagctgccccggcatcgtcctcgcgctgcccatcctcggcgtcaccatcggccgcctcgtccagaacttcgagctgctgccgccgcccgggaaggacagggtcgacaccaccgagaagggtgggcagttcagcctccacatcctgaagcactccaccattgtcgccaagccgagagcgttctagagtgcacactaactagacagtgaactgcatcgtcttctctgttcctctagaagtatcaaccccattgtttggtttactcgtcgaataagccaaacgatatatatatttgtaaactagaactaatttgtgaataaaatttttatatatatgttattggtgatctaaaagcaaaggctgaaaaataaacttcgataaaaaaaaccctaaaatcgacttcaaatttaaggttgaaaatttaatttttgagtgataaacataaacataaacataagtgaaaagattattgcatcgctagttctctacagaagttccattatcatgtttcatgtataaatcttaccaccatcatcgtcatgtgcttaatgccgggctaaattcttgaaatgatcgtcagtcagaaactttgaaatggccaaactgaaaaatggtactcgtagaatttcttccgcataaaacacctaactcactactgtaatattttgtttcaattagtacattccccaacgttgtaatgggggataaaacgttggatccgctggttacgtacgtacgctacgtgtgtggacgcgcgatgggtgaaagtgactgaaggaggatgaccccgtttttaaattactagaatttccttctgtcttggaattcaaatttccacggtccgcaacactggtttttttttcagattctagcaaagcaactgtggttgtgggcagtctgctttggttgtgatgtttcagtttctgctaaaccacttcttctcttctggttaccctgacttctaaaatgcttgtgatatgtactagttgctacatagaattttcatcgatgcctgaccacatctgttaatcatcacatttcactggccaaatacccgtgctttgctacatattaaaacaaattaatactgaggtttttgggataattttgtacctatggatgttatactgtacatctgaaatatgatagaatatatatttacacggattattttataacattaaagtacatatgtaattggtactttctccgtctctaaatataagagattttgggtagatgtgacatatcctaatactacgaatctgcacatgtattcaaaatcccttatatttagggacaaagggagtagataacatgatggagcatgtggtaaataaaaaaaaagtaaatttcagaaaactgcaactttagtgataaaactatcaatttgttgcaacattagcgacatgtttcagtttgctacaacaatagcgtgtgaaattatcacaaactgtaacttttatgttatatgatgctacagtacaaataggtgacaactgaagcatcatatagatattataatgtacaaatattgaatatgtaaatacctgtgcacttctgatgtatttttaaaccacttattctaagttattttcagtttatttttcaaaatatttaattatcactgtaatgaacgcagttaatccgatcataaatcaatctctagcatggtccgatcaaaagtttagaccttactaaatttttagataacaaaccaaacataatctaaacattataaccataccacaatatgataactctcgggaaaaaatatttattaaaaagtttaccaaaatgtagtaaggtctcaataaaaatgtatatcaaccttccctagtcctttagtattatcaaattttagcaagttttatttgccataaactaaacatgcccaataatttatcaagacaaattgagttttctagtaaaattgtacttttaccaagctcaagagggggagaaggttacattgcaaattgcagtacacacaaacacatacttgaatgtttgacgtttaggataagattcaatcaaaattttaaattttgataatttcttgaatgttcaaatgttcaggaaaaaaagaaataatatatgtggatttgcttcaaactgtaccatatcataatatcataaatctgtatgttagaaatttaaaggtttaatcacatgttttttttctagacattaaatatttctgacaaaaaatactccacgataagtaatcgagagtggcagggacctaagagcaaaggaaatagtggactaaaagtcaattataaaattattatatgaaggagagagataaaggaaaatattgagtgtgggctctcaatgcaagatatgctgtaaaataaaatgcattaaattcatggtgagagaaaagaaaaaggagaaaaatgaaactaaccttataaataacttattatacatgttagctctaatgtgaagttatagttagtgttagctctagtattaaacttgctctaaacaaggttttccctaactcttgcactacctttggtatgcagtagcactgggatagaaaagtttccaatttaataagggcctcagactcagagaccttcatatgcaccctgcacagcaagtttctttgatcaattttttacatcagggtgcctctatatgtgatacacacgtgcatggtaaagtgcaaactttgcaatttgacatgtcaaaacacccacacataatcacttctttgcatgcatgagctgccagcctgtccgtccaataatcatcagaggtaaaataaaatcatcagccaacaaagggcaaaaacgcaaattatttttctccccccgtcttcctcgcctttcctgcaggtaggcccccgccaccgagccctctgttacctccccccttctcctccgcttcacccgacgcctcctcctgcccgcccggatctacctcggcgccgcgtcggcgggcggaacccaccggcggccgcgcggggaggaggcgatcgaaaaaacccgaggggggaatcgcgccgggataatcctagggcagaatgttcaagttcctcaaggaggtggtcgcgggatccggatcgggcctcaaggacttcccctacaccatcggcgagccctacgcctccgcgtggggctcgtggacgcaccaccgcggcacctccaaggtacgctctcctcccttcccctcaccgctcgatcgggggcgcggatcgatttgatagatccccatgagatggggcggcggagatatgcgagagcgtgccgctgattcggttcggtggtggtaagctagtgagtgatccgggtcaagctaagtttgagttggagctgatcgtgcgctgattctaacggcgagtctgagtgggtgctccctgggtacggtttggagctcgtgttaggtcgatattagcttgagtaatacctcaggaagtagaattggtgggctcagtgctgagtttatttgaggctgatctggtttaagggagcctgtgatttctgccagattactgggagttcgtcattgctcactgcacagttgcatgccatctggtaatagtgaggaccttactgatgtcagcacttagtcattagatttttttttttggctgtggaattagattattcgtgaggtttccttcatggttagtgatgttattgatttcagttggtggtaattgagcatccaaataaaagttatttttgatgttgttgcattgggatgctggagattgtgtcaggttttatcttttgttgactagtgggggcatgccttgtgcatgcgtgttctgcaaatggtgctgtagattagcacactctgatgatatatgtgacattggaggcctcatactgatgcttatgtcgattggagatcatggctcattcaactagggatgatcagatgtctaattatgcctaatgtacctgtgtttgggtggctgttaatggactaaaagaccaataatccatttctttttggcagttatggatgacctttcagggtgcaatgatctaagtcaagatggattgtatgtaacttatagtggcctttgtgtagttcaatatagagatgtgtagaacattcatgcgtcaattttaccacccagatggttgtgatgtgatgttgatcaaaattaggaggtctgttaagtgtgttatctggttccatttctttttcgcaagctttgatttatttgcgcagcatactcttttcccccaaatgattacatattgcattaattttacaacatatgtatatgatgctatcaacataattgttgccttgtcttttctgcaggatgatgggtcgcccgtgtcaatcttttctctgtcagggagcaatcctcaggacaggcacttggttgctggtcggaatggtgttaagagattacgaacagtaagttactaatgttgatcttaaatatttgtaatgtctacttgtactgcaagtgtcttattttaacagatgagaatggagtctatggtgatatactattgagttctagaagggtacaacaaaaacaaggaaaaaaatctgcacagagaagattcaataatggtggcattatatcatgccatattggcatttttttaaaaccaaaggccctttgacccagctttataagaaagccaaaaggttcttgcaacaatagattttggtttttgctgggatttccagcttacattaaagagtaggcaggaaattccatctgggcattagccattaggtacgaggttatgcatgccggtccacttttttggcatctcgcattaaattttctcagtgacttgcttctagtggacatctttacttaaatatcactttgtagtgcaattgagttttgcttttgtcatcggtttcattggacttctttactctcaatatgacacctgctaagttagttcagtgttattgacctgctgcacttattgcaggtgcgtcatccaaacattttatcctttcttcacagtactgaagcagaagttcctgatggacctgccatgaagcatacaatttatattgtaacagagcctgttacgccactttcagaaaagcttaaggaactgaacctgggaggcacacagaggtattatgagcttcccctatcctttggtgtttaacattatgacatatatatttgtgcagatatggagtacggttgctgcttaatttagtgtgagcaatatgttttttttgcttaatagtctagaactattggggctaatcaattctagtgcactagtcttgtcagagttggcagtttgcatgtttactgcaccatattgccagtagctatttctcgagagcaaaatttcatattgctcagtttttgtttacaatcatatttattctcactattgctgataaattatgggccagagatgagtactttgcttggggtcttcaccagatatcaaaagctgtgagctttctcaacaacgactgcaagcttgtaagccctccccccccctctctctctctctcacacacacacacactctctctctctctctctctctctctctcaaacggagtacaatcgcataatgcaagctgttgatgtggctactacttatctcacagaacttttcaatttccatcacaacaaaattatttctggtgggcataatttgctcatttttaaaattttaaaaatatcaatttatatttagtataagttacccttggaattagattgcacaaccaaattatcgtcaggatcttcttgtttacatgccaaattcttttttatccagatgagaaaagtatcacaatcagccagcttatactgtgtcatttcttcttgaccatttgatttcagaatttgtacttgtataactttgttgatatgatgttttactcttattttgttaatggcggataatgaacaatagtcaatataaatgcatgttcttatttgtgcaaagtcatgtaatgacacacgaaaacaatgtatgttggaagttctttggtcataaaatttgaaattgtcatcatcaatttcaggttcacgggaatgtatgcgtgacgagcgtagttgttactcaaactctagattggaagcttcatgcttttgatgttctttctgaatttgatgctaacaacgaagcctctaatagccccatgttggtatggtctcttaatcacagtcccgcacctttatatatagatatagaactattacaactctcttttggacatgtttggtgaatgtactgaaacaaatgcttttacaccgtgcttgtcatgttatcgtatgtcgagtttccattgtttctagaaagtaagaattggtactctttaatatcagggaaattcaacatgatagagggagatatataccatacttctttttacatacttatgttcctttgcagcaatttgaatggttagttggaacacaatataagccaatggagctaacaaagtcagattgggtgtcaattaggaaatcacctccatgggcaattgattcctggggactgggtaagcagagctaactccttttccttcattacattcttgtttgattgttctgtttccataattttacaattcggaaactgttcaacagttccttgtcggatgtgcactcggcattattgtactttaattgcaaaagttgtttattttctttaaatggatatctctctatgggcctgtatcgtagtttcaaatcttttatggtaaatactataaagttttgcactatagaccaggtcaagatcgaccaagaaaagacatgtctagagtcaaattaataaactatggttacctga

SEQ ID NO: 50735 - DNA, 2889 bp, Oryza sativa
tcctgcagcccattactagacattacatagcagcttagctggaagcaagtagcagcaatgcattcataatatatatctgcaggcagctgtattaaggcccagaactacttcagaaatctaatctaatatagtgaaagctaagagctttcttgcaaaaagggcctactcatgttggtggcaaaacatggccatcaataaatactgttcgtcagatttcaagaagcaagcaatcataaaggtccttcacagaacttctatcaacatctagtaatggagtgatatgactaccggtgacgcacaaactatacaagataagcatagctgcttgcagaaatgttgaaacatgatttgtttcaaatgaatattctagttccaagagaacaccaaaaataatgtaaaagactgagcatgtgtgtaataacatgagagtgcaacacagcttaccttgaaaggttggtggtaaactacccagagtaagtgtttcaaactcaatagaatctattttatatttttctttattctctgcaataattggatttgcaatatcctgtgcagttttgcagatagcctacaggttacacaacttttatcgtcaaccagaagtaatctacaacttaagagtattaatttttattgtcaaccagaagtaatcttcaacataagcgtaccttgttgaggtaaggccacatcatctccagaaatctgctcacccaatcaatctagcaacagagaggacaaaaaaaaaagggcattaaaagtactgcaattactattgatcgagtccatgaggtttcttcaccaagtagttgaaaacttaaaagatatagaagcatactctatcacagtcaggattcttgacccacaaaggaatttcatgaaggatgccatccaaagaatttgagtcatattccaccagtgggcaaactttgacgtcctgaaaggaaatcaggggatacattagtgtaacagtattcacaattatgtttcatgtatatcctgcatgagagaaccctttcttggagatgcaactagtccaagtgacaccgcatgggagaacacaaaaaacgtgttacccagtacccagatatatgcatatataaatcttaaataagtatcaaacatcagatgaaagaacattacaaacccaccaaaaaacagaaggatactcataccacacagatctaatgtaaataatgtgtggccaataagaaatgaagaaggttctgatatgaaaaaaaaattgaatcagctcttgacgagtttatgaccaaagtgtttcttcttaacaacaacctcagactgttcccaaactattttggttaaatgattagagatctattgacagagcagttaccacataacacaagtattcgctacacggcaacaaaatgaaatggcatacagtaataaataaagaggaagatcaaacaagcatatgcccaccttcacctcggttggctggaagtagatgaagaggaagtacccaataacaataccagctgagaatccaaaacaaaacccagagaaatcaatcaacatgctgactatgcccatctcagattcctacaccagctttctaccagaactctcatagccaagcacataagaagatgaaacaaaaaggcattactcagataagttaatcaaccgaaccacgtcaccctgctaaattacaaggggacaacctgagtaagctaacctactagaactagctagtacctccccttttttttctgcaagtatcctattcagagcatgacaatgccctaacatctgcaaacaggtattaaactaattccgccgatcatcatgaagcaattccccactttagaaactgtagggggtccatctatcaagactttcccccacggcacgaatgtaatgcttcagacacgtagacacaaagaaacaagcaaacaaacatgcttaaagtttcagaaaatacagtgaaaacgacactaaaggaactgtgagaacaaagcttagcaatgccctaatggcttggcaacacgaagatgcaagagcttctggagaggagaatacatgtaacattcgaaatggccacacggaattcagaagaatgtaatatagggtggtcatcagtcaagttgtaatgtgctaactacgaatactttggttggtggtccggttggttcttttttatgtgggtttcagaatggattaattctgtccctgtaaactgaaatagagtattgctattagatatttcaatatcatcgtttcggattaactcggtccaatcaaatctactcacaatgcccgattaaaccaacaagattgatcaatagatgccggaacaaagccatcagcaaagcacagatgcgattcctcgatcgcgagatcgatcaaaaacgattgcaagatcgagtagcagatgggcgatgagtttgaaaccgagtggatttacctccgtctcgaatcggccgccgatggcgtggtgtccgtgggattcatctcttgccgacgggaaaccgaaaccggggatgcggcggggaaaagaaaggcgccggcgaggagagggtggtccgtacgccgtcggcggatggcgctctcagcgagcgagggccagcgacggcgggccatatgcacggggcgccgacgcggcggcaagtcgagacgagagggagggaggaacgccgccactacgccatgcgcgacagcgcgaggtcgcactccagacaatcagacttcagaagatgaacacaggggactgcttggtgttggtaccatagtacttttctccgtcttaaaatattactatttattatatggttttaattaagatatggattttatcttggtttttattagtatctttctaaattgttaaatgatatatttcaaacctatttgatagagcatcaactc

SEQ ID NO: 50736 - DNA, 11355 bp, Oryza sativa
ggagctggagctgtgccaaacaggcccttcgtgcgaaaactttatatatataagttattgtaaaaattagataaaccatttttaagtttaaaataattagaactcaattgattatatgccaatgactttttgttttatgtgtcgtacttgatctacgccaacttcaaattcaaacgcttttagaggtacagatctagccaaattcaaagaaaaataactagttggaggcttggagttccagtcatcgtcatgataaaatagtagtattgtgtttgttcttttttaatgatgtttagggcactgaaacaatctccactgtatatatttaatcattatttttccaaaaaatatagtcatcaaaatgatttagagtactaatatatgatactatattttcatgaaaaatttgcttatgccattttcacattgaatcctaatgtttccttttatttgttagtatgttatgttttagaggtttgaaactttgaatggtataaaatgtcatcaatttgcaaacggggggaggattaaaaccataatattcatgaagtattcttcacaaatatgcgaggtggtggctagcctagggaagaatagcccatccggatcatcgtaggaatggacaatatcagaaattcagaagtgaagagagcaaagtactgcttatagcatgtgcatctgcacaagagagatctaaataaagtagcttgtgtgcatcaggagcttaggatttcctgagctattgaactactaggagagtaatcccttgttagggtgcgttcgtttctggcggttgggaactcattccttccgcacggaaaacagagcgatccattatcgtgtgcttaattaagttttagctatttttttaaaaaatagatcaatatgattttttaagcaacttttgtatagaaacttttttaaaaaaaacacaccgtttaggggtttgaaaagcgtgcacgcggaaatcgagagggaaaagttggtaacactatcttgcgaacacacgcgacattgatataaatctctctctgcccttaaaaattactgtctgtggcattttttttaaaaaaagcccatgaaacatcttagagaaatatgaaatgcatggaaaaaagtaccggttgaaacattttgctattgtgcataaaacattgaatttcaacatgtgaaacatataaatttcttttatcaaaatataatcatttgtaaaattttagttgcaacgaatacaatggtgtagtatgattgtagatgagataaataatataggaggaaaaattgtttaaaactttaaagcagagacttgagagatagagtcatgtacatacaaagcggacgtacggttcttttttattggagttttataggatgaatatcattgtcagcccatttattttttctcgcatatttttttagacaatgacatgtgaggtcatagatacatgttactgggtgaaatcccgcgcgttgttgccaaagtttcgtaagatagctagacgacatagcttaaataaattgaaatggtttatgataatttaaaaagtatatggaatgatgattcaaatgtaaaagcaaggtgatatagctttataagagaagaaaaggaaggagataatttggtccatagattaatcatctaagaacttaaaaaacaattgatgtgatatgtttaatgagagaataaagaaataatattaactaaatgaggatgaaatacgtcaagagaagagccctatgcgcgggggcgttgtcctaggcacttgagagctgggttgggttgggctgggccatgcctttgcactctattattactccgtctttcccaaatcgatcatcatgtaatagaatccaaaatttctcaaattatcgtcatataattgcatggacacagatttcatcagaatacaattaatacattatgggagaatgtgtgcatgatagggtgtaattggcatgggttttaatcgatgcatgcattgtgggagaatgtgtgcatgatgtcttgattgatgtgatttaaattgtatttggttttagtttctaaacttatatgatgatcaatgtgggaaggagcgagtacatgcctaaaatacgagagcgaaattgatataatggtggacttgcagagacaaataatgatctaacaggcaaggtaatcttgatggtgtggcctcatagaatttgagctttataacaatgaatgactattagtgagtcacaattttatagtaaggagggattaataacatcatgaaaatatgaattagctgattttttttaatcgcaaacaaggaattgtggtttgcaactcctatataatttttccaccctaccgatcctaaatggatcacaatcacatactcctataccgcaacccgttttgagccaccggcccaccccaccccccctacgcacaaaacaccgggacgcgaagcggaaaacgagcgagcgagcggggctctccagtctccaccccgactcttcgtgtccgctgcgaaaaaaaggttagaacaccaccccccctcctctccctgatccccctcgcctcccccctttccccccctctctttgctcctctccacgcagcaatccgcccctcgattcgaccagatcggcgcgagtaagtccccgctacatcccgatctggatccgcccccgacctccgcgtgatttccctctccgtggcggtgttttggtcgggtacgtagatcgacgcgtggtggggcgggggggttgtattgtttgggtaaattctggtgcgcgacggcgggggggaattcgggttggtttctgaccgaattttgacgcctgtttgttcgatccatttgttgtgcagtgtcgatctatcgtgtgatgtgatttttttccccctggtcggtgtgtgtcttagttcgagttattcggatgtcgatgggagatgctcatgttttacttgttttgtctgtgctgaccgatagattcgttaatcgttgtgattgatgtcggatatgtttgccaccattgttgatgtggtttaggcgcagtagttgtcgtttgattcctaacagatcattttacgtatttgggagcaatgcgaatttatcaagaatttgataaccgcgttagtatgtaatcaacggcttgtatgctggtatgcagtagtattttatgaacttgtgaaattatagttgcatgtgttggtatagtggagtagatacgtgagaatttactactttgtcttacattagcttacggcatttattttgactatggaggttaggaccatggacccatataacctttgtttatctttctggtttacaagagaaaggtcaagtttgtatggatattagtgggtccataggtttgtaattttaggataatttactctgaatgtgttgatagcgaagttgcttatgtggtgagcttaatgcttttgacttttgttaaaaacaagtcccactgcgttgctttatatctacttatatccgattccatgttatgtaaggatggatcgaaacatgtttaaaactgtagaactaataatatatatttcattctcttaagtatgctaatgcaatttaagcaggagcttatcatggcgtcgaagcggatcctcaaggaactaaaggacctgcagaaagatcctccaacatcatgcagtgcaggtatgacccagatttatcagccgaactatagctgttagacacagtgtaaacttgagcgttgatatgataattgtactctgtgggtggtagtcctcatgttcttgtcggatggaattgtacgaactgtttgtatcctttagtagtgaaatcatccaatggtgtggttatccgtaaattaattttgatgaatatattttgggtggtgagttgtttgtcagattgtattccatgttgttcaattggtccacattgaaagtggactatcggtgtcctacatgtaaacaatttcacccagtattcttgctacaagaaaatgcataattctgtcagttgttgtcatgatgatgcccttgtgttttcatctagacagctgtgatgtttataattttgaagaaacgcttctaagacagagcatcctaatgtatttacattttatattgaaaatcttgatgaaatatggacaattattaaccagtgcaattgatcatctattctcatgtaaacaatgaattgttttggtcagtttggtcttgcgtacctttttgccctttgcttgtacaagctctggtgttgatgaactatagatttttataaatttaggtcctgctggtgaggatatgttccattggcaggcaaccattatgggccctccagatagtccctatgctggtggtgttttcttggtgaatattcatttccccccggactaccccttcaaacctccaaaggttagcagcgagccttattctggggcaaaattttccaatatttgccacttctattgaagatgaatcatgtggctattgttccctctccctatctcatggatggattgctactacttttaatggatctttatttcacaatcatttactgtcttcactcagtatcataattcataaatgatctacaatattagtgaatctttagctcaatagattggttcactaagtctactgtctacctagtggtggattccttctgctatgcattaagttagctcctttttttcaggtgtcttttaagacaaaggtcttccatccaaacatcaatagcaatggaagcatatgcctcgacattcttaaggaacagtggagccctgctttgacaatatctaaggtgctttgatgaaacttcactaaacttcactacctataggaaagcacattgaattccgcatgcacgcttcccaaaatactaaatggtgtattttttgcaaaaattttctataggaaagttgctttaaaaaatcatattaatccatttttgaaatttaaaatagttaatactcaattaatcatacgctaatgacttatctcgttttgcgtatcttcccaatctcctcaatccccttctcctcaaactcgccctaaatgaatgcatattttccttctttatgaactttggcgaattgcattgattcatctcatacacaatctagataacaagagagtgcgctgtctgttcaaagtgactgcatatgtggcgctaacatttgggtttgtttgttttaggtcttgctttcgatctgctcgctgctcactgaccccaacccggacgaccctcttgtccctgagattgcccacatgtacaagacggaccgtccaaagtatgagacgacagcccgcagctggacccagaagtatgccatgggatgaaaccccaagtcctgaattcgaatccactgcttaaatgcagacaaatttgtcccaagaaactgtttatgggccattattttctccgattccttgccagtcgtgttgtgtcagatccatctaggatcgtgtctcgtagccccgacatcaacatatgatcatcgtccgtcgataatgagataacatatgcttgcccgtgataattatgatatggtggtggtgatgttatttctgtcatgcgcacacaatatggcgcctagtgcctttttcttacctggggttcctcgtattccaatggtggagtggaggttgagtagctcatgcgaggaagctgcctgcacggaggagcttgttgatgtaacgttagggcatttacaatgctcctaggtggcgttcagcctcaaaggaagcaatgccattttcagtgccatgtcatctatgtgtgtagccaagcgaggaccgagtgaccaaagttggtcacccgttcttggctgaaaagcctgtcaaatgcagaggagaggagaggagagagagagagcgtgttgggaataaaaatcacaggagagagagagccgccgccgcccgacgccggcgccgctccaagtcgtccgctcgtcggcgccgagatccgcccggccgcctctccgccgggtgccacgccgtggtggaaggctgcctctccgtcccgccgctcgaccgccccctgcctctccgcccggcgtcgtggcccctcgtgccgccggcgaagtcgccgcgggatctgcctcaccgcccgggctgccccgccggccgccgccactgctcgaccaccccgcccgccgccaccgctcacgacgcggaggccggatccgagcgtcggcgcgccggccgcctctccgcctggccggctgtgctccgccgccagccaccgccgctcgaccccgccatcgccgctcagagagctcactagtaccacttgttgagagacagagtagttgtcacaccctgaaaattcaaaatatataaattgttgtttaattggaatttctagaatttattttaaaagtcttgaagagaagatctaagtttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaacctttctctctctcctcggcccagccggcccagtccgcagccgcgcgcgcgcgcgttcggtcgctgacaggtgggtcccacctgtcgggatcgtcgtcctcctccggccgaaaccctagtttcgtcgccgccgccgccgctttccaatccggccgctcctttccttctccggccgaatcaaaagaggggaaatgatcctcgggatctcctctaccttttctcctttggaaacttcggctaaatcggtttggaatgagtttgattcgagttcgaatcggatcggctttcctctctccaagcctgagctttcctttgccgttgccacagccgtgggcctttgccgccgcctccgagcccctttaaaaggctccccggtgtctcctctacccgtcgccaccttcgcgttcgcctctcgtcgtcggaagagccctagcgctgtgtgccctagcttcgccgtcgccgccgtcgctccagccgtgcgccgccgtcgctccagccgtcgccgtcgctcgggaagaccgccgtcgtggtcgccaagtcgccgccgtcctcgtccgcctcttcgctgccgtcggagatcgccggagcttcatcgccgtcgacaacccgaaggtttccgccgtttcctcctcgtcgccgtcgtcgttcgttgttcctccgccgtcgctttggtcgccggtgagttcgccgtgccgtccgctacccgttggtgccttccattcgcgccgccgtgccgtcgttcgccggcgagcatgcaagcccgagccgccgagccgccgccgccagtggtgacgtcatcgctgacgtcatcggggccgttcgctgtgagccggtcgtggaccgatcgatcttggccgtccgatttggatgggttgatctcggccgtccgttcgcgtgaaccgtcgcccgtgcacccggtccaccgaaaccctagcccgctgacgcaataatcctccttttccttttcaaaaataattcattattgcgtcataattcaatttaaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgcttctttttgtttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgtttaccttattccttgataccttgggttattataatttgactagttgagctttatttatattggttcaactagatattagaaataattgcttagccctgcttagaaacattagcacacttatgggataactaatgactcactattatttcatgatggcttattgatagttcacgatggtcaatcgtgattagttaattaattaatgtgccaactaaaacctgataatggtgggttatgagcacatgattttgatggtcgtgctcatgacaattaaggaccggttcacgagtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataagggggtgattatgatccaggaaggtgtgctgcagtggattatgttgtatgagggatactgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataataaatgatgctataactggtaataatgtgattagctcctggtttggaatggtatattcctggtttggagatagaactgtgcagccggggtggttgttcagaatggttgggcctatacaacagggtatgttgtatagcgttggattaatattgtttaatacttaactgttttactaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatttttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccttctaaaaatattggaaaagtagaactgttctcctccctttctcttttaattaaaccaaactaatggcacatgcacttcataaatctcttttaatggttctcattcaaaatttattccagtgttattagtactgtacatctattactgtactaatggcttatttatcagcaaaagttttacaatgttgttttatttaatcttgttgcaataaaataaatttagcatgacgattttataacttgattttatttcttttggaacctgttattcaaaagtacaaaacttgtgaccttgttttcaactatttcaactcatcttgcaagcttggtttactttatttacttactttttatcttgattttctaactttattcaaattaatccaaaaacttgtgctgttaattggatagatgtcttaactccctcctttcacttgtctttagatgccgcgctacaagcctgagtacttgtttggtgttgagggttttgtccaggagttgcgtacgatgtcctttgtcattggatttgggaatgcccctttttatacccagattcctcattatcgtcatgaagagaagtgccgagtcaaagtcaccttgaacagcaatagtgaagaggtcccctcagtgatgttcgaagctggaggaagaaattacatccatgcatgtcaggaggtggcaaggatcgccataggagagctccgtgatcgctacagtgatcagttggccgacactgagtatcgctaccatcctcgtcaacctcagggaagtgaccgtggcagctaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagttagaagacaaggtggatcgtttggagaaggaattagctgcgttgaagggagaagcaccgccgcagaaggccagggttcgtctcaccgcaaggaagagagctctatttgtccctcgctatcaattggcgccaaaggttcgtgtggtggaaaaagaagttgccccaaccctagcagatcctccggtcatcatcataagtgatgatgaagaagaaggatccaagcgcacccgttccaagattgagtgggtagcaactcaagatgatgaagacgagccgaatgagccttcaatcgacctccgatgctcggaagaactagagtgacttgttaagtcgtagtcttagatcgttgtgttagtttgcttgttttaagtttgcttgtgtgtgtctcgcgtgtgatttacatcagtggtgggatgtaagtgcatgcgtttgtttgcttttgagtgttaggaagttggagagtttagtggtgtgagagtcttcagtttgtaataataaaactcagttaagatcaataaaagttaaagtaattctctgtcctaagtagtttcccctggtttctcttcttgtgccctgtccatgccagatggtgaatactcgcagcaacgggaatggtcccaacaatcccaataataacaatggagagaaccccactcttgctcaagttcttgctcaacagactcagcttatgaacatgatgatgcaacaacttcagaatcagcagaaccaaggaaataaccatgtacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtttcatttgcatcgcatcagttgcatggccctgcctttgaatggtgggatcacttccgcctgaataggattactgctgaacctatcacttggcttgaattcgccgctgctttccgaaagacgcatataccatcaggagtagtgtctctcaagaagaaggagttcaggtcgcttactcagggatctcgctctgttacggagtatctgcacgagttcaatcgtcttgctcg

SEQ ID NO: 50737 - DNA, 2210 bp, Oryza sativa
aaaccatctttttcggtcgacccaaatccacaatagttccggttccattaaaaaccgggaggaaaaaggttaataagaggaagatctttagtccctgttgttgttaccaaccgagactaaagatcgatttttagtcccggttatttgaatcgggactaaagatagcgatctttagtcccggattcgtagtcccggttagaaaaccgggactacaagggggttacgaaccgggactaaaaagcacttctccaccagtgggtgttatagctaaaggagccaagtggccagcatgactctaagtggggccaacatgtggagctcgagctagaagatgcatcgaagaggataattaaacttaagctcagactcgctagatagcgtggacctaagctcaaactcgagcgcaaacatgacatctaccgaggtagagccctaagagcagttacaatagtagactattagctagctacaaacatattttaatgagataaaagatgatagagaagagcagcagtctacagatctgtagccagctgcagcacagactccaagatgcaatgtgtgtatgacagtgtgaccatatactaatagtatagtaaacaactattgtatgaattgattgactatagataaattggagctattagttggctatactattaaccttgctctaacacgagcatagtgtcgacggagataaagcttgagcgctaatggtgagcatgatggtgtgggtgaagatcggaaaagcaaaagctttttggagggaaaagaggagcttgagctcacgtatgtactacctaacgagaatactgtggtgagttgctagagacaaataggaaaaatatgattggtctaaattacatgtgtttatgttattacctaacccaaagtaaaaaaatattggcgagatgatggtccaaagttaaacttattacaaccccagttgtaagacaatgtgattttggagtttattttgtggtgtttttttcatcatacttcatttatattatttgcttttgaatcgtcaaaatatgcgtataaaagtttcaccaatacttattatttcttttaataaatcgtacgaataagtacaagcggagcgatagaagtatcttctacacctgctttaacattttccactaccatatcctaaagggaaattttgctataagatactgctattggtgtttttagccttaggacaccgctgaggaaaacattttataatcgtggtattttgccagtacacaccacaccgactaaaataataatttccggttaaagaggagagagaaatcgcgtgaaatgtacaaaaaatacccttgggcccacataccagctctcctatctttatttttcgaagtacctagctcaacgcagactctcacaacacacgctctctgacccctatgaaagcgcggacgcttactagcaggcactcacaacacacgcacactcacccatatgagccattttaaagactgggccatgctaatcccctatgaacgcactcacgcaaacactatccctatgagcatattcgaagactgggtcgggcaaatccactatgaacgcacgcacgcaaaaactacccctatgagcatcttcgaaaactaggccgggcaaatcatggagattgaagaagtcgtcacaggcgcatcgctgtcgacgggtatgtcgcctaccactgaaagcacaatgccgttaaatcatagaaaattcgctcctatgggaagttgaacttaggacctaaggtgctactgaggctataggctctttcgctctcctatcttgtatatgtggggtctacatggctgtgactcgggcgagcggcggcggccagtggtcgagcggtgaggtcgggcggccacggcggacaagatgcggccaatgcctacggtggcgcgaccctacagaggagcagcctgtggtggcacgacatggaggaggaggtggcccttccggaggctgggcgaagcagcggcttggcacagtgtgacgacgttgccccgcgagcggattggcaacgctgcagccggccagatccgcggcgaggcggccggccggtgccggcgtgcggtcgcaggcgtggttggcttgcggcgagcggcaacgacgctgaaaatatcgccatccactccccttccctttttcatttttatttcgttttcttttcttcggtttcttctttcttttcatttaccttt

SEQ ID NO: 50738 - DNA, 882 bp, Oryza sativa
aatagttgcatgtgttggtctagtggagcagatatgcgtgggaatttactactttatcttaaattattttaaatttgcccttagcatttatttttgctgtagatgtcaggaccatgggctcaaataacatttgtttatctttctggtttacaagagagaggtcaaatttggatggatattagtgggtccatagatttgtaaatttaggataaattactttggatgtgttgatagcaaggttactctgggtgtgctgagcttaattcttttgacctgttaaaaagaagccccctgctttgcttttcatctacttatattcgattcaattttatgtaagtatgtaccaatgcatgtttagaactgtagaactaataatatagaattcattctcacaagtatgacaatgcaatttaagcaggggcatatcatggcatcgaagcggatcctcaaggaactaaaggacctgcagaaagatcctccaacatcatgcagtgcaggtatgagaaagatttatcagtggaaccatggctgattggctggtagacagtgtgaacttgaacgttgatatgataatgactctgttggtagtaatccatgttttcatgtctgatggaattgtacaggttgtttataatgggtttccttattattggaatattgcgaactcatccaatggtgtggttgtccatacattaatctttaatttattgtattgtattccatgtttgattcatgccgaaattgaactatcagtgttctgaatgtatagggtttatctagtactcttacaagagaatgcacaatcttgtcagttgcagtcttgatgcctttgtgttgttggttaggcagttgttatgtttgtaatttccaatgagtgaagtg

SEQ ID NO: 50739 - DNA, 7882 bp, Oryza sativa
aaattgcaaagagggacgtacttggaacaaatttgtgatcaatggtgcatttgtttatagagctaaccgtctatgcattccagttggttccgttcgtcttttgttgatacaggaagcgcatggaggagggttgatgggacatttggagctaagaagatggaagatgttttggccttgcatttcttttgaccaaggatgagaaaagatgttgagaggttcgtggcacgttgcaccacttgtcagaaagctcagtctcgtttgaatccacatggtttgtatatgcctcttcctgtaccttctattccttgggcatatatttctatggactttattttgggattgcctagaactaagagggggagggatagcatttttgttgtggtgaatcgtttttctaagatggcacattttataccatgtcataaaagtgatgatgatgttcatattgctgatctgtttttgcatgagattgttcgcttgcatggtatgccttctactattgtttcagatcgtgatgcaaaattcttaagtcatttttggtgcacgctatggaacaagttgggtacaaagctattgttttctacaacatgtcaccgacaaacagatggacaaacggaggtaatcaaccgcactttgggtaccatgttgagggctattttgaagaaaaaattgatgatgtgggaagaatgtttgcctcatgtggagcttgcatagagtcgggcaacacattctactaccaagttaagtccttttcaggtagtgtatggtttcaaccctaatgctcctattgatattttgcctttacctactagtgagagggttcataatgatgctaaggcacgcgctgaatttattttgaaaatgcatgagtcaaccaagctcaacattgaaaagatgactgaaaagtatagaattgctgatagtaaaggtaggcaagaggttaagcttgaaccgggtggtttagtttggttgcacttgagaaaggatagatttccggaattgagaaagtctaagttgatgcctcgtgctgatggtccttttaaaattgttgagaagatgaatgataatgcatataaacttgagttgcctcccgagtttggggttagtcccacgtttaacatttcagatttgaagccatacttgggagaagaggatgagcttgagtcgaggatgacttcaattcaagagggggaggatgatgcgaacatcactacctcggatacacacatcaatcctccaacggtcattcaaggaccgataacaagtgctcgtgtgcgacaattaaatttagaggtgagctcgttcctatgttcttctttgtatgaattcgagaatagattgctacctaatgattatattgtgattaggaacaatggaggggacaaggtgtcgcaactgagaaaattaccttttcccgaacgctagtgtattaatccccgtcccaggaaaagccggggtacaccacacaaacatgatacaaaaggcacatctttattatatcgataatatttacattattacaaaggcacttcaggcctgacatataaaaataaatagcagcggactagcgggcctacggctccatcttcacaggcgctcaactggggtataagccagaactccacctaggacttcttctccaaagcttctcttactgaaggggggggggaaagatagagcaagaatgagtacaaccacagtactcagcaagccacaccggtagatgcatgattaatgcaagggggtacaaggggtaataatataggggttaaattttgcagtaaacagcatttaaaagacacgtagttgctcaaagctactttgtacacacgatcctagagctacacaatatttattaaacaaggccgtgaacccacacgaacccgccttaacccaaggcctacaatgattcagaccgaactggcaacccgaccctgggtcccagctcgtcccaagccaacccaggccaaccattccacattttagttgttaagcaggttttaagaattaaaacactaacttgggtacattgctaggcttgcccatatccgagggcgcggctattcgaatagatttactctgatcagaggtgtacatctttacccacaagacacatcttcctcacgtgtaaccacgtgccacataccaccacggcatacggacgaaagacgtgacatagttcccaacccatcctagccataaacaagagtatcgacccaaccccgcctacggccagaacccccgggataggtaggtaggattgagcccctagcagcaggacaccagccctgtgccatgacatctcgactaccgggacgcagctcgtgtagccttcatctatcctagagatgtccatcgacccccgaattcgtcaatctccatccgtgtacctttgtttataaccagactgagccacaaactgagccttacccactagatatgtggaagtacggtagtgctttgcaacagaggcccgagcttaatccttatagtggccggggtgctacttcccacaactggcatgcacccaaaccccaccggaaaacaggttttaggggttttgaaagagaagagaggtgtatgtcctattccaccataatccaaccattccaaagtgtccaagtgatatgagaattcccaaagtctaaagttataaaaccacctaatgttgcctaattaaccagcgcagcatctacctaagttcatactagtggaaccataaatagagtacccactagttggggttttattttcctagggtgaacaaggtaataataacaatagcaataataataaggccataagaaaggtaaataggcatggctaaataaaacagtgataacgcgggaatttacataaagcgataatgcattaatttaaatcaaaataattttataaactgggattcaatatgctcaaggatgatgtgacttgccttgctcaaagagaatggccttccgaaccttcggcgatgaccacgaaccacgcttcgggaacctccagaacgacgaaagctacgcgaagcacacaagcaaactacaagcctataaagaagcaataacaatacataaaaagaaagcacatggttctttaggttataacaaacattaggagacttgaacgggtcgattcggagttcgtatgaccaagatatgatcatccgaagtttaatgctgttacatggagatttacggattattataattaggttttacaactataaaacatgtgaaagcgctagcctggaaaagacaggaaggctgtgctgttgacatgcggaccccacatgtcaacctaaaggaccacggtagaccgagtacacggagacggtctacgggtcgacggaagcagacgctgtgtgtcaaccgaggcgagtggccgacaaacggactccactagacaccacgcgggctgcacacgtggaaacaacgcggctaccgagcgggcacactaacacggtcaccacacgcacacagggacgactaccgacaccggtacacgggtaccggggccgacatccgcacaacgggcacgggctgacaccgaaaggacgaggacggggcagcgagggagagggatccttacctccatgcgacgaggcgtgggaacgacaacgacgaacgggcgcggcggatacggacgagaacgacggagacgaacggtgaggggacacttcggcggcgatccttggacgaaggcgagacgcggccggcacaaggcttgacgacgcggagccgaggatgaagacgagcacggcttgacggagggacgaacaccacgatgatgaggacgacgaccgggaccggcgaggaggcgacgagggcagccggcagcagctgcacggagacgaggacggcgtgggacacgacggaggtggcacaacgagatgacgagccagcgaggaggaacgaccgaccagaggagtcgtcgacgagtacgaacggagatgacgacaacgaacaccgacaaggctcgggtggaggggaggcgaggccgagggcgaccttgccgctgcgatgccggaggtggtggtggcgcggccgacggcgcacgggtggaggaagggccgaccggggaaattccggcgaggcggatggagaggccggcgcggcacggcagtgttccggcgaaatcgagggcaggccggggtagagggcgatgtggcgacgtcgagggaggatggcgacgacgacagccgccgcaccggcgaggtggcacaggcggctggaggcggtggagtggtggcgacatcactggtcgtcggcgaggaggtggctccgatgttttccctgcgaaacggaggcgacgccggggaagaggaggcggctgctacaccggggaaggcgactgcacggccgaccggcgtgctgacactgcggcaggggcggttggaggtggccggcgctcggagagagagagggaggaggcggggaggggtggtgcggccacgggaagacgcgggaggaggctaaaacgatagaacggagggaggatgctccattttataggcgcggggagggagccgggcatgggagagggcggaacggcgatgggaaacacggccggtggccatggaaagaggttggaaagtccgcggccgttccgggcgatggacggcgccattcaagcggaaaattagggggaattgaagaggaaggaatggggattaattccctccaattaatttggaaagaatggttggatttttcgggaaatggcgctagggttttttgggagagagagaggaggccgggcggctggaggaagaagacgacgaccgccgcgtgtgccccacgcgggcgcgcggtcagcgcgcgtgcaacgcgcgtgcgtacgcgggaggggagcggctcgggtagggggggcgcggcttgggccgggcgatcggcccaggaggagaggagggagaggtggcccgggggagagagggaggaggagggagctgggccgatgggaaggagggaggggcagcccaagagagagagagggaaggaaaaagagagggagaagatggagacttgggccgcaggctgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgcttcgttttgggcccgtgagtacttgatggaaagctctcgaagtcctccttccaacggatccagcatcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagtaggtaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttctttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagcttttgttgctcggtgagtttttatcttcctataaccagaaaatagccatacaaaaaaaattcgtatcattacctagccatactgtgccattgcattgttcttttcagtttttgctttgttgaattttgtgttgcattgtcacgtcgtgttgctggtcttagcgtctagttcgtttagagtttcgagttctggtcacgttttgtaccacagtcgtagctgccaccgtgtctctgttgttgtcgggacctacgaaaacggaatcggctcgctgccacggttctatttttgtagttttcagaagtttctgtcggttagttttggagttcttgagttgcatctagtgtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccagtcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattataattttgggtttagacttttacatttgagtccctataaattttatatttatgtttgagtccctgtaatcttacattaaggtccttgagtcagtttttgttaaaaaaaataagaaaaaaagtgagaaaaaaaaaggcagaaaggtgcaaaaaaaaaagaaaaaaaaagccgcaccaaaaaaaaatcagaaaagaaaaggaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcgttctctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgtgagatttgagctgccagtacctagtagttgataggagcgtgtatattcttgtgtatgtttcttgtttgctgctacccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtgccggttctgcatctttttggtggcatactgtggggaataagcttgaaacttgggatgaatgcaaaatactgatgagaaaaagatttatgttttcatactatagacgtgctctccttgagaaatgggaacatctaaaacaaggtgacaaaactgttagggagtactttcatgattttaaaatttgtatcacttatagtggtttacaagaatctaatgagaacacaatgactagatttttcagagggcttaatttcaatattcaggctgggcttgttaatgtgacatataatcatataggccaattgttcatgctcgcttgcattgttgagcgcaaaattttggagaatccaatggagcaacaagatatgcttgtgcctcctatcactgatgttttgcag

SEQ ID NO: 50740 - DNA, 3987 bp, Oryza sativa
ttcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctaaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaatgaagtagaggagcgtgaattgagatcttctttaaatactttgggctatgttcagtttgatgatttttgtgagctcgataatttcaaggagaaattatttgctaagtctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacgtttttctgtgaagaaggggaggatgatgtgaccatggctactatggatacgaccattgctcatatcatgaatcaacaagaagacatcaagatcaagtcctccatgtgctgcaatctgattcggccacgtgttacattgctgacttcaaacggccgccaaatctacatacgtctccgttttgggcccgtgagtacttgatggaaagctctcgaagtcctccttccaacggatccagcctcatctcggaaatctatctcgtttggccggaatcacaaaagcaaggtactgcatcacctatattgggcctatgggcttgtaacttcatttgggaccctggcccatgtggggcccatgtggggtgcgccccaagttggtggagcacgaccctaggcacccctaggtcgtcctcccacccctatatatagctagttaccccttcagggtttctcgggtttttgttagattaaagtttagccattgctacttgcttgcagcgcgcgtgtcggctagaccgtccgtctgcttgttcttcgaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcaatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcattacaggccgagggagagagagggaggactttgggctgggctcggcccaaaggaggaaggagggtttatttttagtttttctttttagtaaactttgataattgttattgttgcttaataaatattttcggtgctctgaaaattcaagtaaaatttgagggctctttttagaccaagaagaatttgacaaaatttctccgggccacattcgaatttttcttgtacatatttagtgtttgccaatttcatttcgaattttaattaattctattattccttttagagaatgatttttaattcgggatgaatttatcaggacgtgacacaaggagacacttggagaaggacttagagccatggaggatcatcgaggacgtccaagtcaaggtagtggcccaaaccaattcgacctcgggtgcaattcggataccaggaccagtctgcactaaaacgggagcctaggtcgcatacgtgctcggattggggcattctttatatggatggaaagctaagaagataacctttccaatggttttggtcccacatccaaattatttccgagtcaatgggaatcgaccaaacaagttgacattcagaatttgttccggtgctgcgtcaccgtatttgggcctttgggccgtgtatcgtgctggaacccagtagggttgcgtcgagagtgggttgcacgaccctaaactctatatatcagtaccaccaccatctttaggtttttggggtttgcttagattaatctgtcgaggacagtttcatcgctagatcggtttgtaagaccccaactcgtgagcttaatcattcatctgcaattttggttgttttctatttctctcttgtttttgttcttcgattggcaaactgccgggtcccaaaactaatgatttggtaaccgacatgttaaaactgtatcaagccctggatcagtagattgatacaagttcaatattttggatcgtctttgcttacgtttagacatagctttgaaggagatattattacataaagtaatagggtatttacaagattgtggttaactattacagcagaagctttagaatggcctaactctgttgttttgctatagacttaaaccatctatctaatctagacttgagaattaggttgaaatgaaactaacttatatgattgaactcccagcttcggcacaaactccaaatgaactctgaaaaagggggttgaagcaagggtgagtacaacgtactcagcaagctattatatttaatcaacaatgaatgtatgaaataataatatctgtgtaaagctaggtttacttgcaaaaagcagagaatgtagaagtagaaaacctgtaatgttttaaatgcagcagtatttaataaaatttcaaattaggtttctatccaagatgccatagtgagtcccaatgctcgataaccgcgagcacggctatttgaatagttttgaggatattcatactacagtagatgtacgctttacccgcaatccatgacgtgccaaacacattagccttgtcatggcaaagcttttcagttactaacatcagtggtacctgttccatgaactctagtccccatgcactctgaacgtaacgttatcagcagcgagaggagttctggcgttcccgagggctttagagagaactgattgtatgacaccatgtcatcgcaatcagggttcacaaacaatttgtgcacaattcatttcatatatttacctgcgcctcggtaaatatcacaattgcccttcgcggcataaatttgcctcctgcacgaggacttaagaagaaccactatacagaggtaccacttttgctagataacttaatcagctaggtctatgcccatacgagaattgcggtcgtactcatatgttcttcacatgtacttggcagtcttatatcggttggaacagtactagccacccggaaatcaaccatttctaccgtactgtcccaatctaagttcattatattttatgcattctaactaggcagggctaagcaaaagctagcatatatctggtttgctatatattcaggttatgcattcaaaatcatgtatggccaatgcacaagatactggagatatagaatataggattattatgctcaaatgggaggaataataacttgccttgctccaacgcaaacaaatctgagataggcaacctgattatccgatcctcgaaacaccacaggttgccatccaaaagataatagactctactaagaaagacgaagaaccaaattcaataaaaatcatgaaatagcaagaaagtgataaacag

SEQ ID NO: 50741 - DNA, 9939 bp, Oryza sativa
acatttaaataacttaaggaaatccaaataaaatattaaaatagcaaatttggtatcaaaatgtagattttgaatttagatgaatttaagtccaaatttgactgtaatcggatctacggtttaggagatatgggcttctaaataataggttttgaattaaatagagaaaataagaagagacactatgcaggggacccacctgtcagtcttttctttttctttttctttctcttcttcttcttcccgcttcttccttcttcttctcttcagtcgaacagagaggaggaggagaggggcgtcgaggctccggtagtggagaggcagcgacgccggcggccagtggtgttcccgggtacagaacacctagggaaggaagtggtcggcaaagggggttaagggaatggctggaacggcgagcacaagaccgtgaaccgacaggagagagagagcttcggtggggcttgatatgggacgaaagagaaggggaaaagtggaaaaatgggtttgccggagtaaggcaaggttggtggtgagaggatttggttagtggtgctccggtgagagagatcggctgacggtggcggcagccggtcttgaggaagagagagagaaagacagagctcgaagagctcggatggtgtggaggggaaaaggggcgacctcatcatctatttataggccgcggaggtcggttgccgaaggcggttgtagaggcggtcgtcgactcggccacggcgacgctgtcgtgaaggaagaaaagacagtgccagcttccttctctgattggatggcgacggcggcgcgtgcacgtggtggctgccgtatggctgggcggcggcattagagaggcacggcacagcgacgccttggcgtggtcggcaagttgactgcggcggcggcgtggagagaacggcgggcggccggtttcttagcggcgaaggaaggcgttggcggcgtcgtgcgcgtgtgcaacaggcgcacctggaggcggctcggctatgggccgatttgggccggcttgggctgatgggagatgaaaaaggatttcggcccaaagtgaatagaaactgtttctgaattttgaagggggtttgggtaatggaattgaataggatttatatttgaaaagaatttgaataggaaagtttggaaggaaattatatatggatataatttccaaaagagatattttctaatttgagtgcaatatttttggaagtggaatatagtggaatttatatagatgcactcaaatgggggagagagatatatatttgagaatgtgggaggaaaatggagggaatggaataaataaaattttagcccaaaatatgtggtaggaaatctagaattaattatgggctaaaagaggttttggatttgggatggaaggatgaaatatatcttcttagcacaagagcaatatttgcaatatttgtaataatattattcttgtgccgaggaggaaatcaagccacgggaattaaattggcggctagattgaaaggaggaatttggatacttgagatttgtaaagggaactaaggataggtttggaatcaaaggatgggtcgacaattaattccaattaaaattggaatttcaaagagttggtttggagggttttcttggaccataattcatacaaatgaaaagggtttcaactaaatttgaataagaggaattttgtcgaaagaaggttttaatttaaaaccaaatcaagaaacaccttaatttaaccaaatatatctttaaatgaaaaacacaaaagaagttaaataccagagagggattttatgcaaattagttttaggaggtcctactaattatattttcctaggtttaggaagttattaaaaacataagaagcggcatgatgcataattagaaaatagctaattttcagtatgttacacaaacagggattagccttctcagcgaggtcacccacgtttcgacacgggtgataaccagaggagacgtggtgctgcgattgcggggctcaagtgtgtgcgcattcaagaagccggatcgatttgtgtcgcggctccgcccaaatcgttgtttatcagaacctttcggaagatcgggaaccctagtgcacatcactgtcattggctatcgtggccctaggacttcaactcttcttcaagggctcagcagagaaccagccgataccggtaaaaagagaaaaaccaggtcatcggctgcagatccatcggctcaagctccaaagatgaaagtcaagtcaaagaaaacgaagccaactgatgatctgcctgccctagatccatccattgaacaagctctggatgaagaagaaatcggcgaggatgttgaccaagccgcagatgaagtaagcgatactgaaagaactccatcggcttcacctaagtaaactcctcgaactccttctgccctagcccatttttcaagggtaagcaacttcccttgattccttttgtaatcacttcattttatggccgattactcacagattttatagttgcagaagaagaaaactgttgtgaagaagaaatcggcaatagcaattctcaaatcagctccaccagtaagatattcttaactcttccactagttgatctcagcctgattttatctaacacttgtctctttcgtagcctcctcctcctccttctcctgtacaacaatcatagagtgatcaaactccatcggctgtagaaagccaccatattgaagaagaagaacaaccagctgttcctgctatcccagtaagtcttgtctataaaaatcttgaatcggccaaatagctcatgttgatactcaactgttttcaaattccttcttgcaggccttagccgatctgttctctttcgatattaaagactatcttgatgaagaaacagaagaagacaccaccagcaagtctttagttcccttgtccgatgatgtgaagaaaacccttgaagacatctctcatcggctagaggcatcatcactagacaacttggtggtaaactgtgggccgattaggactcggttacacaagatccaacctctaatcccagatgagctagccgatgtcttcacttcagctgtctatcttgagcagcatcaattcaagctggaaaaagccaaattaagactagccgaacgtcgggagcgcaaggacattcaagtcaatcggctgcttgtgcacgaagagaagtccaagcttgatcagctatctgagggcccgatcaagtccaatattgatcggctcgaagcccgtaagattgagctcttggcacaacttgaagaatgcaacgccgagctggatatggaacataaaaagctagccgatctcccaaaatctatcgaagaacagaaggcaagactaaaattggccatcaagaatgttgctgatctcaccaagtctttaaaagtcatccctggaactgacactcaagatgcccaagtaattgaagaagtagaacaaatcaggcaaagggctatttcggctatccagcaatatttgtctcaatgatatcttgtgtaataggtcttagaaatttttgtaatcggctaagaaactttggctctttatcgaacttatcctcataattttatgccgattcaatagaactccatattttgctcaaaaatttgcaattttcatatatgtgcccccctaattttacaatctcaaaagcattgataaaattataacttgaactaagggcgatatgaaaaaatcggccattgtcccatcggcaaaccacaaccggttacgataagaaaaaacaactaagggcgatataacaatatcggccattgtacatcggcaaaccacaaccgagtacaatatgaaaaacaactaagggcgatataacaatatcggtcatctgaaggcgatgtaaacacatcggctatcatgtatcggcaacattagccgatcatgcgttaacccaaacacttgggtaatatttcttcaagtacttgccatttagtgctcgtccataaacttctccatcgagtccttgcaacatgtaagctcccttagacataactctatagatttggaacggtccttcccaattcggtgaccacttgccgaatttgctatcccgactcccaatcggcaaaatcaacttccatacaagttcaccttccgaaatagttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatcattacatatatggcctataaagccttatttctataaacagataaactactagactccatcacaggaactgcctgagcgtaggatgacgtaaaaaccatagttgtcccactctaatagattgttgtcgaaacgacaactgcatacgtcgaaagacgtggttactcaacagtggttggaaaaatgaagtgtactaaattttgaattttacatgggatccccccattacatggccctaggggactatttatagccccattacaggtccttactaccagggtttaggttgtacaggggaatttacatgattacccttaaagaaggggcatttacaggggtacataatgttataggggctcatgggcccctgatgggccgtttggcgatcgccggcctgatgggccggaaaggcttcctcggccctcgcgggggcgaacttgtcaaggcgaagtcatcctccttcggcagacagtcttcgccttgcacccttcgtctgagacgcctctggcctagcgctactcttcgccttgcgctgctctcgctccatagccttcgccatgggtttcggcaggtttcgtcgaagggcctgatgccatccgccaacaagcccctcacgggcaagggtgagactggagcttcggccaagaccgtgcaaaccatgtggtatggtatgcggcgccccctttcgaccgatgctcctaccgaaaccaacattatacctgcgaatgaagattattatttgtgcggctggtattattttgccgcgcttcgcctcgtgcgattgatggttatatatattcttttttcctgggccgaacgaaacagtattgggccttcctttcttgggctttttactgtgctgctcggtcgacaggaatttaccgtttcgcctacccttgcgacacgtggcgctttattactggtgggtaggcgaacggtcgcttgagcgggctatatattcctgttgctctatccttttcaccgccacacttgccattttaccgtgcgcgctctctttctccatctcttcctttcacagcgtctttcgacccctcaggcgtttcgccgaatctcttttttcgccaccgcaaacgcaccgttcgccatggctccacgtaagccaaaccctacttcggtgaaagggccggatcccggccgagtcgatgacgacagcaccgcctttctgggggtctctcttgtggacgacgtcgagctagcgaagctggtcagctccggagggttggttgaggggcaggctttcgccctagggaaaaccgtggtgccgaaacctgtcgacaaccggacggtggtgttcgccgtattttttgaggcagggctacggtttccctgcaacgtgttgttgccggagatccttcgcctctttgaggtggaacttccacagctgagcccgttagcgcttgttcagatcgctatcttcgactgggcgtgccggacttccgagtttgagcccaacgccgagctctttggcgccatatttttcgccaccgtgaactcgaagaaggtaatcaccctggctggaacgaaaaaaaccgtgttcgggagcgtgaacttcaacgttcgccccgagcggtccgatctctggccggtgaacgctgctatgtcgaagtgggaccgccattggatggcgaggtggttctaccacaccatccctttcgaggctggttctgaatcagcgaaagccctccggtgccggcgtagggtgattgcgccgaaccggagacccaagatcgctgtggacggcgccatggaggcgcggttcgttctactgcggaaggtttgctcccgccttagctgccgtgacttggtggaggaattttgtatgcttcgcatttttcccctctcccagtcatggcaagtcgcggttgaacaaggcgaagaagtcaacggtttgccgaacctgatactccctgaggggcgaacagtaagactgttctattgctatatactgctgtgctttgttatttcgccttatttgacttttgacgtagcttcacgctctacttttacagtgttgaccctcgaccaggccgaagtcgaagcccgcaggatgatcggcgatgtttcggtcatcgagtatagtcagctgttaacgcgtcaagcggctgggcgggcgaaccgggtttacaatggcgaactgcctccccgggcgaatccccaaaaggccgacgacgaggcagggccttcgtgaaagcggatgcgtggacaagtgaagcttgcccccaagaagcgaagggttcctgcttcgtctgactccgacaccgacaacgaggatgatgccgaagaacgtgacggcgaggaggaaggagaggaagaggaggaggtggaggctgtggctgataaggccgcgggtgaggcggtcgaagaccgcgccgacacccccgggtacactcctaccccaagtcctagtcacaacgaaaccggggtgagtcgaacagctccccccttcgtcagaaggatttggaaggggcgaaggccctagttgcgttctcttcgggcgcgtcggcgaagggaggtcctgtcaagaaggtggctaaaaagaaagggctcgtcaatgtcgctcgcgtttttagcaacgacgagtcctccgacgggactccgacttcacccgctggtcgcagcctggatctttcggccgcccccattcctccacttggcgccgctagagtggacggtagtaccgccgctggggcttcggcttctgcggaaaggattgtgatggccgcggcgaaagtattcggcagtcctccgcatcagccggttgcctcgccgctgatggaggcgaagggaaagagagcggttgctgagatgtccgcttcggaatattcgctctcggtaccccgcttcgcccctggcgacttcgagacgcgagcggacctccttccttttgtggaaggggtaagcaatcttgtactgcctgccagcgccccgagcttgttcaccgaactgaatgagttcgacgaggggtgctctgctataaaaagcctggctgttcgggtacgtttcccccccccctttttatctttactcttcctctatcttgtttttacaattgacacttgttctcttcgccgctcgtattctgcgcccagatcctcgcggctcagtgctcaacagagcgaaccgtgcgagctcgacttgatgggttcaaaagccgtcttcgggccaaggacgacgaactaggccgcaaaaatttggacatggaggcccttggcaacacccttagggaggcgaaggccgaaagcaagcggcttcaatcggaactagagaaagggaaggaagctagggccgaagtcgatcgcttaaaggccgaactggagaaagagaaggcccacaccgccatgctcatagattattataacctcaccgagccgaagatggaggctctttggcaggaggttcggaaggccgaagcaagcgccgcagaggagtcgcggcggttttcgcgggagatggtgaaaaccaccgagtccgcgcggacagcgtgccaaacgcttcgccttgcccttactgatatgggcgcgaaggtgcgggatgtcccctccgaagatgccttagcctttgacttctccgaatggacccaacaggctggtggttcggtttcggactgcgccaccgcatacggcgattgctgtgcacgcgtgtcagcggcctttaccatgggcctcctgcagcagttcttagattttcatagggggtggaggcgatgcccaggatcacccagaggtgtgaggccctccgcccttctcttagattttcatagttttcttttggtgttcgctagatgtggcgaaccattgtatattcggcaaactgccgctaaaccttaaaaaaaaaaaagcttttttgcatacttggactgtatgataattttaaccactttttaacgattaaagtctttggcatattattatttcactcattttgcattatgccataccttccccttctttcgcctattcttaccatgcaagatgtgttttgccttttctgcactgtctaccagggggtctgccgaaaatcatgcattcgggccccttctgggagctggcgaattcaaaacgagaaatttgtggcattgaagggtttgccgaaggtgcgatgtccatttcgacctgtttatcgcgaaatggaaataaacggtcgtagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcgtcgttacagtttagtctgtgtttcgcccccttctcctcttaaggttgtgtatgacattagtagtgatgacgaacctagttcatccgaccattccttagggagggataatgattactggggcgaaaatgtaatttacttgtaaaatgaattgtatcgggttgtaaaccttgtactcttcgattatttttttgaagctaataaagagcgtgctttatttccttttcgctatttttcgcatcgtcacactttgtgcttttgttaggtcggaacatgctggcccctttgcatatagtagcgaaataggtgtagtgacttttcagcttttcgttgttcgtttttgatctgtagcgttctgtgtcgagagaaacgcttttgcttttatgctgatcggtcgtaacgtcgtttggctatttattttccaagacaagctgttgcggtttcaacgttcggcgagcaatgcttcggcagattcgtttcgcccccctggcctttttcgctgatcaggcgtttgccttggggtttttcaacaaattatcaatcacacgaaaagaaataaaaagaaggcggaggagacagagattttatactggttcgggcctccatggtggataatagccctacatccagttttttttctcttttttccttttttttcttgccgaaaggcttacatagtgccaaaaggcttacatgataatatgtacatttttacaagttggcgatttgggtgccacccattctagacatagagcgcttgagggaggcggcgttccaggaatggtcgaactcctcgccctttgagtgtcgctaggcgaaaagatcccgtcctggacttgtgtttgatgatgtatggtccttcccactttggttcaagcttgccaaccgctactgggtt

SEQ ID NO: 50742 - DNA, 4111 bp, Oryza sativa
atatgggggacgtggatgtatcgatggtgttgatgtcctcatcacttagcaacatcatcacgcaaaatatcttcagagacatgggatgcaacacaattttcttatcatggtacagaaaagagtactggtttgacctaccatgatgcatagaatccctatcaaattgccatggtctacctagtagaatattacatgcttgcatgggcacaacatcacattcaacaacatcatggtaatttccaattgcaaaattaatgtgcaccagttttgttaccttcgccttaccactgttgttcagccattgtatggatgtgggtgcggtttggtgctaagtgcaagcttctccaccatctcgctgctagccaagttgttgcagctacctccatcaatgatcatgcggcaacaacgctctttgacgacacactttgtttggaacaacgtgtgtcgctgattttgctcccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcatttggcctatggatgccattgaagaagcactcggtgctggctgagcagcctttgtcgctgacttgtcactagatggaggaggtgctgctcgactggttgtgggtgtggaagatagagaagcaatacggccggccggaggagtggtgcgttgccatgatgaagttttacctgtagaaaaattagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaacctattcagcatgtcacatgcatcgtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaagaaattcatggcatgcaaatttttggtcaacagcaatctcccaagagaggtacgcatcaggatcatattttccatcaaaggaggaatcttaaatttaattttagaaaaagcatcatcattgttgcgtacctcgcgtcggcggcgaccacccatacctcgtcgattgttgtgtagccgtcgacgatcttgagcatctcgatcatcttgttcagtgtcagcaatatattcatcctctaaattatcctcgacgtactctccgtcaatgtcatcgtcattacccccaccattgcctccagcattgagagcatcaaaatgcctcacaagagcagcaaggctagtgtcaatgcgggcgaccgctgtctccaaccctgtaagcttagtgtttgtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacccacaagttagcaaccgtggaacgaggtgtatcggtgctgtagcaacaagaccagtcaagctgtagtcgggtttgtggtggagctgtttgtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtggaaggtggtgacaaagggggaatggtggggtgtgctcactggatcctctttttttttttgcttgctctctctagtgctgaggagagagacacaactttttttttattattattttgatatttttttcacaaccaggagcacactagaaccaaccacagaaaatcttatctcaaacggacaaagtatgaagcttgtagaattttttcaaagttgtatgcgaataggtcccgaagcttctcgccacaaaaacagaattttgcaagaggaatttggcgattttaaatttgccgaacccgacgtagcggggagaatcggatgtaactttttttgtagatgtccgtggatatattataagcctaatttcgagtccgtatgaaaaagatatgactgttttaaggaaggtcactcgaatcagggttctatttcctttctagtggcggcaggatacatggcaactcacaaaagctatcggcaacagatcaaacacaaatagaaagtgatttggtgggtgactgcgatggtggtgacggtggtgatgacgcaaaattgatgaaggtggcgatgtgcggtggtggcaagaactggaaactctaatcgcctaacactaagaccagcaaattaacacaaccgatgcaatcgaaaactcaacaagacttaactaagcagtactagtaaaaaggcacaattgtctataggatcacgggaaaactaatctactattttttttggacttttctggactataggaaaaaaaattaatgacgaagggaagggtaaattctctcaccgatgaaccacgctctgataccacctgatgcgaacccgctagggtttgtggcccgatctttcgatgagaggtaagggataactcaattagatgaagacgacgttcacgacccgactacaactgtccaaagacgctgggccttagcaaccgatacaccgtctccaatggtcgccgcgaacttgtggtgcgcgtcaacccggccacgagggcactcgtcctgcaagcaatcgaagaacaagcaagaacaagtaggacaagcattgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttctttgtggcgactagaggtataagaagaggggaagaacgaccatagggtcgtgctcctaccctaggacgcgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacacccaaatcggagttcgcatgaagtcgtggcggccatcagaagttggcgctgccctacagtccgaatccaccccgcgcgaatcctcttccctttgggtcctctccatcgttcctagtaaaacacgagtgcacgcgtctccggggtataaagacgaggaatatgaactcaagaaagaactcacctgataatttagttgacgtgcacgagcgcgggtaataggaccatcatgttgtacatggggggacgtggatgtatcgatggtgttgatgtcctcatcacagcccataatcgcgggcatggctattcgaatagttttactctgatcagaggtgtacaactgtacccacaagacacagccccacgaca

SEQ ID NO: 50743 - DNA, 15771 bp, Oryza sativa
caatccctagttcaatatctagtcatgttatatcccaagctaacaaaggagcatggtacaaaaatagcatggctataagagaaggtaaacatcccatggtatcattgtaaaacaatgcaatatttgaaggaaaacaatagaacatttacaatataggatcaacatgttcaagtgacaagcatgacttgccttgctctgctgctggaggaacctcggcgactaattcaaagtacaccggagcgtcgggagagccggaatctaagcgtcatacaaagcaaacaatacaaacagactataagactactgaaacagagaacaaaaccatttttactggattctatgcatttttcttgatttactgagacttgaatgggcttaaacagagctcggatgaattttctatgaattttagcagattcccggggagagagacgcggcgccgacatgcgggccccacatggcagtgactcggggggcggtccgcggtggactgggtccacggaccgggtaagggacggcgcaccatgtggtgcacacgtggcgccgacgcggcgcacacgtggcggccacatggcagccacgcgggcggcgggattggatggccccgatctaccctcgcgacgggagcgcgtggccggcgcgcacgggcggctcatgccggcttggtggccatggcgcacggcggctcgactcgacatagcggcggtgcaaggcggcgaccggctggcggcggagggcggcggcgtcgcggcgacgcggatggtgatagcggcggctaagcggctaggcggcggcgcggcggctaagcggcgcgggagagagggagaaaggggaggaggtgcctcaccgacggcgattgacgacggcgagcgacggaggacgatgacgacagcgggacgagctccggaaccacctagcgaacacgatgaaaggggttagagagagagaggaagatggaagagagcgagaacgccggccgaaggcggcggccatggtggtgctcaccggcgcacggtgcggagtgggttccggcggtggattccgacggaggaggggtggacgggatgatccacacgacggcgaacgcgacggcgtcgacggcgcgactcggcatagcggctagcggcgaccggagcagcggcggcagcggcggcggggaggagggcgacggcgctagggtggtggagtgcacgggagcgggcgattgcaaaacgaaaaagagagaggagggaacgggggtgctttatatagactcacgagggttgatcgtggccggggagaccgcgatttcgccagcgtagtggggagaggtggggaggagagagaggcgggattcaaaaattgaatctcggccgtctcgagcacgagagcaggcaggagagagagggagtgggcgcggggaaggcgggcgcgggcggcgacgtgggcgatgtggcccgggagatgcaggagcgagcggggcggcggttgcgggatgcggcggcgccagctggaggtgggagacgggcccgacaggtgggccccacctgtcggcgacccaaagggggagggaggcgaccggctgagctgagcctcggcctttggccggcctagtggggagggggagaggaagagaatgggccggcggcccattcgaaaaggaaagaaaaagagggaaaaagaaagaaaaggaaggaaatgaatttccagggaattaaatattgcttgtgctcatttttaattggttaaaattatttctagagctctgaaaattccactaaaaatcttcttaacgtatttcgacatgtagaactgaagaaaaatcccacatgccagttccgattattatttgcattaattcctttagggtttctctcttgcttttacaccgatattttcttgagaccatttataaattcaatttaggcttgggaaaagaacttcagggagtgacaattcagaaccaagttgatagagctgttgaaggaattcagagattgcttatcttgggagtattatgagatgcccggactcagccgatcgattgttgaacatcggctacttatgtcacgtcccaaaacgactctaaaatatatcctttaaattatgcctagaataattaaaatccttgtggaagcctccaaaaattaaaatgtgcaaagttaaaagtcaaataaggcttggaggatttttgtatatttcctaaaagcctaaaatgtgtaaataaatttcagtggaattttccgagcgcaaataacaattatcaagaaataaacaaagttgaaaaggctttatgaaaagaaaaaccctaaaaccctctcccctctctcttgggccgaattcagcccaactccatccccttctctctcctctcgccgcagcccactcggcttcccctcccttcccgcgtgcgcgccgctgacgggcgggcccgcccgccaccctcgctgacgggaaggggcccacccgtcatccccctcctcccgccgctccgtcactccctctgcccgcgcctagcgccgccgccgctgcaaatcccgccgcccccgaccgttcccgcgtgccattaagtggggggaaatattccccgtgattccctctccctttccccccattttcccccctctctcccgcaaatctcgccggcgccattgatgccgaccgggacccccgcgccggtttccttccccgccgtccaccctctctcactcccaaacctatataaaccctccccgcaccttccttgtcagtttccgccgtttgccgcccctcctccccattggattcgcgcccgcgccatcgtcctctctctctgccattgccgtcgacctccggctgggcccagccgctcgccaggaccatcccccgcctcggcgtcgtctcctccggcttcgccgcaccaccgccgaccccatccaccgcctcgccgagctcgccgaccgccgaaacgctgccgtccccgtcgacccgagccgcaccaccgcctccctccactccggtcgcctcctccgtcgccgtcgtcgccccgtggaccgccgcctctttcccccttcccttactctctctcggccgccgctgggccgcgcctatggccaccgccggcgaccataggggcgcaggcgccgcctcccgccggccgcgctgacgtggccgcctccgggcgcgccgtgtggccgccgcgtggggcccagccgtctgccgcccgtgccctcgggtacggctgacgcgtggggcccacggcgccggctggtgagcagcgagtgcacccggtccaccgtggaccgaggagctgctgcgtgggacccaccactcccgtggacccggtgcacgcaccccctcccctcggttgacgcaataaaccctatttttaattaaaatttaaatgaagaaattcgcaaatattcacattaagagcatataaacttcaaatggccatatctttgccgtttgaactcggaattggaacgttcaagtctctaacttttccttaagaagtcaggaacctatttttgtgctttgtttctgcttgttatatggattttattagagtaaaagcctttttctttccattggtcatgtagacgctgcagcttcggaagatccgctctacgtggagcttgaagctgatgtttgggaaagcgagcaaggcaagtcacatcatccttgaacatattgaatcccaggttataaaattagtttggtttaaattactgcattatcgctttatttaaattcccgcgttatcactgttttatttagccatgcctatttacctttgttatgaccttattattattgctattgttattattaccttgttcaccctaggataaacaaaaccctaactagtgggtaccctattcatggttccactagtatgaatttagctagctgcttcgctgattaattaggcaacattaggtggttttataaccttagtctttgggaatgctcatatcatttggacattatggaatggttggattattggaaatagacacacacacctgggtttagcctgggctcgaggtgcatggttttgatagtagcacctcggccactacaaggaccagtcttcgggcctctgttacaaagcactaccgtacttccacatgtctagtgggtaaggcttagtttgtggctctgtctggtcatgggcaaaagtacacggatagagatggacatctctagggcaaatgagggctacacgagctgcggctcggtagtcgagatgtcatgccacagggccggtgtcctgctgctaggggctcaaccttggttacctttctcgggaatcccggccgtagccagggttgggtcggtactcttgtttatggctaggatgggttgggaactatgtcacgtcttgcgtccgtatgccgtggtggtatgtggcacatggttacacgtgaggaagatgtgtcttgtgggtaaagatatacacctctgatcagagtataatctattcgaatagccgcgccctcggttatgggcaagcctagcaatgtacccaagttagtgttttaattcttaaaacctgcttaacaactaaaatgttgaatggttggcctgggttggcttgggacgagctgggacctgggtctggttgccagttcggtctgaatcatcgtaggccttgggttaaggcaggttcgtgcgggttcacggccttgattaataacattgtgtagctctagaatcgtctttacaaaatagcttcgggcatctaagtgacttttaaatgctgtttactgcaaaccctaacccctttattataactcccttgtactcctttgcatttattctgcattcgtgggtgtgtcttgttgagtacgatggttgtactcaatcttgctcaatttttccccaacccagaagaggagttcctggaggatgaaggctttggtgtctagctcgtgcctgtcgtcaagtgcctatggtcgtcaccctagtcttccgctgttttccgtttatcttcgtgtgtgctgggccttcatcgcccatgtaataaattaactatttatgcttccgcttgttaaactctgaattgtatcaacttttgatgtaccttgcctcctgggacaaggaacaatacacgcacgtatggaatgcccgttgggttaattccggtcgtgacaacctatcaaaccaggggttaggccacaccaacaacctcctagaagatgcaaagccgatatgcttgaacctgtcaaggctgagattaaacggttatatgatgctggttttattcgtccttgccgatatgcctagtgggtttctagtatagttcctgttatcaagaagaacagcaaggtgagggtgtgcattgacttcagagatttacataaagctaccccaaaggacgagtatccaatgccagtagctgatcagctggttgatgctgcctcaggacacaagattttaagttttatcgatggtaatataggatacaatcaaatctttatggccgaagaagatatccataagacagtttttaggtgtcctagtgcaatcggcttgtttgagtgggttgtaatgagttttggcttgacaagtgctggggggctacatatcaaagagccatgaattatatatatcatgatctgatcggctggttggtcgaggtctacattgatgatgtggttgttaaatctaaagagatagaagaccacatagctgatttgaggaaggtttttgagagaaccaggaaatatggcctgaagatgaacccgacaaaatgtgcttttggcgtatcagctggccagttcttgaggtttcttgttcatgagagggggatcgaggtaactcaaaggagtgttaatgcaatcaagaagattcagcctccggagaacaagacagagttacaggagatgatcggcaagataaattttgttaggaggtttatttctaatttatctggacggttagagccttttacaccattattaatattgaaagccgatcaaaagtttacttggagggcagagcaatagaaagctttggataatattaagaaatatcttagctctcctccaattttgattcctccacagaaggggacaccttttaggttatatctgtcggccggtgagaagtcaatcggctcggtctggattcatgagctcgaagggaaagaaagagttgtattctacttgagtcatcggctcttggatgcagagactagatattctcctgtggagaagttgtgcttgtgcttatatttttcatgtacaaggttaaggcattatctattgtccaacgaatgcactgtcatatgcaaagccgatgtcgttaaatacatgttatcggctccaattttgaaaggaagggttggaaagtggatattttccttaactgagtttgaccttcggtatgagtcattgaaggcggtcaaagggcaagctatagccgattttattgtagaacatcgtgatgattcaatcggctcggttgagattgttccatgaactttattctttgatgggtcagtatgcactcatggttgtggcatcggcttggttataatttcccctcaggaggcacgttttgagtttgcttatactatcaaaccttatgcaaccaacaattaagctaagtatgaggtagttcttaaagggttgcaattgctcaaggaagttgaaaccgatgctattgaaattatgggggattctttgctagtaatcagtcaattggcaggaaaatatgaatgcaagaatgatacattaatggtttataatgagaagtgccaagaactaatgagggaatttcggctggttactttgaggcatatatctctcgagagcaaaatattgaagctaatgatttggcccaaggggcatcagggtataagccgatgatcaaagatgttaaggttgtagttgctgtaataacagcctatgattggagatatgatgtgcatcaatatttacagaatcgatctcagtcggcttctcggaaattgagatataaggcgttaaagtatacttttttggttgacgaactctattatcggacgattgatggggtgttgcttaagtgtttgagtgccgatcaggctaaggttgcaatcggcgaagttcatgaagggatttgcggcactcatcaatcggctcataagatgaagtggttgcttcgacgtgcagggtatttttggccaacaatgctagaggattgtttcaaatattacaaagggtgtcaagattgtcagaaatttggagcaattcagagggcaccggcgtcagctatgaatcctatcattaagccatggccatttagaggttggggaattgatatgatcggcatgattaatccaccatcgagtaaaggacataagtttatattggtggcaaccgattattttaccaagtgggtggaggcgattcctttgaagaaggttgattctggggatgctatacaatttgtttaagaacatataatctatcgatttggtattcctcaaacgtaacagccctaaaatttgacaactttttaaaaccgatttagtttgctttaatcttctaaaaaaaataaccgtcgagttagtagttcatttaaaatattattttccatgtttgtattcgacgtttcttttctcatttgattttgtcgcaaagtgcatatcatccctcaaataattcctttgatctgatttaattctatcccgaatatcggaccatctaaattccacaccaattcaaatcctatctattttaatcttccccaaattttccttttctctatttccaccttaattttatttttccatattttttttcctttttctatttttgttccctctccttccctttctttgtttttcttttctttcttcttcctctactcggctaggccgagccaggcgaagccagcccgatgcaagccgcgctcgagctgcctcacgccaaccctgtgccgcctcgcgccgcgctcgcgctgagctcatgccgccccgcgcgcgccacacgcccgcacacgctcgcacgaggacgaacgacgaatgaatgccgccgcgacacctccatcttcccgcttctgtaactccttcgtctctcaactagaaggctcaagactggaggcaaaagaagcgcattttcaacctctttcacctcatcaagtccgcccctacttccgctgaatcaaatcgtcatcaccggaggaaaaatccccgaaaccctaaatttgcaccattgatagagctcccaaattcgtcacatacattgcaaatcctctgaaattgaaggtaaaaacggattctccatgccgagtactccctttcccctctctttccccatccaatccgtcgccggaatgccaccggtgccgcctcccggcgtcgccctctgttcggccgccgccagccgtacggcgcgccgccgctcccgaccgccccaggccgagttgccgccaccaccgcgctccccttccttccctgatgcttaccaggcccgttgccctcaccggagttcgccggaaccaccgccaccatggccgccgccgcctccagctcctggccgccgtcgccagcctcgccgccgctgcctgcgccgccaccaaccatgggaacggagtcgctgcaccctgtagatcgcaaaactggcgcccctttgcccaaaaccggccatctccaccactgacgccatggagtggtcggccgttcctgtgcagaacgagaagaagaagaaaaatccgattttcctattgaaaaataaatcagaaaaatcctttttcttattctatcaagttgaccatccgtttgtcctcgaaatcgaaatccgacacctattccaaactcctagaattattccgaatccatccgtgtcagtttcgttgtaatccgagcacccgttgtcgcgaccctaattttagccatagggttcgccgttcaccgaaattccaaaaaaatccctaaaattatttctttaaatccttttcacccattgttgcactttgtgatactattttcttttgtttatcttttttttctgttatttattgtggtgatgattgttgcgtcaatagaaaacgctgacgttggtccggtagtcgaagcgagtgaaatctccacggtaggaggagacggtttgtacgactacatcgagcccgaaggttgaaagacatgcaccctcctttgaacaatttaatcccagtagttagagagttattttggtagcgtacttgtcctttggagtacgatagactgcacgaattcttttaaattaattatattgcaattattgcattatatttttctgttgtttttataaataccttaatgagccttagagtctaacaaacttaggataaattttgataaacacttaaacaaatggttaattatttaacatgctattgatttaatatggatattattattgcatatgaaaacatacttatggaactatttatggctatatgctaagagctgttgacaccgcatgtgagcaggtggtacacatgatagagttcatgtgtttggttttatggacctgtttatggtcgtgatggatatatgtatatatttatggttatttcttatttaaaattgatataataatcaaccaccttgtgtcaataagaatgacatagttggccacacgatcgatttgtcgaacctggccgtatattgctccaattgattgaacttctgtaggcctttcggtgtactggccattagctttcaagtgtatgaagcaaagtgacatggttcatgtttatatgatttatatatgtgggcttgatgggccccgagaattcagaactaccctatgggtccatgaagttctgggctgcccatcgagtaacaaacaatggtaagtggatgcggaggtaggttggcacacacctcggaccggatcactccgagcaacatcccgagcatcctttaacttactaggcagaagggagagatatatggagcaatattacaccttgttacttttcagcccggccagctgtgggtatcgtgtgggtaaagctaggcagacgctgcagagtcgttgagtattcgtatacgccgtgctctcggttaatggagatgtgtctatgggtgattccagattatgggcacaagttaaactaaatggctactaattaatatggttaacttatttattatttgatgttctatttaagttatctataagtaagatttgtattttttttatgctcgttattattgtttaaattaaatgttcaatagtgttgtttatattaaatgtttattaagttagcctctaagaaataactgttaaggttagggtttaaaccttccagctctcaatactgcatgtttatcataagcatgtcttgctgagtaccatttgtactcataaatgggttcagatcatgaagaggaagatgcatgtggagaacctgttgatctgtgttggcggatggcatgaggccctgcgaccaaacctgccgaaacccatggcgaaggctatggagcgagagcggcgcaaggcgaagagtagcgccaggccagaggcgtctcaggcgaagggtgcaaggcgaagactgtctgccgaaggaggatgacttcgccttgacaagttcgcccccgcgagggccgaggaaacctttccggcccatcaggccggcgatcgccagacggcccatcaggggcccatgagcccctataacattatgtacccctgtaaatgccccttctgtaagggtaatcatgtaaattcccctgtacaacctaaaccctggtagtaaggacctgtaatggggctataaatagtctcctagggccatgtaatggggggatcccaagtaaaattcaaaatttagtacacttcatttttccaaccactgttgagtaaccacgtctttcgacgtatgcagttttcgtttcgacaacagctggcgccgaccgtggggactccgagcgaaaccactgagagcgaatgccaccgaagagggtcgtgaaggagaaggttgccaggcggaaggagagcgacgccggaccagacatggccgccgaggaaggagcagagccttcggcgcccgtggccgaagctggaggagcacaagcgccatcacaaccgccttcggcccctgcaacctcggtgcacgtgccgaacgaggccgacgtggcaaaggcggctgcggcggcaagggcactccagaccagggcggagatcctttcgacaagccaaccggtggtgccccaggcagctccatcacagccggcagctaccacaaccgcgctcaccgttgtacagtcccaaaccagccttgaccccgaagcacaagccgaagccgacatggaagccatgcggcagaacatgacacggctccaagacatgcttcgccaaatgcaagaacaacaacaagcatacgaggcggcaaggcgggtcaaggccacgtcggctccaatccttcagtattcggcaggctatgtcccacatcaagtccatccgcaagtgacgacccagccctttccgccacaagccgcacaggcgccggtgtagttcgccgggcagcatcaaccaactggccaagtgccacaaacagtggcggaagggacttcggctctgcaggcgcaactccaagctttccttcagcaactcaaccaaccccactacatttcaagtacaaccccatcggttcacccggtggggaatacaagtcaaggtgcgcctacttggttgccatcgattcagtcaggctcgggagcttcgccgtggaatcagggactgtagttcgactgcgccaacgttgctcaggcgccaaccgttcggcagcaagctccgaccccaggcttcggaacaaaccaagcaccaatccaagctgctatgacgtggtcgcagccaatttttgacccatccatggcggctcagcaagtgcctccagttggagccgggcagccgaacgccatggcccaacctcacgcacaagctgcgatttcgcccttcaccagaccgtacccgcagcaaggtgcggtaaacagggcgggaggcgaaaaggggctaccgctgagtgggggaatcaagactcatccaatcccaccccagttcaagttcccacccgtcccgcgctattcaggcgaaactgacccgaaggagttcctctccatctacgagtcagcgatcgaagcggctcatggtgacgaaaataccaaggcgaaggtaatacatctcgctctagacggcatcgcccgttcttggtatttcaatttaccagccaatagcatttactcatgggagcaattgcgcgatgtttttgtccttaactttcgaggcacctacgaggagccgaaggcgcaacaacacctactcggcattcgccaaaggccggggaagtcgataagggagtacatgagtcgcttctcgcaagcccggtgccaagttcaagacataaccgaggcgtcggtcataaacgccgcatcggctggtctgcttgagggcgaactaacgagaaaaatcgccaacaaggagccgcagacgctcgaacacctacttcgcattattgacgggttcgcaaggggtgaggaggattctaggcgacgacaagctatacaagctgagtatgataaaggctccgtcgccgctgctcaagctcaagcgcaagttcaaattgccgaaccacctcccctctctgttcgccagtctcagccggcgatccagggacagccaccaaggcaaggccaagcccccatgacttggagaaagttcagaacagatcgagcgggcaaggctgtgatggctgtcgaagaagtgcaagccctccgcaaggagttcgacgcccagcaaacaagcaaccatcagcagctagcccgcaagaaggtccgaaaagacctctactgcgcctttcacggacgctcttcgcacaccacagagcaatgccgaaacattaggcaacatggcaacgcgtaagacccaaggccgcagcagggagcaactgtcgaagcaccccgtgaagcagtccaggagcaaacacccccagccgaacaacgccaagatacacaacgaagggtaatccaagtgattaaaagagccgacccgccaagccagttgtcgaaatggtagagaaagatgcagatccgcatggtccacagcatcacttcggcgggtgagggggcgccacagtacgtgaaccagctgatctctttcgggccagaagacgccgaaggagtcctgttcccgcatcaagatccactggtgatctcagctgagatagccggttttgaagttcgatgaatcctggtcgatggagggagttcggtcgacgtgatcttccccgaagcatatgctaagatgggcttgccaacccaagctcttacaccggcacaaacgtcgctccgggggttcagcggagaggcagtgcaagttcttggccaagcacttttgctgatagctttcggctcgggagaaaacaggcgcgaagagcaaatactgttcgacgtcgtcaacatcccatacaactacaatgccatcttcggccgtgcaaccctgaacaagttcgaagccatttcccaccacaattatctcaagctcaagatgcctggcccaaaaggggtgatagtagtcaaggggcttcagcattcggccgcttcaaaactcaatctagccataatcaacagagcagtgcacaatgttgagaccgaaccgcatgagcggccgaagcacacgccgaagcccacccctcacggcaaggtaacgaaagtgcagattgatgatgccgaccccacaaaactcgtatcactggggggcgacatgggcgaagaagaagttgagagcatactagaggtgctcaaaaagaacatcgatatcttcgcctggagccctgacgaggtggggggcgtcccggcggatctcatcatgcatcacctagcagtcaagccggatattaagccaagaaaataaaagttgcgcaagatgtctgccgatcgccaagaagcggtgaaggccgaagtacaaaaattactccgggcgggggttatccaagagattgatgatccggagtggttggcgaatccagtgctggtgcggaagtcaaacggcaaatggcgcatgtgtgtcgatttcacagatctgaacaaggcgtgtccgaaagacgatttccccttgccgcgaatcgaccagctcgtggattcaacagctggatgtgagctcatgagtttcctggatgcatattccggttaccaccagatccacatgaactcgctcgacatccccaaaatgtccttcatcactctattcggcacattttgaagccttcgtcaaaatgaagcctccgtcaagcgtacatgaagtacaaaagcttgcaggagctaaagcaatacttgcaaagcccaccagctctgaaaagcccacccctaggaagcgaactgctattatacttggcagcttcgccagtggcagtcagtgctgcactcgtccaagaaacagagtctggacagaaaccggtctacttcgtctccgaagcactgcaaggagcgaagacaaggtacattgaaatggaaaagcttgcttacgctctagtaatggcttcgcgcaagctcaagaactacttccaggcccacaaagtcatagtcccatcacagtaccccttgggcgaaatactccgatgcaaggaagtcactggccggctcagcaagtgggcggcagagctatgcccgttcgacatgcattttgttgcacgctctgctatcaagtctcaagtgctagctgactttgtagctgaatggacaccggtacttgcccccgaccccgagcccgacgaccagttctgggtgatgtgctctgacagttcgtggtcgcacaagggggcaggcgttgcggcagtcctcttttcgccgaatggtgtgccgattcggtacgcagcgagattgcagttcgacacaaccaacaatgcagcggaatacgaagccgttctccttggcctaagaaaggcgaaagcactgggagtccggcgcctactaattcgaactgactccaagttggtagcaggccatgttgacaaatccttcgaggcaaaagaagagggaatgaagaggtatctggaggctgttcggtccataaaaaatgcttcaccggcataacggtcgaacacttgcctagagaccaaaatgaggaagcagacgccttggcgaaatccgctgcttgtggtggcccgcattcgcctggcatctttttcgaagtcctacatgctccaagtgtgcccatggacagctcggaagtcatgacaatcgaccaagagaaactgggcgaagacccatatgactggcgaaccccatttgtgaaacaccttgaaactggctggcttccggtagacgaagcagaagtgaagtgtttgcaactcagagccacgaagtataagatggtctcgggtcagctttaccgctccggggtacttcaacccttacatcgtttcatctcttttgtcgaaggcgaagaaatggcaaaggaaatacaccaggggctatgtggcgcgcaccaggctgcaagaacagtggcctccaaagtgtttagacaaggagtttattggcccactgtgttgaaagtctgtgttgagcaaatcaagaagtgcaaaagttgccagcgtcatggccaaagccaagccgtgccccagtatgatctgcagcccattgcaccaatatggcccttcgccagatggggactggacattattgggccattcccggtggcgcgaaacgggtataaatttgcaattgtagctatggaatatttctctcgatagatcgaagccgaaccccttgggttaatcacttcggcagcagtacagaagtttgtatggaaaaacattgtttgccatttcggggtg

SEQ ID NO: 50744 - DNA, 1335 bp, Oryza sativa
  unsure (1)..(1335): unsure at all n locations
ggtcactgagacccttctactgaagtatgaaccccatgtaaattaaaatgcagatatatatgtacaaacacaggtgcaatgaaaaaaggaagttgaattcctgccggtttatagtcaaatgaactccaacattaggcaaccgaccagatcgtatgtctgacagagagtaaacacatgaagcaacagtgcatgtatccctgttcttgaatcatccgtgcaaccccaagccccagctaggattctttggcctgcatagatgggatgtgttgcgtacatggaagcaatgtagcatgtcccaaccctccatctagaatggtgtctatagcattaactacattgccatgtaaaacttttagcttatgtggcactatattaattaagtgagagagtgaagagaggaagaaactgggtctcatgcaagacacagcttcaacacgagaacctatacactagacactatcaagttttgtattgggagagaataatgtcttcataatagatgaagaataaatatgattggtagagaagagagatgatgtatttattaatggcccactttaagaaaccatgggttgaagtgtagtttctatcgtgatgtcttattaagatggcttcatacacactacttatggatactataggttgggactgccctcatggtttctttgacatatatgcatcgatcaagtcatcaagaacaagaacaaaggcgtgttctcacaggctcgcagccggccgatgaaattcagatcagagaattcaatgctatgattcacgtacggttgcaaataacaacgtgatcgattttgcaagataaaagaaaaacaacagcgtgattttacaagtatgatcggtgtggtcagattatgagattatgactactatatgcatgttaacactgttaatttatcagcacgtgaaaaagtttacccttcccctcatttcaccccagaaagcacatacaattactttgtctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50745 - DNA, 996 bp, Oryza sativa
cccgtacagatcacttagtttagtagtaattccttttgcatcatttacgcaaatccatttgatgagatcctcttggtttgtggttgcacgggtcaggagtcggttctcagcggagtaattttactccatgaagctttttccgtgttgcatttggggattttttttctcccccgactccggttggttgcaatccttttcatttttacaaagtgcaaaacactgaaataggtttttgattgcttgattatttgttcttttatgagaaggggaaaaagaagggtgagtgcactgtgccgaatctgcttccctttaggcctttaggttggatgctccagtgatgactgaattcacatcatatatcgttccaattcctgaatgcagctcctatgggatgttgcacgtttgtggagatgaagagacatctgaggagttcagttccgttgttttttattgctcaatgtttgaacctttcgttttcagttttcttcgtttgtattttgttttatcctaaaagaactattccataaaccgtcggctgaacgactgcggttgcacgattcatatcacataaccacgagtatgttggtcctaaggtttcacaaaaccacaatgttaaccaatctatcttagtactattacaaaaataaaaaaataattaacttagattactacagcatttatacaatgaaattaaagaaactaatatatttcagatataagtttataactcatgtgcatgatacatcaaacaaaaaatagttaatggtgtggttttatgaaattataaagccataatacctgtggttacgtgtaacgcaccaaaacccctatggttttgtgcaacttggaccataatacctagggttttgtgaaatttattccttttttcctactccggtggtttgcattcctttgcttcctttcggtatgctccaatgatgactgaattgacatcatatatcgttccaattcgtgaatgcagcatcctataagatg

SEQ ID NO: 50746 - DNA, 710 bp, Oryza sativa
aaatattttctatatatagtatttctatacatctaatgtttatacacccaaagtttataagtcaaaagtttacatacccgattcaaatttgaatttaaattcaaatatccgattcaaatttgaatttgaattcaaatatttttaatatatagtatttctatacatctaaagtttatacacctaaagtttatatacccaaagtttgtaagtcaaaagtttacatacccgattcaaatttaaatttgaattcaaattttttatatatagtatttctttacataaatttttctaacttttatttttttaaaaaaatattgtggcttactgtagtagggaagagaaggggaggagagggacgtacttataggggagcgggtgcgggtgatcgcgcgcattatcagtccctgtgggcggcgagagggaggcgttcgcgggcaacgctagcaacagcaaggatgtcgttggagaccaggaacgggaggagcagtacatcgacgagcttgttggttatctcatacgctacacctgatcagcaaacaaaaaataattataacgaaaacgtatagtttaatatacttaacgatttaaaaactagcaattttaaaaaaataaattactactttctaggttctaaaatgttgctatctaagacggaatgtgacctattattggacaacgagtctgtacagatgctttgcccaatttcatcg

SEQ ID NO: 50747 - DNA, 3773 bp, Oryza sativa
acagttgagattttgagaacagtaaaaaatattgattagcaaactcacttccaatagcaatcacagcaaccataatgtactggtttcagcactaaaccccgcagacttgcagaagaaagaaactatagataacaatctatacacctctctactactgttaacaaggataaacatgccaatgctgctgtttcatggcatactatgttgatccatcaagtagatacagtcatactaacgaactcacacagatgcttcttaggctttaaccaagagtccaagactaacatgctgttcttgacaccacacttcgatagacaaaaatctactttactaacaaaagaaaaatgatctgtctaggatataaacagacacaaaaacatactcatgagcagcactgcaaaattactagacaatcgatcatgaaccactagaagtgaagctaaatcctaattatagtctccaaaaattcagttggattacaccattatgcatttgtgatttccacgcagcagttacatatatatgctaggactatacatgctctagtaagaaacacattatctgaaaaaagttaagcataaagatgagcatataatgaaattacggtcattgaacaactgcatataacaccataagctgataagcatcacacaatcaatctatatcagacaaaccacatcgtgtaacaagtaaaagatgaacacttgacgataagatcttaacaccatccatagagatatcataggtattacagtgacatcagttcaataccaaaaattgcatacttgaacaaaaaactactagggaacaaacaaaaaaagggatccatgagtattaattaatgagacgggggcaaaggagcgatctctagatctacttctcggaggagtttggcccgcgcttcttgccgaagccgacgacggcggtgacgaaacggcggttgtactgcatccgcttgtgggcgcggccccggggcttcttcttcttgtcctgcttcgccaccttcggcgtctgccccctcaccttcccggcgcgagccagcgagccgtgaaccttacctgcgatcgaggcgggcaaagcacatcaatcacccaccaaatcgcacggcctagagagctacagaagcaaggaatcacgagggaaagagaggactcggaggagatggttacccatggcggcggcggcggcggcggcgctcggacgatttgggacgacgaggcggcagcggcggctggtgtgatgagacgaagccctagatgcgtgggagaatttataggagatccgttgctgggccgggatattgttttgggcctttgggattctcggcccatttcacgtgtctcgctacaccggaggcccatgaagagcccagtagaaaggcgtagtgtagtgggaaccctcggggagtcgcggcgcgagcacaccactgacctctgcggcggcggcgaggagaggagaggggagaagccgaggaggaggcagcggggagagaggatgccgcggccggaggtgcaggcgccgccggagatattctacaacgagtcggaggcccgcaagtacaccacctcctctcgcatcatcgaaatccaggtgagcttcttgccagttcgcggtgctgggtgtggaggaattcttggtctcatgtttagttatgttgcagtcgaggattaccgagagggcgctcgagttgcttgcgctacccaacgatggcgtccccaagttgcttctcgacatcggtaatgcttttacttcttcctgctcaaacgatgtgttgatttgattaaaaaaagttgtttttggtacaattactttgcttagtttgtactatgttttgaattgcagggtgcggttctggacttagtggcgagccattgacagagcagggccatcactggattggttatgatatttcgaagtccatgcttggtgagcacctcgctttgttacttgctcttaaggaaatcttggcttattgcttgttggattttttttttggctgagtgctttaaatttcttctgtagatgttgctctggagcgtgaagcggagggtgatctccttcttgcagatatgggccaggtataatatgcatcttattaatgtatggttcaagaaatttcaatctcatatgttatgtttatgctgtggtgtatgccaatactcttaaccgtaagggaaatgcttgtcttgtttatttctagtatcacacttgctctacttaataaatcataagtggcagggacatactcccttaataacactaatatttttcattacttttgctattgaccgtgaatccatgattgttctcaaaataatttctactctgaaagtaactatgagtctaggaattcaaacctttctggagagaacaagagagaattaacccaaacagttggcttctccgatagtactatgatttctgaatggctatattttttttctctgcacatggcctggcgaataatattttctgcacaatctcaccatcctttggttaacacaaatacagcaacttcttcacagttgcttcaccacaacttgtctagctttaaggtgctgcatgtgtatttatttatattcaatcctgttccagggtttaggcttgcggcctggagttattgatggagcaatcagtatttcagcagttcaggtaatgtttgagctgttatgttactgcaacaaactgaccatgttgatctcaaatctgcacttttaatttgtcctctcaactgtgtgttttgtttgtgcagtggttatgcaatgctgacaagtcttgtcacaacccaagattgcggttaaagtgtgtatttattgtttctcttagcctcttaggttgcttgcaaccagttcataactttcatatgtgcataattttcagggctttctttggatcattatatagatgcctagcaaggggagcaagagccgttttgcaattttatgctgataatgtgaaacagagtgaaatgatcgtgactgctgccatgcgtgctggatttgcaggtggagtggttgttgactggcctcacaggttagtattttattacctcacaacaatgccatattagcgtacgaacaatgctacgaatttcgttactgatatacaattatgggcatgccttctttcttacagttcaaaagcaaagaaatcctaccttgtcctcacttgtggaccaccttctctaaattcatcgcttccgaagggtaaaggtcaagatggtgccatgtgtagtgatgatgatgagagcgatgatggaagtggtgatgaagatggagcccaaacagtaagcccatgctttacaagcttgttcatgcattgcattgtgctatgtttcatgtttcaagggaactacttactgcttcaacggatggcagtatattgcattctttgtccagagcttccccttgatattgttatattgtcgcctttacatcacataagttgtgataccgttgctttttgtgtgtgtgtgtgtgtgtgtacaaaatctttctaccaatctctgcttgcaagttgcattgttcctgtggtgttttactaacttattattcagttttaccttagatgttcagtagttatagaatgctgttgtcttggaggaggtactagctaaatggttgtgcttagtcaaggactcaaggatcatctatttcatacttggttcttactctattttataggacctaatattggggtttttttccctcccttttgatgttcgaccggcttagatgaatgcttatatttttggtatgcaggtcggcatatag

SEQ ID NO: 50748 - DNA, 2333 bp, Oryza sativa
atacccccggccccatgtcaccgacaagctgaaatcacttctttctgtcatgttagcttcatccacctggcaagtttctactttatggtttcaaaatttagttgctaacaactgaccattatcaattatcttctgtcagttctgctcaacatactttttcatagatgaagtgctgattcagatgtcatttactcctttcagcctcttatatctggttcagcagtaggtttggaaggacaggtactgctgtttttagtaacacgacgactttgacttatctgttcattttagtgacactcatctgaactttctctaacagctgactgtttatcatcacaacggaagtccatgctaccggtgtctttatccaaacccaccatcgtcgccaacatcgcagagttgttccgataatggtattcttggaattcgtaagtaattatcttctctacgtagcaaaaaaacaccctatgaaaaggcatgtggatcaaattgtgagaaatttctgcatctcaattctaattgtaccaacatgaagaaaatttcggatggagattctcgaatagaattcaataattgagggttcttttatcttgtgttggtgtcttttagtttatgttttctttacattatgtcagtgtgtgctgagtttgttcgtgtgtggactttgtaataattggttgtatctcgttgagcaaaagccggaatgttatttcattatcttaaaaaaaatgaagaaaattaccaactacagtagaatagtagaggaattccataggtataggtatattatcttcataggtacatgtaaatgtacttgtcgtggatgtagaggccggttttctaatatcccatccatattgtctatatgaatgatccaatgtctacatttttgtttgttagttccaggagtaatcggctgccttcaagcattagaggctataaaggttgcaactgctgttggtaaacctctctgtggaagaatgctacacttcgatgcactgtcctctcataccaggatcgtaagtcagttcattatgtccatcgactcaatttcctaaacagcaaccatcagaatcctctgtttcaatctccctgaaaggccataaacggttacacaaactcctgcaggtcaagatcagtaggagttcaccaacttgcaaggtctgtggagaaaatcctgttttcaccaaagaggacttcgtgaacgttgattacgagagcttcacacaatctccaatgtccaaaaatgtatggatcgctctttttgttgggttcttagattgtatcatcggatatctgtgcatggcaatatgacatcaataaatagtgcaaacttcatatgtagtgtaaatctaaaaactatcgtaggatacgcaaatggatggcgtgaacaaatcttagacgtccatttatatatcatgtggtagttttcaggtttgcactacacacgaagtttgcacaattgcactgtgtattttccctggcatcactcctaatcactctctgtttgaactgatgatgattgcagtcgacgacgcggagcctgaatcttctcccggagaacgcccgggtgagctgcagagactacaagaaggtgctcgacagcggcaggccgcacctgctggtggacgtgcggccgtcgcaccattttcagatagcgtccatggctcactccatcaacgtcccgctctcgctgctggaggagaagctgccactgctgcgggactcggcgagggaagtgtcgtcgcggcgcgacgggcggcagcactgccctgtgtacgtcatctgccggcgaggcaatgactcccaggtcgccgtgcagatcctccgcgagaatgggttcctgtatgcgagcgacgtcgccggtgggtttgagtcctgggccaaggaagtcgaccccagcttccttctctactagccagatgctttacatagttgatagttgcaacttgcaagtaacttgtactagagattagagaaaaggacatatgtagttgccttgaaggttcaaacatgagtcaggtgcctaatgttaaatgtaatccatttccagtgtataaaagaaaaaaaaatgaaggctcaaatagatgtgattgataatatgattgtatttaccactcctcttaataaaaaaatgtgcgtctcgcgtattccaaaaaaaaaagataatatgattgtatttagatcatgagaaattcacatgagtctgtcagacattgaaatggggtgtaaaatttttgttcctggagatcaagttcaaacaaatgagataccataaccaggtcaaggtttacctttgatatctgcctcattggtcgtgtgttagaggcgta

SEQ ID NO: 50749 - DNA, 2082 bp, Oryza sativa
  unsure (1)..(2082): unsure at all n locations
cgagccctcattgtaaaaagcatgtttcccttcttaggcagcgagaggcccatgtggtgaccccggaccagataaaaaggaggcccaggcctaggaggaaaaaggggaggaaggggggttgggactctggggaatgggttctagagcctgaactctctctcgctctccagctctctgtattccttcacgcacagatccaccagaacacaggagtagggtgttacgcttctcagcggcccgaactgtctacgtcgcccgtgtcttgtgcatttcctctcccgctgacgttcctcagatcgagggcgaagaacctcacttagcgcccccggccgaaccggcaaaggggggcctgcgcagtctcccggtgaggagccccacgctccgtcacagcttatatgtactattacaaacagagatgatgagaaacaaagctgaactttataccttgggcatcaggacacaacaatcactgatcatgtaccgactagggacggggtttgttgcgtcaactactatgtcatatctgtgatattttagtagtgttggaaacaggaataagaacaaacaaaaggacatgattgatatttcctattgcattctaaggatactgtcgcataatatccaaagcgttgctcgcattcaaagtgatatgatactcgaacaccttgatagaggagttaattctgatttcatgagaaacatatatagaactaattgatatcactttgtaggcacacataagtgagattgcttttacaatttatatatgatagattatctgcccaaatgataacatcttacgcacggcaagaagcagcagttgatttcacctttggttgtccaacatatgcttctatgtgtattatctgtaaaaaaacattgaggaagaatttaagatatttagcctcccttagatgttttacaaattacaagtcctattgttgccaaaagcaaaccatgtaagaaaatgcaagccactagtctatgaaaattaaaaaaaaaacttaactagtcaataagttctttccaccctgcaagttaattaacctaataaagtggcagtcgatgagagtgccttcctaggaagtcataacattataaatagagctccaataccatcacatttagaagaaagtgcaagagaatatgggggacaggtaacgggtacctgacgatgcaggttgtcaagttcaactcgatcgccatcaacaatacctaagcaacctaacaaaatacaccaagtagtaaatcaagccatggacgattaatcacaaaaggtatcatcgcattcgaagcaaaaatatctgttcctcaggagaagagacattctttccgaatgaactagtacgataattgatacctgatgaacagctcttgttgtaaaggaaatcgcaataatttttccaagtcaaattactacaatgtttagggtgataaaaaaaggggaattcggttttaccgacgccacaagcagccagatacatggccacaggcgagcccaatnccacctggcaccgactcaccaggtatgggnnatgattgnnggacagcttccgttgccctgaaataacaacgagtggatgaacagtggtagtacaggctagaagccaagcaacgagcgatgatgctgaagagctaccttcgaggccgaactgagggaggaggaggtggcgtctgtagcggctgatcatgtcggcggcggcggaggaggaggaggagggcgatcccgtgggctccacttcggcggcggcggaggggggaaggggagcggcgccgaggcggagctgcgactcgagcaggcggatgcggccgtccagctcctccctctccgcgcgcagcctctcgagctcgcgcatgatcgcctccgccctgctcctcccgccgtcgtcgtcgccgccgccctccattggcgcggtgccggtggggttgggtcaccttctccacggagctaggagcctaggagtagtagtaggaatagtactccagttgcccagttgcacggttgcaagggtgcaagggctggtgaaaacggttaccagccacaggtacgttgcgccaatcggactgactggcaattgccaa

SEQ ID NO: 50750 - DNA, 1855 bp, Oryza sativa
agtttcaccgcgaaccggccagaacggtaggtgggcttgggctgcagccagctcttccacttccgtaagaaccggaatctggctcaacgcgtcactgctctcggcccattaggtggccgacgttctccggcccagctttttggtttatgaagagagcgagcgatccacgatcaatctggcccacgatccactccacaacccatgcctaccgaggctttcttgtttccacgccgtgtataagtattgagcattttggtgtttcttagcaatgcaccacgctctcttttctttgatcatcctactagtcccccaatctcaaaataaagtattttttaatatgaatctggacataaacaaatattttttttcctggaggagtagtacgatacaatctgcccgtcagaacatcaagcagggcagagttgcctgtgatttgtcagtctactgtctactccctccgtcccaaaaaaaaagataaaccatgagttttcgtgccaacatttaactgtccatcttataaaaaaaactataattagtattttcattgttgttagatgataaaacatgattaatactttatgcgtgacttatatttttttcataattttttcaaataagacggacggtcaaacgttggacacggaaaccaaggtttgtctttttttttggacggagggagtacattgattcggaaggacaatctcatatatccggttttggaattggaaatttgaaacagaattttcttcagatgaagaaaaaagtattgtcatcagcttatatggtgtgtgaaaaaaaagagagaaataaataaaagtagtattatagtacaagatcagtttgcaaaacatatagaaggtgtaaaaacacagaactctgtaaacattctcaaaacctagccctgggcacacatgagatgtgcccaactacagtatatataagctagcagtatatagtctttgacagaaagctctttctctcgtcctaacatcctgactgaaaacgaaaacatgtacatacatcagtgcacacccacacgcagatgccaggcaaccaaaaccgagctgtgctccatcaactcacgcatgcatctccttcagttcagttaacccagtatcttcaggcgtttcacagatcgtgcaaaatcactgcaacaaacaaaacaaaggattaacatgtcagtattacacagaatctaatgttcaatcttgctgattcattaagttatactaacactgaaataactaagcttgaaatcgacttactcccatggcacgtccccaaccagcatccaatccccatcaccatcctcgtaggtgaccacaggtccagcggcatcgccatgatcatcattggccattttcttctcgcctgtaaatatatcacgataaccaaacctagcatcagaatcattgatcgcaatcgaattcggttactagattctgcttgcttttgtaatcacatgtgctgatgaacaattgggttgagttaaattagctactgaccttggtggtcgttggtggggaacatgcgggcgagcgtggcagcgagctcgtcgtaggaggaatggagggccaaatcaaccttcctcccgatggcgtcgccttccttcttcaccttcacgtagttggcgccgccgcacgcccgccgcgccgagctcaccggtggccaccccaccaccgtcttcttcctcctcctgcaatcgtcgtcgctggtgttgcagcagctgccgtcgtcgaagagcagcagcgtctcctggaacgcctccctgaatcccctcttcccggccgacgaggcagacaccggcgcgctgccgctgccgccgccgctgctgctgctgctgctgagctcgtcg

SEQ ID NO: 50751 - DNA, 2751 bp, Oryza sativa
ctgcagcccttcttccctgcgcctctgtgcagcgtttgcgtttctgttttttttttcttttttgattgctgtcatgtgattgtgatcctgtgggctgctagtatgtgaaattcagagcttcaggttgccgcccactgtcagactgacagtcagaaacgttgcaccgttgggcgttgacgtgcatttggaatgaaaacggccgggaaataccattttcgtaactatatttttctccgtcatcgaaaatgtaaagctggaaacaaaaaccgtatcatataactacacgaacaaaaaaaacatgctggtatcaactgggaacaggtaattgttaatgtataacatatttaattcaatgttacactatataaattattagtacaaactatgtatatatgtctattttatgtccttaaattagatatttagttagaagttaatacatcactaaactatgagctaaatagagacatgttaaaaaattataagaatatttagaaatacggttcccactagaataccataacgataacgatcagtacaacatgaaaaccatttatttccatagtttttactatcttagttaaacttttttttaaacgaaccgtagcgagatctcatactaatcaggttgaaaatcagaaacgagggtcgaccggttcggcctgggagacgcgttggcgctaggcatgcatgagatgcggcagccaggatttgtcagccgcccagccggccggcgcgcgcgatgttgccgtcggcgcggaaggcggcgcgcggccgggcatgtggcctcgcctcgcctctcccggggaggtggttgtgcgcctgtgcgtgggccgtgggcgtggctgttctgcgcgccgtcaagcacgtggcgcgcgcgcgatccatcaacaaaccagctgcttctctgctctgcttgacagtgttcctagctgtagcgcagcctgctgtggaatcctccgttttgacccgtttcttgccttgctgatgcaggacacatgcaagccaagcgtgtacattggcatgaaaaatacagatgccccccgtttgaatctgattaaaatacaaaattatatggattttgataacacgttttccaaattaataaataattgaaattcatttatcgttttacatgatgctcgtacttaatttcaatcttcgacgggtgcaaacagggccgatatagactactcaaaacacaaaaactcatgcagacatggaaaagagctactacagctcaccgtttgctctttaacttgtatgttgttgttaaaatttgaattttaaaagttagttttatagttttattttttatgacttgctttaaatcgttaacataaaaatgttactgtaaattatttgttcataaaaatcgttacagcttatgaccagctacagaagaaacgatgagtttaactcggaaccaaagattttattttaaaaagggagaaacaccccgagccaaaatttcagagatatgccaagtgtcttcgcccattcggcggcagcccgcgttacaataatcctcgagtacacaaccattattaaaatcgagcacatgctcctagcacgagatattcgttgccatccatgacttgacataaacaactaatcaaccgcttttcatttgcacatattaatccggctttttttttctccaactagtaatcaactgcaatgtgctcctcctgctatatcttaagctgctccttaagctactcgtaagtactaagtacgaaccactaatggcttggaggagaagggagagggaagctccgtatctggcgtgtcccccgcacatggcgggtctcatggacacctttgtcccgtcccactcgccgctgtcggagttcttccactcctcgattcctcatgcgccgcaccagcttcgattcgatctcttctccctccagccacacagatattccaagctgctgctgctgctatttcgcgtttgatttgattaaacaatggcttaattgatactactattattaatcattcaccttcttgagaaaattatatgcattcattctatcagactatttatagaatcaatttataatataacactctattaatttgttgccttaacaattcacatgttggagagaatattcagagaaagtagctcgtgggaagctagtttatgcttatagctgccgttcgatctttggagcatgagaccactggttatctgaagattctgaagatacaagatatatcttctacatcctcgcgctcaccactcatcggcattgataaatacgatgatgaaaagtgattttttataggctccctgaatactttactcgagttgatattccacatttccatggatcattatatctctgcgacctgatcatgcgaatgtgtgatgatatgccagctgaaaatgtcaatggtgaacaacttaaaacacggcagaatcaaaggattcttcgggaataggttgatgcttgataacattcaaagtccaagctgaagcatgtgatatatacttgacaaagcacctgggatcctgccggcatcttgcttgctataagttcaatttttctttctctcacttgtttcctttcaaggaagcggaggagaaaggtggtactctttttagctgtgattcactacaagaaaggtgatgttgtatttacgttccaatattgacaagtgaaaagtgatgtatgatccactctattacaacgataaattaaatgctattattagggactatctactctacattcctcc

SEQ ID NO: 50752 - DNA, 903 bp, Oryza sativa
gctcctggaaataatggcgcaacttcctcgaagccatcagaatagcataaagcatcttctgggcctgagggtatcgggtcttggcgtcccggagggcctcgctaacgaagtagacgggccgctgcacctttcggcggggccgatcctcttcgccaggccgcatctccagggcgctcttcgtccgagaggccacgcggggcgcactcggcttctgtgccgacgacctcggggtcagagggcgacaggcgcggccttcccgcagtggccccggggccatcctgggggttgggggcgcctggcaccgtcggacaagcaggcggagggccagctccggccgtcgggggccttgggccgccgttcggctcaggggcctctcctccctgctctctcccgggtcgagtcgacacagggtggggatgcgcggagtgagggttgtcctcgtcgcgctccacgaccaacgccgcgctgaccacctgcggggttgccgccaggtagaatagcaacggctcatctggctccggggcgaccaggactgggggagaactgaggtacgccttcaactgagtgaaggcccgcttagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatccgctctatagctcgtatcttctggggttggcctcgatgcctcaggcagagaccaagaacccgagaagcttgcccgcaggcacgccgaacacgcacttatcggggttcagctttatgcgggcggagcggagactttcgaaagtttccgctagatccgagagtaaggtctcttggt

SEQ ID NO: 50753 - DNA, 739 bp, Oryza sativa
cctggtattcactcttcagaattaagtttaacaattagattgtgtaatcataattgccatgtatcaacaattcaatattagttggaagttggttttactgtgatttggaaatcccatgaattgaataggcctgaagttattggccgtgtttagtttcccccctattcctaactttccatcacatcatatctcatcaaaaacttttctacacacataaacttttaattttttttacaaactcccaactttcttcaaacttctaacttttttcaagaattaaatacacccatcataaggtaggaagcgagaacaaaataaatactgtagtaagtatacgtgttatgctcacttttgtagcagtacctttttttcccttttggcacttgaaagcaaccttttcaatactaaaaagatatgcattacaaatcttcttcgattcgaattcagtacaaattttattcaactcgaaatccagcgggagcaggagcaatgatcatccttaaagttgggagaattgccgcacaccaactgacgtgtggggcctccaaaccgcaagtacacctatgctggcaatgctgcccttgcccctctcccgccaacgaatccctccactccccaaaagcaaaaacgcgcgcgaaaaatttcaactgccgcgcttctcccaccgcatcctctctccccttgagtatttacttttcaaaatacataaagaaaggaagggaagccgagtgatcacatc

SEQ ID NO: 50754 - DNA, 2654 bp, Oryza sativa
aatgacatttcaattcaaaagccctaagagtttcaatatcttacttaaactacttgagaaagaatagcaaatcatacaggcagcatttttcttggccggattggcacctgcaacataaatgctgggaaagttattggacatcaggcactaaccttgctgacagggctcccgctataagtttcataaggaccttcttttgcagcaatttcagcagaagctttcaaggcatgataataaatagtctcaaaaatatccttgttcaattgctgagcctgaaaagatcattgcatcgcatttcagcgaagtatatatagattggaataaccacatttttaggttggaaaaatttacctctgttgaatcaaatggcatgccaagtaaaatgaaggtgtctgccaagccctgaacaccgattccgattggcctgtgcctcatatttgatctctttgcagtctcaacagggtaataattagtatcaattattttattgagattccttgtgacaattgaagtaatctgcaataaccaacaaatattagtagcattcaggctagtgggaagaggcataaagtaagtaaatattaaacacaaacctcagctaatttatcaaagtcaaaatatcggtttttggatccattactaccaacaagcttagccggatgagactccataggaacaccctgaacaaatttgtgtcgtgagatacagaaatttcaacctacaacaaatcaaaaattatacagccagtactgcatagtgcataccttttcccttacaaaacgcggtaaaccaatcgatgctagattgcacacagcagtttcagtgggacttgtgaactcaataatctccgtgcacaagtttgaagacttaattgtccccaggttttgttggttactttttctattacaagaatcctgcagaccagatttcagaaataagcatatgtggcaacagaattgtaggcaaactactgttccctttatgaattgcacaccttataaagcatatatggtgttccagtttctatctgtgccttcaaaatgtcaaaccagagcgcctgtgctgaaacaactttctttgccttgccctgaaattgcatgctaggttaacaaatattctttagatattacttcaataaactgcacacccagcacacatcttacctctctttcatatttcttgtacagattctgaaactcatctccccaacagtcagccaaacctggagcttcattgggacaaaacaatgaccagttttcattattttgcaccctttccatgaacagatctggaatccagagcgcatagaaaagatctcttgcacgattctcctcctgcgaattgcacatggtgagtaaatgtgtttctgtgttatcaatttctaatgtctatcagaaaatgcatcctttcaacagcctttacctttccatggttctttcttaaatcaaggaactcaaaaatatcagcatgccaaggctccaagtatatagcaaatgcacctaaattaatgttaggaatccataagaaatcctgaacactgaacatgtaaattaggtccatgtctaactaactgatggtatttaccttttctcttgcctccgccttgatcaacataacgtgcagtatcattgaaaacacgcagcatgggaacaatcccattagatgttccatttgttcctcgaatgtaactcccagtagctctaatattgtgaattgagagaccaattccaccagcacatttgcttatggtagcacattctgagagagtatcataaattccctcaatgctatcatcgttcatgcagatgaggaagcagctacttaactgcataaaacagagaggagcataagagaccatttttaataatccaaattggacttcaatggtaggaagcatattacttgaggccttggagtgccagcattgaaaagggttggcgaagcatgagtaaaccagcgctgagacatcatgtggtacgttttgatagcagattcaatatcatccttgtgtatcccaatagaaactctcattagcatatgctgtggtctttccacaaccttcccaacaacttttaacagataagatctctcaagggtcttaaaaccaaagtagtcatagtcaaaatctctgtcataaattatctcactgtccaagcgggtggtattctgaaatggtgcatcatatagaaattatcaagtcacattggcacaatatacatataataaaaaattgaagcacctgaagaaatatatccacacaagaaattgaacaacgcaaaaaagcagcattgatataagaaaatttcaagaactccaacaaagccaataaagctaaacaaatatcagatcatcaaatatgaatttcaaaccaaatgacgggcaacataagcatcataatggatccaaaagaacagaagtaaacaaagagtcacggcaatacacgtgaataaaatgttagtaaataaatgttgaagaacaacctattggtgcgattctatagaagtgacatattgcagcaatacatgattcggaaacaatctttttgggggaataatatcataagaaaacaaataaacagttaacaatttgcgaggcggtcatcgtcacaaatgttaattgcaatcttcatgcatgccatattgcagaagcacaca

SEQ ID NO: 50755 - DNA, 3434 bp, Oryza sativa
agcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcctagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttatcgccgatgtccatgaaggcgagtgcggagcccactccgcctcacgcaccttggttggcaaggcctttcgccagggtttctattgaccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccggacgggttcgagtatctgtatgtcgctatcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctacttcgcctcccccgcccaccccagaagcaatggccaagtgaagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctagccacgggcgacggcacagagctgcctaacccgtggaacatcgaacaccttcgtcgcttctacccctagtgggggtcgggtgtcatgtctcgggctcgggccaaccccgcacccccccgggcgtgcagggttggccgggggctaccacatgcatatacttaccttttttctcttccgtatttcaataaaagcattttcgatttcctgaggactgtgtctgtgccatcgtttccttttgaagaatcttggctcgaattagcacgctcgtgctcgaccctgccctcggtggcccgggtcggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacatagaaggaccgcggcacagaccatcctcgtctcatacacacaacaaacagaactgacgcagaaatttcctctttacttgattgcagattaaatcagtctatacaagaagggggcccgaaggcctcggaagaagaaggaaaagttattaagattggcgggggcctaggggctcactccgacgcgcccgggttgccggcctcgtcgtcgctgtcgtccgcaccgtcgtcaccgccctcctcgtcgaagacgagcgcgaacgcgagccgaggggctgtaccctcgaagctgtggacgatgtggtcggcggcgtcccggacctgcgcgcgcgcgccgtcctcggttccgggagggaactcttccagcgctgcccacggggagaagtcagggtccctggcctggtagcttgccagcacgagctccaccgccccccgggcgaggtccctcgaagatgacttgatcgtctcctcgagctcctcggggagccgctcgagggccccggccatctctgagaggcgctgggcgaggcccccctagttggcggtgtacttcgcgtaccgcccgtcccagaggcccgcctgccgcccggcgcggtctagacaggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggttgccgtggcccgcggccgccccgccgctgtgcgctctcgcgtccagctccttcgcccgcgcctcgagctcagcggcccgctgatccagtgcggccctctcggcgcgggtgccttccagattgcggcacgcctgctcctcccgcgctgcctcgcggaggaacaggctgtccgccagccgttgcgccgcggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcagcggcggcatcaaggactccctgggcggcgtcgagcttctcctctagctccgccgcccggctcccgtattggaggcggaggtcgtcccgcgccccgtcgagcacggcggtggcgatgagggcagtcccgctcctcctccacctccctggcgacctccgccaggtccctacgacgggcctcgagctgtgaggcgtgccggcggtgtgccttgcagcccgcggctggaagtagcagccaccgactaccgtcggcggcgacaccggctgtacggtgaagaaccaccggaacagccggagaaatgggcgcaccc

SEQ ID NO: 50756 - DNA, 1118 bp, Oryza sativa
ctgtcggtaacatgggccgggggtatcgggaatacaggcttgggtagccgcggtcacccacgtggcctgaccccctcgggggggggggggggtcgggcccgagggtgacgtggccacccctccctctgtctccccgaggggtcgggccgctcctgtttcggccccgagggctggggcgcccccgtttcggccccgagggctggggcgccccgaccccctgtggttttggcgccacgtgtgtgggttaggtgagcacagcggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagtttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgtgctctgcttgtcagaggtcacttccggctgtagacgagccctcattgtaaaaagcatgtttcccttcttaggcagcgagaggcccatgtggtgaccccggaccagataaaaaggaggcccaggcctaggaggaaaaaggggaggaaggggggttgggactctggggaaagggttctagagcctgaactctctctcgctctccggctctctgtattccttcacgcacagatccaccagaacacaggagtagggtgttacgcttctcagcggcccgaacctgtctacgtcgctcgtgtcttgtgcattcctctcccgctgacgttcctcagatcgagggcgaagaacctcacttagcgccccccgccgaaccagcaaaggggggcctgcgcggtctcctggtgaggagccccacgctccgtcatctggggcgccaggtagggggcgcgcgtgtctttctaagccctcgtcctctttcgtgtgcgccaagct

SEQ ID NO: 50757 - DNA, 792 bp, Oryza sativa
ttgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttctggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgttgtccagaagaccaccgattcgtgtggtcttggacgggccgtcgcccagggcaacctccttgaccgggacctcgtcgcacgtgaccatccgctgccttggggcagccgggacggaggtgctgagcctctcgtcgccacccacgggcttggacgccgcggcgaggtggtccgcgcgctgctccatacaagcaagcgcgactttgaggtcgccatggacggtgatggggccaccggggcccggcattttcatctggagataggcgtagtggaccgccgccatgaacttcacca

SEQ ID NO: 50758 - DNA, 2008 bp, Oryza sativa
ctcacggtgccccagataagttcactgggggcagaatagaccattcctcatggacaacatctggaacaaaaattcagcaatcaaacagaaattagctgcagtaacgtggaatacatacattttgtttttcttacaaatgccgtgcaaacaacaatgtggcatgctgtgattagatcaatgttcttttctgacgtcctaaccgactaaatcttgcttagacagtaagccatcagaaaatggtgattaggatagctaatgtacactttttgatgctagaacttcaagcttgtcctaactcatatatgctagtaccatttcacttcagcacacagctgctcaatattcaaaacgcttgacatatccattgtcgatacctggagcattaagtctgtggatttgcgaaaataatcctcaagcaattcagtaacaatgcaacattcattacacttacctggacctggagctgaagctgcttcaggtactcgatggcatcgtcaagcatggaggctttgtccgtctgcatcggtgaatgaaaccatcagcacaagataaacgccaaattaactcgagagattagcttccagcaacacaagtaatagtgtgtataaatcgttgaacaaaaaatcgagtaagaaacaagagagacaattttttttactaccttgctggagttgggaatgaggctctgcagggccttcatcttctcattgattctgctcctcctcctctgcaccaaattaccgtggtcaaaatcaatcccacaaaatcagctgataccaagaggaacacgagaggtagcagtcgccgtcgccgggctaaccttctcggagaggttgtgcacctcggcggcgcggctcctcttgccgcgcggccgcgccggcctggtgggctgctccgactccgacgaccccagcgcctcctaaaaagaaccaaacaccaaatcaaaccgccaaatcaccaccagcatccgatcgaatcaaacgcggacaccgcacgccaacctcgctctcgcagcgatccagccccatgctggcgtggtgtcgcatgatcaaatccaggtgctcctcctcctggcttcctcgcccatccatcatcgcctcgccacagcaccagcaaaccacaaacactagcgctaccggacgaacgaacaaaaccaagaactccttaagtactccagaaatggcgagcgagcgccacgagaaattggacgctgctgctgctgttgctggtcatgagctgcccataccttgctgctgcagctgctgcaggagttgccacctttcttcagtttctctctctctctctctgtgtctctggttttgtgatggcttttccttgagcccgagaaagctgcaagcgcggcagagcttttgacgacgtcttttgagttttgccgctgcggctgcctctgcttcggcttcagcttctctctccggctccggcagcagcggcgcggggcggtcggtgtacggctcgtcgcgtcgcgtcgcggggtggggtggagaggttcattgatggaggagggagggaggggtggttctggttcgcgcggttttcatttatgagcgggggggtgtggtgttaatggcgtggcgtgttgagctcggctttcagagctcaacagtgccagtttccgtgggaagacatggacatggatatatgctgtgtcgtgtactcgtttactccctccgtctcgtcttattaaatttttttatgtaaatataaaaaacgaaaagttgtactttaattactttagataataaagtaagtcaaaaaaaattaataataattttaacttttttttaagaataatacgagtgatcaaacagtgcaagtaaaaactcaaaaggaagtagttgtgtgtaggcttggtacttgtgtggactctattttctccatcttaatataatataacttacacattttaatattataaatttagatagaatctctatttagatttataatagtgagagtattagattcttatattttatagtgaaagaag

SEQ ID NO: 50759 - DNA, 1799 bp, Oryza sativa
tcgcggatttctttgcgcgcagcgctaacctcagaataaaattacagctttggtttccttctgatctggatgttgacaacattaacaaggttagatgaaagtacataccaaattgttcaaagctctggctcaggtggtgtttggatccaaggacttaactttagtctctttatttatacactaatttagggtattaattatatactacttacaaaactaattatatactacttacaaaactaattacataaatgaaagctaatttgcgaggcaaattttttaaacctaattaatccataattagagaatgtttactgtagcatcacataggctaatcatggattaattaggctcaatagattcgtctcgcgaattagtccaagattatggattggttttattaatagtctacgtttaatatttataattagtgtccaaacatccgatgtgatagcgacttaaaagttttagtcccatctaaacagggtctcactgtggctgtaaacttatcagatcctaagtttcccatttgtctgtgctgtgcatgacagtcttgaaccaactctgagaacctcatggaggtgaactagaccctccttgttctgtactgacattagctaatgcctaatgcagaagatgtgctaagaaatcattgataaattcagaaagttgacatgcttttctgaacagctttgcacaggatgatttgcgtgtattgtcaagacatcgacagatatacaatattacttgaagtaattgacctgctgtacatacagaggaagtattgtggtatgcagataagcctgataaacatttcgggtatgcgatcttcagcgcttcttgggtatccaaaagcaactgaattgatttgaaaaggcaaatgtaaatcgatctggccatgaaacttgcgcaaaaaaagtttgatacaatttgaattctagtttggcatgtacctgatccaacgcaatgtatgaccttcggcatagcagatctagagcatctatcagatggaggatcttgttaatgatgcttgctgacaacagggactggtttggtaatggatcactagcaggattgcagtttccaccaccctcaacaatagttgtcagtaatgccaggccttcatgtctgttgaaaacgcctgaagcctcctgcaaattctggttatgaggtgcaaattgtcatgctttaggccgattttgttggtgtggccgaattttgtgtgtgataagcaagggggccgccaagaggattcagcaatgcttctcctcaaggcatgatgatcctcagagaaagaggatggccccatcggtacaaggacaatctacaatgatatatgcagagaaagggagaagggatcaaagcatctgatggaaaatggctaagatttaatgaatcagaaacagaaagatggaaatggaagaggtttataattagcatagtagtttcttgaggcagccagtgttggctaaaattaagtatccaagctaaaaagcagctaatccatgaggacatgtggttatatgtttgtgtggagggtaacccacggtaaataccaatgctttttcccaagaagtggatatggtcacacagacacatttttgtcttaagttgttcataccatgggttctgaaatctgaataatgaacagcaattccatcaagaactgacaaaaactggttatcaaaggatcttctcttatgcagcactgaatctaagaacaatcttgacctagcctggcttgggtgagtacaaaaacagagatggagcaccagttcctggttcattcgagaagaaga

SEQ ID NO: 50760 - DNA, 1185 bp, Oryza sativa
aaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaactttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccacatgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaaatgcaagagcaggaaaccgtacacccggtacgttccccgatccgcggttttggaaaattcatttagttcgcaagcaccgacccaggtgtcgggttttccaagtcttttgtaaaactccagttttacccaagttgttaaacagattttaagtttgaaggcgtccgtcgatactcgcacagggtgcacgaatatcgagacgcaactagatggttacaaggggacaagatatagcaattaacaaaggaaggatcaaatgcgacaaattaggtaggtccgccaatctgccttgcagacgggacaaacagattaagtgcgatcctatcaatgcataatattttgcaagggatataattaaatttcaaatataggctcaagatattcaaaggtggcttgccttgctcgagatctggagcttgatcctcaaaatcctcgcactgcgggtcttcgggctccgaaactacacgcaaaacgggacaactcaacaaa

SEQ ID NO: 50761 - DNA, 1020 bp, Oryza sativa
ggtgatgctttgtcaggctcctaggtacgtaggaaggaagcttccatggactgcaggatactcgctgtgtcgaacctgaagtttcggaagcttttacctgggcggctgtcaagagtttgtgggtcagatcctgttctagtaataacggggttctcaacaggcgccgctccagttgaggaattcttcgctttccacacagtacctgtcaaatgatgtgtggtaccatagatgttatcacaattatagaggcaaacggtatatgtagcaccagaggttcaccaattttatcacaaattacatactaggagtacattgcaccaggttcaccaatggtactacacacactatgtactaaaagttgatcataagtatagccatgagttcatgactatgccaggatcagacctgctttaattatgtactagctgatattttgctcagttgagaactacttctgcagattaacttagaaaacaacaagcgaaacttgaagcagaactgctaaaaataattgacaaataatttaacatttttaggtcctaacataaatgggcaaagggaggatcagaagaaacctctagcagacgtgtctgatttctgatactgtgggtgacgatgtgtggctatccaggcttttagacccctggatgaagaagtaaaatgtaaaggaattaaacaatgtagaaacaaattcacactcaggaaatgtggatgcgggttaaatattttagaagccattaaaccaacatgctcatgatgactgtctgcaccaagaaaaaaaaactaaagtgggtcaaaaaggtactgactgcaaaaatggtgcgaccatatagagcttcatcccattcactccacgagatattgcgtcatcaccagcaggaaggagttcatcgatgttgtgccatgagatctcctgtcaatttcagaggatcacgactcagtaatgcctatttaactctctttaaccaaaaaggttcaaaactcaaaagggtcaatggataaactacaacgaaaaaaaca

SEQ ID NO: 50762 - DNA, 867 bp, Oryza sativa
tcagcgatcaaaccaacggcggaagcgccaccgatgaatccaaggtggagttcggccggagcttactgagcgtagtgaagtccttgaaggagagcgacttgagggaggggttgtgctcgacggagttggcctcgtagaaccagtgcgcctgctccagcaagaacaggatccgctcgaacgactccaaatcctctttgggcacgttgagcacgaagcggctgttatttttccgtttccaccggcgattcgattcagtttttttccggggggtttgatctgagcaaaagccgagaagactctcgcgagatggatgggatcgagggtttgggatgggggctacctgcagagatcgtcgagaagctcctgcggcggcagctgccccctcgacgacgaccggtagagccccccggcgcgcgctatcgatatccaccgccgccggggcggcgcccggtctcccaccccttctttcccttttttggttgccctcgggaatccattgcttgttaggttgcggcccagttcacaaggcgcactttaatttaacgtaaactcttttcgaagacggaaaggtgggccgtgggctacaccctaataaggcgtaattttattttacgtaaacgagtttggaaggcggaaagtgtgggggcaaacagtagtagattaaaaatcggaggagagagacagcgaaggagcggaggagccgaggcggggggagggaggccatgatgccgccggcgataagcttggctcgctctcagacgtagtccgcctccgctttcctctctaccccgtccgccgatccgccgcagtcgccgtccggcaccaccgctgcccgtccttcgccaccaaacccgctgcaggtcttat

SEQ ID NO: 50763 - DNA, 1127 bp, Oryza sativa
tgcgttgacatcaagtggtgcagtaatatattcaaatgtctgaagtaacattatgaaaacatcatgcatcatcatttgatgctaatcatgtttcttaaacatctactagctgcaccatcatgacatcaagttgtgcatacatatattcaaatttctgaagtagcaatatagatccatccaaaaaaaaagtacttgcattatataaacatcatgcatcatcatttggtgctaatcatgccttttaaaaatctactctagtgtcatcatcatgaataacaccaatgccagggactccaaaccaagcaatcgcatttatatccaaatgatccgttggttgagagagcatgagtacataactttcttcatgtattgtgacacataattttctgacatagtacgtccactcttgtcaacatgcaagatcaaaggacaaaccaaatatacagtgtttaaagtggctccgatagtgagagcacaaacaagataccaatacattcatggaatcaatagtatcttgccaatgtgggaactttcttccatcaacttgtgagcttcagcagcttctgacagaggaaacgtcttgtatattactggtttcaccttgccttgcacaacggcaggccatacatttttctccacctcactgacaatcagagctttattatcaaggcttctgttgcgtagtccagcagctgcacagaatcataccatttccacacatgctaaaatcagcgatatcgtttaggtatcatccaatcacataattgtgattctcagtaaggcaacaaccagcagtggtataagatcgtaaataacaaaactagaaacacaaaaatctagtatgagggacattgttgcctatagatcaacgttaccttgtatggtcaatcgtcgagcaagcatgggttgcaggttcacttcagttacagcgcctccttggaaaccaatgatgaaaagtctaccatcaacagctaagctgttcaggttacgctgaagatacaatccaccgatgttgtccagaatgacatcgacacctggtaaatatacttccatgtcaagagtcactaaagcatatgcaaacttggcaggtatcaaacattatagacagttccatggagaaatgccgt

SEQ ID NO: 50764 - DNA, 2482 bp, Oryza sativa
gtgcctaaacacctcatgtgacaccctatataatatccgatgtaacacgctaaaactttaaaccctagatctaaacaccccctaacctaacgtcctaatccaaacggcagcggcggcggcggcaatcaccgattcacctggtcaccgacggcccagcgggaggggacgttagggccgagggcgaggatggtgccggagcactcgaggcccgggtaaggggacgcgccgggcggcgcggggtaccggccctggcgctggacggtgtcggcgcggttgacgccggcggcggacaccccgacgagcacctcgccttcccccggcggcgggaggccctccccgacgtcccgctcctccagcacctccggcccgacggcgcgcgcgatcaccaccgccctcatctctccccctacctcgtcggggctcagctgctcgccttgctttgctcctctcgatgagtccacgcacgcgctgacactctgcgtctctgctgtgactcgtcgactggatattgagatgggccttgggcctggttgagtaaaattggcccagatagctgaaatctggtccagccttctaaaaaaagataagtacttcctaagtgctagtccttccgtttcatattttaagccgtttaactttttttcattcaaactttgttttgattgatcaagtttatagaaaaatatctactaacatagttaaaataagttttattgaatctaacattgaatatattttgatatttgtttgttttgtgttgaaaatactactatatttttatataaatttaattatactttaaaaggtttaactatgaaaaaaagtcaaacaactaaataataaataatatgaatgaaaagaagggagtaatacggtataaacgttgtttgctacattgtctatatattttgaaaatgaatcgattcggggcgagttggtattgactggagaatagaaagtctatatatctgtgtaattgaacatttggagaatactctcacattaattaaaaagatataatcattaatttggtggatcatacttgtactaaaacggataccttctgaggtatggcctgatatagacttccattaaaatgctattctcttacaacatttgagaggacaaatgactatactaattaatgcacaattttttttctaccacatgtctttctttttttttctctatccatatatactaaagttttcctctataaacgcctagagtcgacgaccattgtcacatttaacaagtatatttctctctttttttttcatttctcttatatgtcagcaacttaaaagtctgtttattaattgtctttgtatctgccctaattaactcttacattcaccagaaaaatgttcatacatcaggttgatatgacctaccgtaaatagtagtttaaagtttgtgtgtcaataataatgcaatttataaaaactatggacttattaattgtattttattattttaataattttaatgttagaattatgaatacgaagtctatacatcctatgctctcaatttagttttaactttttattttaatttcaaattaaagacttgcatgatgtaaccaatatgtacaacaactaacatattcagtcatcgtctcgagtggcaacgaatagagtgttaaatcatcaaattttgcttgtactccgtgcaaacatcccaaaaaaagaaaaaaaaagactggataattctctagtgatgatataaagttacaaactcgtgcaacacatggattgatggctacttaatgatattccatgcatatttatgaggttgtcaattttaattgtattttagtgtaacgaactactatacctaatcttgttttgcttttagtatgactagttactatacctcatcttgttttgtttggtattgcagaagaattgtttttatcttctttgttaagctacgcgttatttaaggcatcagaagtactatacagttggaagagaatcaaccagtaaccatgacaaaaatatcagttgagtggcggcaaatcatgtcatgctcgtgtgggacatagtactagtactactaatgggcgatagcaactcagcaaggcgaaagaaaagaaaagaaatgaaagtgaaaaagactgtgttctttatagatgagacggatattttgtacgtaaaacgaaatgatcactaatccataattaattaaatattagtaaaagatatatttaaggtaaatttaatatatctttttaagaaatattttttaaaaaaaatatattatttcaaaatttaaaaaacatgtgcacggaaaaataaggaataacgtgcgcactagaaatgagaagtgttgcaaagaaagctttccagattgagatggattcccacggtgcgggggcttcacccgcacgcgcgctctccttcgccaccgttgccggctaaccaaaaaagtggaacacgaagaagaagcagcagaagaggaggagcatctcgcaacc

SEQ ID NO: 50765 - DNA, 2347 bp, Oryza sativa
ccgtcccacctcgcggcgggcgggtcaccccgggtcgggaccgcggagcacgactggctgtgggattgccgcggcatcggcgggggcgggagggactacgctaggcagatggaggtcgcggtgcgcgtcgtgcaggccgcctgcaccctctgccagcgcgtgcagagctcgctcctcctccccgcctccgcctccgcctccggcagcgtccactccaagatcgaccgctcccccgtcaccgtcgcaggttggtcttgttgccttcactcctgagcgagctcgtagcactggtcagttcgtcgccgcaatttagtatgcctccaaaatccatagcgagagattagtcaaactggagctccatcatattagaatattcagattgatactgattcattgttcttaattcagtccgaattcctaaatggaatggttgcttaattagttattgttgttgactttgaaattgagcgaccgtgtgcgtagtggtcttatactcttatgttctgtgatttcctaaggaagagaattgaatacttgcacttgacttgttggcctgttagaacactactaaataataatggtccactaccaggttcagtatgagtacaatggtagtgggtagctcatgctccatgttgccaacataccagataccagatagctcataataccacatggtcatatgtcaaatcaaatctgatctgatgcaatgttatttggcccacaaatttaagaagatctttgtgttaaatgccatcaagaattgtgactttgtggttggtatcttttggatgcaataaatttatgcttttgtggtaattggttaccagtagtaatctttccttcaaacgttattccagattggggcgtccaagcgatagtaagctggctactctcggattgctttcaagatgaaaacatatctatagtagccgaagaagatgatgagacgctatctagtagcgatggtgcagctttgcttgaatctgtcgttgctgctgtcaatggttgcttgattgaagctccgaagtatgggctgaggtccccagagaaagagctcaaagctcatgatattcttcaagctattaggaggtgcagctctatcggaggtccaaaaggaaggttttgggtgcttgatcctgtggatggcacgcttgggtttgtacgtggggaccaatacgctgttgctctcgcgctaattgaagatggggaagttgtattgggagttcttgggtgcccaaattatccaatgaagaaggagtggctcaactaccaccaacgatattacaggttgatgtctaaggtttctcctcccacatcaggatcctggcataagggttgtgtgatgtatgctcaccgaggatgtggccaagcttggatgcaaccattagttcatgactttggcaagcttgattggcgtaattcaagagaggtccgagtatcaactgttagtgatccaatctcagcaacattctgtgaacccgttgagaaagctaatacaagtcattccttcactgctggacttgctcatagtgtaggcttaaggtcagttcttgagtttaatgtctgcgcggtatgcataacctttatggatgctaatattgtgtaactacagccaaaactactctatacatttacatgccatatctgcaaaccattgcctgatctttcccgaatagtatacttcttttgaaactgtttcctgaataggatgctggttctgcatcagtataaaattaaatggcaccttcatttgacagttgtccgtttccatctattgtagcatgtaatttgcaagttttggatttatcgtactgttatatttatatgttttgcttggattccaggaagcaacccctgcgtgtgtacagcatggtgaaatatgccgcaatagcacgaggggatgtagaaatattcatgaaattcgctagagctggatacaaggagaagatatgggatcatgccgctggggtggttatcattcgagaagctggcggagtgatcacagatgctgggggccgcccactcgacttctccaggggtgttttcttagagggcttggatagaggcataatagcctgttccggaccattgcttcatcacagaattgtgggtgctgtcgatgcaagctggaactcatcaacactgtaatgcaaatagtacggatgattacagttggttggaccaatgtcggtcatagaatgcaaaggtgagttttacaaagaattgctgttgtgccctctggttgaaatctgttcagccatcttattctctgatagtctcctacgggaaaatcagctatttctaggttgcagaattagtatgtgttcatttcagttcgatttac

SEQ ID NO: 50766 - DNA, 739 bp, Oryza sativa
tttccttgctaatagaatagcacttcatatggtcatttttcacttgttgtatctatttatgttgaagatgatctatcctgatgagatgatgttaaagcaccgcctgacttcagctagtgagagcacaattgtgccaggttagagaacataaactatttccaataaccaatagtagtttcagattgcatttttggtgaacatttttttacattgactgaccttccctttgcttcttcaataggaaccgatgagaagtcggttaggcagaacacatacatgatgaatgctgatcgttttgatagatatgcactcagcaaagaccagttgcagcacattatgccgaaaaacacagaaagtgtacttgatatgccacacttgcaaaggtaaaagcttcttttgccacttatttatagtataatgaaagtaggctccattttccttatagataggattatttctttatagtacaccataatactttcctgtgatcataagcatattttaaggaaactggatttggatggcctaaagattagcgtgcgcctattttatcttgttttttcattaacatgtttagtaataaatgaatgtcccatagcagcaaggtttcttggtctgactatcttattctgagaaatagagaaaggaccctaaaattcaagctgtaggtagattaaacagcaagaactaacataattttgcaaattagactatgcaactgcaattattagactatgca

SEQ ID NO: 50767 - DNA, 2700 bp, Oryza sativa
tctacatttaacagtactctttatatcaactactccctccgtcccataaaagacaaacctagtacggaatgcgacacatcctagtactatgaatttggacatgtctcctaggatgtgtcacatctcgtacaaggtttgccttttatgggacggagggagtactccagaacataaaaacagaaaacatgagtttttgatggaattacctcttttctctataaaagattcaaatcctttattgagattttcaccaacatagtcgcaaatgttacgtttgaagagcctctaaaataacagtatgtttagtacagcagcaaatttataacaatacttttctgtaatactacatagacagactttaaggaaatggcgaactaaagggaaagtgaaattgatcgtgagcaattctgtgatcttaccaagctgcggtcatcaaaatatacatccccaccctcaatacggctgtagcatgcaatctcagaaggctgcatgaataggaaaggatttggatacatagataccagagataatatataaaaatcaaaagaatatggtatcattactcacctcctgaaaagcaacaaacttcctagataaagtttcttcactcttattaagcttcatttctgaaacaaaaccttcaacattacgcccatttccatgcgaaaacctcccaccatatccaaagttatgccgtcctggatggcctcctgcccttggaagaagaggtggacctctgccattccgccccccatatcctccccgagaatgattgttggtgttccgtattgagggtagcactataagggaaggcatggaatgaaatatagtgttgaagctcaaccttccctcctagataattcaaacattttaaagtgctagctgccccaagccccgcaccaacatatcaagcgatagccagtaaaataacccagttacaatctttaccacaagcatgggcattaccaatcactaatggacctagtagattgataaaatgtatgccaacaatagatatcaagttgttacacataaagcattagcatgatctccattccttccagcactaaatcatcacaaatagcgtattgattttagggagcttcctatcacaaatatgattagcatatattgaaggttttcaataaattatgcatgttttattatcaactttgatctttcaaagttcaaacttctatgtttctagttagatggcagattgagaagaatgtgaaaaaaattgttctacagaggaaatcagatcagatgcagtattcttcataactgtaatctactgcagagttcacttcaattatacttcaaattcgtttgcagatagatgttattcaactgtagtctacctataatcaaaacgggagattaacatactagcatagtgcaatgtaactatcagctaatccaatagcccctaacacttatcgttaggcagtgttcaatggctactctccaacaattatgcttgatggtgttgtaaaacatctcttgcgatttaaaagtgagttgcaagcagaagacagtagccatgatgtactgttactttataagacacattgtgcgtatcatatgcctatcgaaagtggaaggaagaattaaaaagtccagaacaagaataattcatcatacatacatgtgaaacccgcaattttctacatgctcactgaatcccctaaaccctacgatcagcttacccgcaaccaaaagaactgggttggattttgtaaaaatgccctaattaattctactgattagacatgcttagagactgatcattgtcacccaaaatgtgcacgataatttagcaaatattagaggcggacctgggactaggtagttgctacgcgcgggggtcttgacgtaatcctcgttgtcagagccgaacaaatccctctcctcctcctcctcctcctcctccgcatcaccctcgcccctctcctcgtcaccgtacccaccggcggccctcgcgggcgcgccgtcgaacgggtcgtcgtcgtaccccctggcgtccccctggtcgaccccgtcctggtcctcgcccccacccccgcccccgccgctgctgctggaggcgccgctggaggaggaggaggacccggcggcggacgacgaggaggatgaggacggggaggaggagccggacgaggcaccgccgccgccgccgccgtcggcctcggcgtcgtcgtagtcctcgccgaagatttcgacgtcctgctccgagaagtccatgggcagagagagagagagaccgacgaagaaaggtttctttcttggctttctggtcgggggggagggtttgtggtgcgatgcgatgcgattcgagtgttcggcacggcgaagaagaggagcttctggaagtattagggctcgctcaccggatcaacgggagcgagctgggctcactaggcttttggcttggttttgatccgggctttagattagatccaaggtaggcacgacacgagggtatcgtgtggattttgcgtgtattgttctgttgatgatacttatatcttgtaatcagccagctaaaacaactaaaacagtaataatctcataaagtagaaactaacaagtcttataaagtataactaacaaaggcaaataattgatattcagcatcatactgcatatgtattgctccctccatttcacaatgtaagtcattctatcatttcccacatt

SEQ ID NO: 50768 - DNA, 2372 bp, Oryza sativa
ccattcaccaaacattgataggtgggcccctatgaccaacaatgtgtgaagaacctattccttgcatgcttgcatggattgagtaggggtgcatggcaagccaccgccacacgctacttgtatcgagccctactcgggctacccgaggccacgatggattgagctaggtatcgtggtgagttctcaccatatcccgttcatggtggaccccgccaaggcatacccaagggcagcggggtgggcaatgagaggagatcctggcaagacttaccatatttgatcccgatacgaacaatatatttcctttagtaaagaaaaacaatatctttcctcgagctttgatcatcaggtgttccctggtgaagatatatggggagaaccaggacaagcgaggagggttggaagtgagagaaaagagactttatcatattttgtgtggttcttaggaaatccagaagagaggaagcataactattttgagtaatcaatagacttgtaagatcctcataacagataggggtaatcctacaaataataagaatagggtattgtacctccgagcttgtatacatcctaatgaactcatcggttctttcgtttctatattgtttacacgtgactagcctccccagccaaattcacataagggggttttgtcggatttttgctatctaatcatcaatatagttgagtactctctagaaacaataagtatgactgaagtggaatggaattattaattctaaaggtgaaatggaaaattttgctttgggatccgtgtagtgacaagtatttgcaaataacttttgtggtaagcaattataagtaaatgagaacagaagtagtataaacctaaataagcagtagacaatttaaatttcagaacttaattttatagccggtttatagtattttgttgtttttgctgttcaaccttatttgtagatcgctacagtaaacctagtataaaacttcattgttacagttacatgttttcgtctcatatggtgtattttggcatgctttcttatcgaacatgcatgtgcatggactagttttaaaatgacctagtagcccaagctagattatgggctctaatatgcatataaaagtttaaggatagtcggtatagtttactcatccgaatataagatacggtaaagctaagccacaaacaagatatttttatttttattgtactagaaaaatatctgtgcgttacaataggtggagacaattttcacgattgatggtagcgcccacacacttaggctgtgttcggcaccggatgttcccaactcctcttcctcgtgttccgtgcgcacgctttttaaactgctaaatgatgcattttttttgcaaaaagtttatatacagaagttgcttaaaaaatcatattgatccatttttgaaaaaaggctactaatacttaattaatcacgcgctaatagaccgctccgttttacgtgcgtgcgagatgggttcccaacccatagaaccgaacacaaccttagtagtacgttttttttacattttttttctcaagtttgaaaatactatacctggctttactcctatacttacaataactacggtccccatcggttggtctagtcttattataagccataacggcttattagagcaggtacaatagcagactataagctagctataaacatattttaaaaatataaaagaagagagataagggaagcgggctacagatctgtagccagctgcaacacggactccaagacgtaatatgtgtatgacaggtgggactaagtattaatagtgtagtaagcagctattgtatgaattgtctattacattggctatagaagatttggagctagtagttagctatactattaagcttgctcttaacgattaagaaataatatgcgagtaaaagttttatatattgttcttaccgattgaaaagccaaagttgaaaaaaactatgttaaaatagaatcaaaatcaaattcaaaatcaagttttaaaatttaaattttggctttagcttataagccgtagggcaaaggatgaggccatacattggaaaaaataattatcaaaacaacatcttgcctatttgaccattatacctatctaaccaacaaagagaatcatatcactccgtggaccaaacgatcggtaaaaaaaaaagttagcatatcactgaaactacatatagcgtgtacgggcacgttgcggggaagcacatctaggacaagcaagctccaaaccggtctatccgtcagctcagccctttcttgatcggtgtggcaagttagctcgccaaaaaaaagaaaataaaaagagaacataacaaagttgcttttaggtattcattcacactaacc

SEQ ID NO: 50769 - DNA, 985 bp, Oryza sativa
cagaaatgcggcagaatggcggtcgcctaacgttggagcagatcctcaggtgtggcattgcatctaaacatggatactaagttttatttgcgtggttatatttgctgcagtcatgtatggttatagttgctgctatcaaactatcgatcgccgaaaatgataaccctaaaaatacagttgagctggggcgctatacgacagtttgtccgctaactgtatgtgttcaaatgcatggggtttcaatggtggttcgctaagctgcatgtctagctagaaggatcataaaaggtggaaaatgttgtagtttgagtactgacgtggaaagcggtttttgcgattagtagtgccaaatttgatctcaatgagtttgtagtatttgtacgtgttcggcaatgtttgggtgattgtcggcagctttgttattccatctgtcctgcatcttttgttgtgttgtgacatagtgcttaggtctattattaacaattatcacacttagtgcttggaggaatgaaagatcactctttgtactacgattaaaattcaagccaggctgctcaggaagtcagtgtccagtgaataacatagttttgttttgcaattggtttgttgatttaacacacatcaatcattctacatgtggagcttgagttctctttaatttgtgaacaaaatgatcacttgtatgtgctatgaatttgtactatacaatgtgcaatcgtttattcccaaaattataattcctagaatattgtgaggttcgtgacggcgacgaatgaaatgccaacactttctggttcatatctgtaatatttggcaccctggacatttctccataaaagatataactcatatggctgttagaatggagggattggagcaaagatggttgttcactgctgcattaattctgttcctctcaactcaaactttagtttccaaagatctgttgaatacttctgtgcagtggaatagtgtgggccactca

SEQ ID NO: 50770 - DNA, 1617 bp, Oryza sativa
ctgcacccctaagtaaaaaactggattgtaattatttgcaaccttaagtaattaactgacaactttcaagatgaacaggctggtaaattaagaatcagaccagttatgagcaagtcagataaagagttattgggggtttgggggggagggggggttggtggtaaccactcacttgtatgcatgtgacaacgcgcagcgctcaacagcaagctctgtgttgctctgttcagctagtatgataaccgtcttgaaaatccttccatatagcagcctccactcgagtgccgtgcgatccacaggcccactaacatgcatgatcaacacaacatttccaaagttctttctccacttaatcaggtttccaatctcatagttcactgtaccaatctcatcaactcccaagtgcacagatggcagcttcttgggtacaaattccttcatgtcaccctctccaatggttgcccgctgcctgtcaatttccaatgacatgagccgaggctgccggtaacccactgcaagaaggtcctgcagccaggcagccgttaatctcacatcttgctctgtccagaacccttcctcagccatggcatagctcaaatcaagaatcctctcgaatagagttctcttgtttgacctccactcattcagaaacttgatcaaccgacccacattaacatgcagatccttctcctcagcgaacgggtatgcctgaatatgatccttccggtaaatagtcggcggatagaaagccacatacccaccaatctcccacaagatccgttgcgcccagtagccacggatcacatctgatgccattgagctcactgacactggcatcatgagaccccagaaagctggcgtgtggaacaatgtgttgaacgaattcaccggtgccatcgtgccctgaggcagtgccactttcggcgcctctgcatcaaacctgagatcaaacgccgcggttggtggcttcctagtgaagtagaacacggcatcgacatccggcaatccatctgagagcccttgctgaatgtattgctggccactgaacacctcagtgtagaacacctcgtgagccacctccccaaccttgtctagcggcagcccccgtggccacacggaacgctgcccaaagtgcacgtagggattcaccaccgtcctgttgggatcggcgtggctgtactgcagaagcacgggatggttggtgaccccagatcccaaatcgacatcgaaatgcttgcccagatcgttgccggggacctcggcgcggtcgtcggcgtcgaagatcaccttggccccgtgctggatggcgaagaggtagccggccgtcttgcggacgtgggacgcgtaggggaggaagtcgacggagcggtagccgagctgcgcctggagctcgagggagaggaagatggcgcccttgagctcccacccggagggcgtgtgggagttgccgacggcgaggagctgccaccccttgacgcgggcgagcgcgccgagcgcggcggtgggcggggacgagacggagaccacgatccacctctccgcgcggaacgacgcgaacggcgcccccgccgcgatcgcaagcggcggcacggcggcccacttgacgtccgggtacgg

SEQ ID NO: 50771 - DNA, 1200 bp, Oryza sativa
ctagtccaactgataggtcagagcaagatgctgcacttgatatgctatgggctgatttagacttcactttagagtcagagaacattgggacttattatgatgatgaggtacttttgctgcatgaatttatctgacattgctgacgtcctattattttccttaatggggttgatttgattatggaacatggcaaccctatctatattacatgattgttgcacttatctttgcagagaaaataagctgggtatagacataggttcttgttaatcattcatcaccattgctgcccaatttgttacattctattttaccactatttgtggtaccaatatttgggaacagcagtcttaacttggcgcagccaattctaagtagtgtatgtatgcgtattttgtgccactaccatattgcactctttaacaatgaacatatatttatttgtttggagaataaatattcctttatgttatctctgtataacagcagaacaccttttgatggttgacaacaggagattctggtcaattttaactatattatattatgtaattctccaaaattttccagtgtgacaaatttgatgctttcatttttttggtgtcatctagtcaaggctaccatgttgaaatgattagcttctgttgttttgtagggccaagaggacagtctgctagatcatgcacttgctcctattacaccttgttctagagggaagcatgaatttattattgatgagcaaataggaatcagatgcaaatactgctccttggtaaatctggaaatcagatttattttaccattgctggtgagtttagtatctctcaaaacttctggcttgcttcccacaacataagttgatcaattccattatttatcttgttcttccattccaggcctccaattttgcagagaaacctgcatggcgaaacagctcttgtttgaagactgcgttgatgtgtcctgatctttatgaacaaacagggactggtgatggacaatctcaagatttccatataaatggaactgtgtgggatctcattcctggcgtcattactgatatgtatcagcatcaacgtgaggcatttgagtttatgtggacaaatctagtgggtgatattaggcttaatgaaataaagcatggggctaagcctgatgttgttggaggatgtgtgatctgtcatgccccagggacaggaa

SEQ ID NO: 50772 - DNA, 4883 bp, Oryza sativa
  unsure (1)..(4883): unsure at all n locations
gtatgtgactactaaaaggttaactccaggctcacacattaaagttctgttaacataatagctgaaagagttttttattaggtagggtcatcagagttgagttttcctataaacagcagttttttttttttattaagccacttatgaaatatttcatttcttaatacattgctgctctactttcataagcaggaaattgagaaggctgctgaaagaggagagcttactgaacttgttcttatggtcatatggaatcgacttgatgttgctcgccgcgatgtatgctaattttctctttgaattatctgatgacttatgtattgtttatttttttatttatttcaagcccttgcagttttcatcttgttttacggtggtactagtcagtattcacccttttgttatcaaaagtgtggttgctttttttttttttcattttgggcgtaagataatcatagttgaatgtgcagaaaatgctttcgagaaacatgtaagtacgactcatggtaaagaaactcattaagtacgaatgttaagtattgatggaacaacaattgaattttggattccctgcccccaaaaaaggaggaaataatttaggctgtataacactacaacataccatttactcaccttgcagatttggacaactaaaacaccttgtgagttgtaagaactcctagatcccatgcatttatttttcttattccacactgccactcaatattacaacctgtaaacattgattgatatttaaacttttatcacttctgttgctcaattgttgatatctagtctttccataaattttcagcatagcaaaagtatatttgagaagggagaaattcctttgcctataagttctaatatctacaatcaagatatttgactagaggcagcatagcaaaagtatatttgagaagggagaagttcctttgcctataagttctaatatctacaatcaagatatttgactagagggataccatatttattttttttgaaagaatgggataccatatttattgtttagatattgacttatacacccgcaggatgagagggatgccatcagaagccttgatctcttatacagaagggtagaggtaagtcacacaggtgcaccgcacacagcctccattatcttatcattgttggaggagtccattaagctcttatatttatatcaatcctgttcatttgaccgcttcattggtctctgatgggctaatcagaaaccataacctgaatgcagacggaaattttaaggagtgaagcaactcctgctatgagattgctcatgaccttctgaatcttcatgatggatctgatgatgacaagtggttaaagaaatgtaaaaaacatatgcttgaagtttttcccagagaagacccgttcaccatgggtctttcctgctggtttcaacatggaggaagtatgttagttaatgcatgcttttcctcatgggataaattgaccatgctaaaaattagagttattcgagacttgagaatgaaaatttatgcttgagacatttacaaaattttaatttacatgacacaattccaaaacagagatgctgactttacagatttcacacaaaaatatcatcccctagttgtattcaaaattagttgtgccacttaccataagtgttaccaagtcttttattatacataacctcctaatcttagccatatacttcatagttgttaacgttgacagcaatgaaattttccttcaagcaagcatggacactgccacatccctcatagttaatttagttagtccaaagataatacgcgaatcatcgttagtcagtgtcatttagttgagattcnntggatttcgctggctccattctcttctttggttctctcatgctacaaaaaaatctgaattctttcttttgtcagcatcaaggacagatcaagctgccacctcaggatgatgatgttcttctaagagttgatttcatcagggaagttgatgagctcttgaaggaagttcaagctgcacatgaaaacaataaggtcccaactggtaatgacccggaagctgttgcgaccaagttgaagtatcaagagaagctgcggaccatacgtcaagtggaatctctcctggaactggcatcctccctgaaatggtgaggattgagtttgcagaggaccatgaaattctgcgcacataggactagaagttaccggctgagtacttgatagctgcaattagggtgcagccttttgagctgattctcaagtttctgctaattagaaactcctagcatttgaatacaaaggttagctgatatctgcttgggcgtcaatgcattttcgtagaatattttctgcacctgggtgtccaactctattagatttgtactgctctaggcattcagagttcaactgtgactcaagcagggaggctttgctctggattaatgtatcatcatgagaatggcggagggtattcacacgctcaagctctagcatgacgcagatgattttcaagccatcgagctgtgtctctagtgtgcataatccagatgcagagatggttgagtacttgagttctgaagttcccaagtcaaatactgtgtaaagattttcgtttgaaggaaaagaaaacattgaatgtaacattagtacaataacttgtaaaagtttttttttgtatggagcatgtgaaaatatctggaacaatccatggtttcaacagtagcaaaatttggtcacataccaaggcatcaaacattcgtatgttaccatctacctctgcacccgatggtgcaatgcaacgcgtgaatgttgcacgggcatagcacggttttcatttttggtcttgtaagagatggattgcaaacaatgccttttcaaaggaagtgcacctggatgctatgatcaaatatatggtgccatcggatggtcgaagcgatataaaagaaaatggactacctgagctattgttttttacccttatatatcagtcacttgatttagcgtctgatgactctatatcaattttttcttggagtgaaacaacgagcaatctaacttttaaatattgtaatagacttaccagtatgaaaaaaattgtaatcaataaccatagaaacatatatcggtcgattcaggattttttttgaacgactcgcatgagacgatgcgaagttctattgatagagcaggaaaaaattacaatattataaccctggagggtcataaccaggagaaagaaaaaaatataccaccacccacacaccggcagcgccaacacacacgaccaggagaaggttagcaccggaccagccgccgctaagcgtgaccggctgccgctagaccaacaaaggaacacagacgagatcgccctacagcaagggggggggggtgccaaaacgacgtcttcaagaagagaagcgacggaagaccgccgccgccgtccatcagggctcaaaggagccaagactgggctttcgcccggtaatcacccttaaggggtgagatagcacgacaacgccctcaggagggggaattcatcgttgtcggtccggccaaggctgggctgggttttcacccgccgctcaccacctacgaatctacggatgatgcaccgatgctccaccaccactcaaactctgccgacatgtggggccctgcacgaatgcccccgccggccaaccttcgtgcgccgaagaccgcgccacacccaccggcagctccaccacgcaccgaggtcgcctcttccaccgccggccgcgcctctcgcgccaagccggcctcgtccaccggacgcgcctctcgcgccaatccggcctccctccatcggctgcgcctctcgcgccaagccggcctccatctccgccgcccgcacctctcacgccgagccggcctctgctgccatcggctacgccactctgcgtccagccggtctctgacccctcctccaaacgatgctgcgccggccgatgcagccgtctgccacgccctcggcaagccgtacgaggccgccatgcttcctcccaccatcgtcacggtcaccacctcaccgtcgccgccgtcacctcacacccaactccttccccgcctccactgccgcatccttcgacattgccaccgtctcctcagtcacggccactgcaagtcggccgccgtcgccgatgccgctgtcaccagccaccgacgccagcagtcgtcgtcgcaaaccgccgacaccgccaacgcaaccgccccaacgccgtcgtcgagctctccgctgccgtcgtgaccgccactggggcaaaaccatctccagcgcctggatccggtcgccgatgccagcatcactgctagatccgacctccgtcgccagcctcgccgccacctccatccccgccgccatctccaactccgtcgccgacgcccccagcaagagaagcagcacaccaccagcacgcacgccatccctgtcgccgtcgccgcctcccctgccaccgttgtcgcctttcccggcgccagccgccaccaactgccgccaccacccccccaccttcaatccccgccgccaccaccaccaactgctgccgccacctcacaccgacccgctgccggcggcctgcccgccagatccggccgcggcagcccggatttgggcggtcttcgccgtcccgtgcgtggccccccaccgcgacgggagagggagacgaagacgagggtgaagccccgccgccgccgtccttgcggccgcgcggctttgccggcggccgctcgggcggcggcgagacggcggagggaggaggggggaggagcgggcgacgccggtggtttccacctcccatgtgcccgtgggggaggacaacgcgggggcgcaatacaactactccctttaactacaaaacggtcgattca

SEQ ID NO: 50773 - DNA, 2586 bp, Oryza sativa
ttaatctgcacaagatttccgagaatgcctttgatcgacggttcgacgcacaacacaaagtcagacgttcaactgatggctctagctctgcatgtgcacaagtccttttctctctcctaatatattagcgtacaatctttttgcgtgtccgagaaaaagagtcattttctctttccgcatctccttgcatgcaactagcatctattaggctccatgtagcacgaggtttttgttgtaagcgttaaatgatttttcctcgaaatttttttatctgatttgtgatccggagaagataggtgctggtgcaccgcttgtcggagagaggccaaaggagatagaagaaaaaaaaggaaaaggaaaaaaataaaactgtgtcatgtgatcgttgccacgtaagttagaccacggtcaaacaaagctttggattgggatgatgcaataaaccaagtttaggtaactcgatgcatgctttgcaagtttgtggatctaggtaaaaaaaacatgcttataagtttaagaatcgctggtgcaatttactcgtgtatttatttggtgtactgttcttctatgagcctactcaaagtaagagaactttgacttagcacaaaactaaaatagttaaataccttacattttcaagcagagggagtagattgttgtatctttttccatcgcatcttttaagaatttttccacctcccttatacaaaaatgcatatggataccctgctggctgcagcagctaatctttcaggcttacctaatgcaagataaccagtaaatggatggtttgtgtagtgaccacttcaaattcttaagcataccagcataatgcccgtgacactgcaacggatttgttttttaaaaaactatttattatatattattttaaagcctctaaaatatgttattcctattgtccaatatatcatagagcgatgagaaattccacaataagaatatttcgatatttttcttttgtctgggtcttgtttgtatggaaagtaaatctgtaaaatcttctctcacttttcgcaggtctcttttaaaatagtatagatattctgttgaattatgagatgtttttggtaaaagtatgtgccaatgcaaaaggccggtgtgtcacttgacaacagacaacactacattcattaagggcgtttacattgtgtcgaggtggcattcagcattttggcctcattgttcccccaacaaatattatgtgccacgtttgcttctggcacacatatctgaagttcgtgtatccaactttggtcacttgttcttcagtctaatcctgaatgagtgcatggggcgagagcatcgtgagcgcactctggaggtcatggcccggttcctccactgcacagcctgcacatgtgtatttttgcctttttccttgggtcacggcatggggattgggcacagtgtgaatggcttaaggccttgcacagtgcaaggacatggcgtgtggattcgtctacgtggaggaaaaagtaggtggggccatagctttggtttgttgttcgcttctcgctagagtaatgagtgctttctttgcacaagcctggtgcaaggcccacttggtgaggagcagccgaggaaagtgggagagagaatgcgaaagtagcggtggttgggttggggtggttggctcggggatgttggggtggttggctcggggatcccgtgaaagtagtttgcactgtgagagaagtggattctgtgtatttatcctacatggcatctaagataactcaaatgaggggcttgcactgctactggcatagagttcagctagcattcctttggcgaatgtaaaatggagaaattaccaggagtaactactttgcaagagctacacctttttgagcttataaaaataatttatggttgaggatagaaggttggttgaggagtataatacgcagaaatttgaactggatgtgattgatgggataaatagtacttgagagagtgacaagtattatgaaatacattttgaatggtagaaagacaactaatttaggacggagatgtattaagtaagagaaagtagtacatctttagcttcaaaagatatcctgggcacaataaacaaattagtactatatccatcccgttttaagtgtagttgtgggtttccgtatccaacaatgttgatcgtccgtcttatttaaaaatttatgaaaaaacattaaaaaattagtcacgcataaattactatttatgttttatcatctaataataataaaaatactaatcataaaaaaattttaaataagacggacgatcaaaccttgtgcataatcagttccaaattgtactagggcgttctctataatttttatcgtttctgatactgacggtgtggagtagtactggtatgttttctgtatctttttagtcatggttgtatctgttgattactactctgtcaaaaaaaaaaaaaaagataactcttagctattgaattatttttggacggaggggtacttgtttttgaatgactaacaatccttgcttgtcttgcgagaagagaaatccattatatttattctctccatccctaaatataagggattt

SEQ ID NO: 50774 - DNA, 3069 bp, Oryza sativa
agagctcgaggattccgccgtcggccgattccgacgtcgctgtgctcgccgactccgacctcccggcgcgcacgcctctgcggtcacccaccgcctacgccgcgctgtccgcggcgctccggtcggagggccggagctcgcctgctccgccgcctacccgcgtcgtctgctgcgagagagaggggaaagggaagaagagagagaagggagaggaaagaagtgaggagtgaggctgacatgtgggccccaccattttaaaaatacttttttgtgtgcagctgacatgtggggccaagctttttattattttttcgggatataattgccacgtaagcgccacgtcaatgccacgtgggacagagacctagtcaaataagccacgtaggcgccacgtcagccaaaaccgccttcaaaaccgccgagggatcttgtttggccagttttcataagttggggacaggtcgtacccggttttcggtcaaggacgaaaatcggactaggcgacaaatatagggacccaaagtgaacttattgcgctgcagaaaggctaagcatcggcacaaggtttggagcagcaggcttcagaaaggctaagcattggaaatagctttattatcctttttatacagaactagcaaggcaaatgcatgccgaggaattgaccatgtcatagaacaacctaactggtggacaagtagagctacgtcaaaggagcttccactaaaatttcatatctagaaggttaaaggcttaaagctacacaatagaaatggcaaatagttcagtgactttagtccgaactattgagaactttttgttccaaacaataaccaactttcatcaacatatgctggatttcgaaacacaattatactcctttaaaagggtatgtatggttttccgtttatcaaatatttcatcaaatttgaagggtacagcaaattgtatccctcaatggtgtatctcactgaaggcaacccctgaaagctcgcaaaacagccgaccgtggtgacactcttctcagtaaactcttagctgtcctttccttcactagggcagctggaccaagatgatcctcagtaacaatgtcactattgatacaacagtatacaacagcagaggaaaaaaaacagctacaaaataaacagaataaatgaaattacaacaatggagaaccccctgaaaacagaaatctatggctgtctactctgtccacactgtcacaaggatgaagtttcgttccaactacagaatatgtatttataccaactccattagaagagggtctcccgtggacataacccgaataagctttataaaatcaatctcgttctgtactttcactgggaaaacagcaggtgcgtgagctgtataaatacttgagaaagtctcgttgcccaccaagttgctcctgaacactgttccagccagagcatcagagtcaaaatttttaggcgagtccatcgccaggaagaacatcgggacagcaactttgtggtgcaattccaaatcgccgacaagtcccacaaggtcaccaaaatcctcaacaaattgacgtggtatgtaaaaaagctcactgccacagaatgcaatcttatcttcgcccatgctttctttatagtttgtctggaaatgaactggggaactgccaatgacctgcttaaccattgacccttgctttacaaaccattcctctttgttgttctccaatggaacagtaacccaagaatgtgcaatctgcagtatgagaaagtatgttatggataataacgtatcatgtgaattgattaatatcaaatacatgaagcctacaaaccttgttggttatccaaagtttttccttgtcagcctgcagcaggttccagtagttaagaatcatgtgatcttgcaggaagagaaatccatcagcaccaccgtatctcgcaaacaccttgggcagaaacctaattaagttacacaatattggcagcacgattagcacatggaagaaagttcaaattcataacattattgatcagctataatcacgacaaacatcaaaacaacttaaaggcagttaaaagttgcaaaccaacaatttgatacaatcatgcaaacccctttggttcagccatatgaacctaggcccctgaagacttgaacttaaaaatgaaatagaaatttgtaactatagttagtcctttctcagttgaatccctggtggaccactatattcatataggcatgtttgatactaaaaagaccacattacagaacatgtagctagtgaactctgacaatcaactactccctccatcctagaatataagaagttttagagtcgtacacggttattaagaaagtaagtagaagtgaatggtggagggttgtgattggatgagtagtggagataggtgggaaaaatgaatggtggagggttgtgattggttgagaagagaatgttggtggagaagttgttatattttgggacaaatcctgagggctaaaagttgttatattttgggacggagggagtagcaaatattgtaaagtatttttatgctaagctccatcatacaagtgtgcatttctatttagccttttcagtgaagacacactcaaatgtcacaaccattataaccagctcagccacaacaactgaagagtcttggaggcagtaccatcataatttgttgatgctcattattcaaacaaaaatggttaattatcgccaaaataacatcatatatataacgacacaatcagccaacattcaatgtggtttaaagagtgaaaaatttgagtcttctctacaaacaaacaaaaaaaaagaatcctctagcaaagttcaatttaacaccagcaggaattatctagtgatatgtaatgatataataataatgactttaagtatttcaagcaatgtgttcatttaaatatagtctggatgcaatcatcaatataaaatcccgacattacagtcctaactgtatttgacattagcataaacgatattgtcattaatgaatttcatattggattatttaacaaattccagagaacatgttcagaatgtgcatgtggttataa

SEQ ID NO: 50775 - DNA, 3117 bp, Oryza sativa
cgatccgcgcggggaggggggggatctctttgagcctaaggcgcggcgcccgcgcgcggtgtcggtcggtcggtcgcggcgagagcgagagcgagggcgagggcgagagctggagtgtgcgttactccacagtccagtggtggggtgtgtgtgtgtggtggtgtcccagtaggtggagcggttggtgggagctcgtggtcgctcgcggtgggggagaaacgcaacgaaacgggggaggagaaggagaggggtgagcagtgaggtgagcggagttcgttgggatcggggttttctggttttcttcttgttttttttttgctggatttggtgtttttctttttagataatggaataaaaattccaacctgtgcatcatgtgatgcacacagcccgtggatttgatgtttttatttacgtgtatagttttgttttatggaatgtggatcgaaatgggctggaatgataatcatctgatcattaaagaaacattaaccatcggtggcactccttgcacatgggattaggagggcaatattttggagatcatgtagatctagatgcttagtacagtacattttactactggtactcggcagttttttctagaaaacaaaactagggctgtgtttagatccaaagcttgaatctaaacttcagtcatttttcatcacatcaacctgtcatacatacgtaacttttcagtcacatcatttccaatttcaaccaaaatctaaactttatgctgaactaaccacagcctagtacttggagtggtccgtagtatattactctacttggcaatgccaatggactgcaaggggttgtccctaaggaatcctgagtaaagaaaaacagtaggaatatatcgtgctttaagtactgtaaccttgcagaatgccggtgaactgcagggtgttgtcgctaagcaatcttggagttaaaatggcatcttactgtatatgtagtacttgtagcgatgtagtttcttgaaagatttttttttagataatggaatgaaacattacggctctgttcgcaagattaggttcccaacacaaacagtaagcatgcaaaacggagcgtccattagcacgtgattaggctaagttcatatccaactacagctattttcgatttttagaattaatttaggagtttatatatatatatatatatatatattcttcacagggatatgtcatttaccgcaccctatattgttcctttatgctttatagggtgttcttctgggttccttcttctagattccttcttgattagtcttctgaaatctttgtttattcttccttccacgcccaaattgttgatattctattatcaatatatattgaaaaacatatttagcttaaagaattctattcatctggttgcccatgaccaccaagatccatagtgtccagatcagaaaaagaaacttctaatttctcatctactgccttttttatttgttcaaatttctgatccatttcttgttttaattctttaagtatttcttcctttaattccttctttaattgtggggaggcttcttcaaatttttctattattttccaatcaatatattcctcatctaatggatccactccttttgttaggcattccttgtatgtgggttttttagaatacccttcttcttttatagtcgttttaatgggtatttctggagtcttctttcctttagcttttttgcatttttgaatatattcttttgcagcagactctagataataatttattcctagtatttttctagcctggcttagtgcttcatcaatgtctttatatttcttccaagatattcctcccattaatttagcatatatcttttgggccacaatttcttcaaaagatatatagacccctgggagctttccatcaaatacgacatatataggcttctgttggattatttcatgatcttcattagctggcattaataacccgtttattaagtgaaaatattcagagaggctattcaatattgataacatatatcctttttcttcccttttattattgtattggtaccaaaaattatccaagatgcattcttgtacttcatctaagattatatggtcttttggcttaaatttatatgaatttggtgggaatattctgagcttgttgtcatctccaaatgtgaagcattcaattccgctgtaattcattgatcttttcatacctgcaattcaggtaaacgagaaagcatgtcaggcaaattattatctttccccttaatatgttcaaatataactttatagccgtttcctgttataatatcttcaaataaaacccatcttctagttgagcttttcttgctatttagctgattatagtacctacaaatggcttcacaatcggttctaaccgtgaattctttaaatcctaagtacaacctaaaggcattgattgcattgattattgccatgatctctctatctgtattattgacagtttttaatttataacttccagaagcatatctacatattttttcttctgatttagcggaaaatttagtaggtctttgctttaatatagtaccccaaccgtgttgtgatgcatcagtttcaataataaagtaactttcttctaatggtaattctagatgttttaattctttcaccctctcttttattaatcttactaatttaatgtcttcagaattaaaatatctctgaccattttttcttaatttagcatataacggtcctgctaactttgctaaattattgatgtgatttctagcataatttacaagtcctaagaattgctgtaacttctttttatcattcatagcatcaggaaattgtaaaattttcttagcaatatgttcttgcaaatgaattttgccctctcctatttcatgtccaaggaagttaattttttctttgcatatgtccattttctttttggataatattaacccattttgttccacctttctaaaaaatatttcaagatgagctctttgtaagtccttgagaagactaacaggtcatctatgtagactaatatgaattcttggttttcgttaaataattcagcattttcctttggaaaattgctggtgcattttttaatcctaatggcata

SEQ ID NO: 50776 - DNA, 770 bp, Oryza sativa
agaaataggagccaaaataactctggtcaagcctgagagaatccattgtgttgcaaagacagaaagaccagctgatgttactgttaggccttcatagaagctgtaatcatttatatatacattaaaggtccttgaactctcagagactgtatcagcaaaataaagagcaacataatagctatcattctggagaggtattggaggccattgcagcaccaagggtgcatcttgttctgccaccaaagctgtattaaacaccccaggaggtggaagattccaaaaatcagccgatgtgacattgtgggtactactgactgcatgtttactgtctgggaatggctgccaataccgattgaaggtgtcattagggtacctaagtttgaatataggaaaacaggtcaaaaacttgtacagatcttgtgaaatttacatacataagaaattaatacatgaatataacacagcatatcactccacattaacccgtgagaagataacctaaaaacttgagttattcagtccatcaaagaaaatgatccaaagagtattacttatttgtttcaaaattttcatttatccctataacctatgaatacacatcattgtccatcatatcaagattggctcagctttgcagtcaataaacatactcacttctagtgaatcatgtaatccccattcaacatttcatcactaagctaatcgtaatagaggacctaatggggactgcagaagttcataatagtgaaggcaagagtgatcgagcactc

SEQ ID NO: 50777 - DNA, 2107 bp, Oryza sativa
cccaggatccagactaacgatggcggcgagcggcgtagcccctccctcctccttctcccgcggcgtgtggcgaggacagagtggcgcaggtaagtggagtcggcggcgagcggtggagcccctccctcctccctctctctctctcgcggccggtggggttgctgctgctactgcaaggccgcgccgcgccgtttctccctcctcccatccgcgacgatgccgagcgggttgctgctgcatggccacgacgcgccgtttctcctctgcacggcgcgtcctcgtcctcgcatctctcatcagtgggccccgcactcgactttttgagcaaggttctcgttccttcgctgggaaccgaagaagctagtggagctatgggccccaccaacttttttcaccacgtaggacaaagtaacgcttcacatagacaaagtaacgcccccactgtgaagggcctaatagatgtcacatcactgccttatcaatggattttactcccaatactctctgggtgtgtttagttcgtgccaaaattgaaagtttgattgaaattggaacgatttgacgaaaaagttgaaagtttatgtgtgtaggaaagttttgatgtgatggaaaagttggaagtttaaataaaaaaattaggaactaaaccagtccctagtctctataaagtactacctcctaaaatataataatctagaatcgaataaaatatatctagcgctaagaatccgaacaaatcatctctctagattcgaagtactactaccttcgtcctaaaatatagcaactttttgctatgaatctgaacacacaattgttgagattcatagctaaaaatgtttacatttgagatggagggagtaacatatatcaaatcttatcatagattcttactacctccgccccaaaataagcgcagatttgatatatgtgtctaatgtttgaccatccgtcttattaaaaaaaattaaaaaattagtcacatgaagtactaatcataaaaaaatttcaaataagacaaacggtcaaatgttggacatgaacagtgtaaaactgtacttatttttgggacggagggagtataatatagtaatctaatatcagattagatatatttaaaagtataaatctgaacagatcttttgttcagattagtatcactaaaatatatcaaatctgaccatagagtcttatattttgggatgaatatagtacctctttcatatatagagggtgccaacattcgattaaaaatctatccggtatcgatctcacctactccatccttgaaccagctcacacctttgttctgtcgttgttttaccgacactcacaatgcaaagtttatattcgagaaggtaatcgcttggagtacttctaacagcctctctaaatttgactagaacagcctctctaaatttgactatttaaatatctatttagctagtttgttaaaaatattaaagagtgaaatttgactttcactctaatattcttattattacactttccaatatgatagtgggttacacatatcaatctttatattcttcgtcttccttccttcctctagatattttccccctcaccattttttctctccacccatttctttccatgccgcttggtggtaggtggtggacaaggctagcacaagatgcacaggaggtgacggcatggacgaggcgagcatagaggctgtgcgggagggcagggaaagggagggaagggcagagacacctccgtcagggaagccatatccacacaggggggctagcagggtgatgagctctccgaccgctgatgccaccgcctatgccttcttcgctagattcggtatcgagctcaccttccctccctacctcatgcagatcgacatagaggacgagcttgacagtgctggagaggggacgatgaagggagaatttgttggcggtgacacatgaggatgatggaagaggtgtggatcttgacgattgtgacatgacagtagaggggtttgactctgtgacatgcaagctttgatggcggcctcaccattataattgtcgagctgctcctcgtcgttgccattgtacaccaccgcttaaggtcgtatcctatggga

SEQ ID NO: 50778 - DNA, 2315 bp, Oryza sativa
tcattccgattagcatagccattttcaaaattcaaatcaaggtactcttctaacacatcaactaaaccaaggtggtgatacacattactgcttgatgagcagaattggtaaggaaacgaatcaaaaataaacgaaccaaatcaactctgctgtgtttagttcacgctaaaattagaagtttggttgaaattggaacaatgtgacgaaaaagttgaaagtttgtgagtgtgtgaaagttttgatatgatggaaaagttgaaagtttggaactaaacaagacaattaagttccaaattataaattctggctttggtttataaggaaacgggcaaaaatcattttgttcccaaggaggccctaatttccgagcaagcacaaaaacggcgggggacacgagcacgttgagcagcggtggtggaggcgccgattggctggccgatgcgaccaccggcgtccgtctcgcacccccgcatttgtgaggaacaaacccgcttttccccgcagcgcttttgcaaaagccatcttttcttgccaatccactcgctcacccatccgtccatccatccaccgcggcgtattataatctgcgccattatctcgcccgcgcctcatgatcgccgcaagattcccctagcagacacaaacccaacccaacccaccatcgctagctcctcctccgctttctttttctcccccaaccaaaccacccactcgccgcacacgcacaggtgacaaagcccacactgccaatgccgttttaataccggcgagacgccgggcacgcgcgcgcgcgcggcggatgacgaaacgcaccggcacaggaaggatggcggcgcgtgcaatccactgtaccacgctgctctgcgaacctactagccgtaacagcaaactgtactacctacttgtaggggtaaaaaaaaaacgaaatggtaaggcaaattaactgatcgctgcaaattaattagcccctgccacgacaaaacggggagtaaattaactgtagcagtaactagtagtataggcgagcacgatgcctcgatgcgtaggaacgaatgatttctccgaccagcattagcacggatctcgaattctcgatcacggcgagagaggagatcagcgtgaattcattctcgcacgccttttcaccgcatcgccatcgctacgctactccccctcttctcaagcaagcttgctgctgcatcaaccaccaccacaggtggatcccgaaattctaacggaaaaactactagtaaccggaatcgtgggatgaaattggaattgtggtgggggacaatcctaacgaaccaagaaccaaatggacgtcgcaacagcaaagcgattcaacgaatgtggaaatggaattgcgaagggtggggatttgggggggggggggagggcgtaccgttgggcatgagcttggggtcgacgacgagctcgccgtggatgcggaggccgacgatcatctcggagaagcagtggacgcggcggtcgtagcggaagtcgaccaccttgtagttggtgaggcgctcgaggacggcgccgtagcggcccaccaccagtagtggtactcgaggacgacgaacaccacctcgccggcgaaccgctgcgccgtgatgaacagcgggatcagcccgtcgctgaactcatggtacacgttcccggtgtacccgcccgtcgagaacaccaccgccggcacgcccggcgggtgccgcacgtcgcaccgccgccgcaggctgtccttgccggtgtcgccggcggtggtgccgttgctgccgctgccggcgtcgaccaccggcacgatggtgacctcgtcgatggtgctcatgatgctgccctcgaacttgcgggtgtacggccgcaccttctccggcgcgctgccgcggggggcgttgtacaggagcaccgacgaggtggacgggtccgtgcgcacgtcgccgcggaggtagcacacgtcgctccggtagtggctccggtcgcagcacagcgcgctctccgccgccgcctgcccgccgcccgcctcacctgcgcaccacccgattagcacaccatccccaaaccgccaatgaatcagcagcaatcaatccagctgagcaaaagcgattagctcctctcctcaccgttgatgagcgccgagcaggggagcgacgccggagagcgagtctcctcgcgagcctccaggttgttctggttggacggcaggtgcgtcttgaacgccttcacatcctcccgccgctccacgcgctctgcgaagcacaagaatcaccgccattaaaggacaccgaaatcggttggggggggggggcgaagcaatcaac

SEQ ID NO: 50779 - DNA, 4993 bp, Oryza sativa
  unsure (1)..(4993): unsure at all n locations
ctgcagcccctctctcgctctctatctctcaccgccgcatgctacgccgcccacagctcacaaacctcaccggcagggccacaaatcgagctgccggatagatatatacaccgcgagtgcgcgcgaggctaggcgggtgaatggcggaggagtgggggaggagggattcgagcaatcgagctagtagtagtaatggctcgtcacgatcagaggtgcaggagaagggggagagttgaggaggggaggtgggaagaagaagaagaggaaaatgaatgaggaggagaagggacaaggccgggctcggtcgggaggaatcacatggaggacaaagggaaacgggggcgaatttgatgacgctcactgctactgtactaattatgtgcgcgcccgcccgcgggtgctaatcgcgattctcccactgatcccctcttttcttcagtaccttcttctgggctgtcagcagctaatccgcactattggcgcacacactggcggtcaaaatcgatcgtagtagtatgccgcatgtgttcaaaatgggggtactgccaatgtgttatgagaaaccttgtggcgttggggctcatgtttcattgcggaattatttttgtactgggctcaacatttatttttcttatagtagcatagtaatgatatgtctctgaacttatagtgccattatagttttgagatgtggtaacgggttacaccaactgacatcagtattcacaaacgagtaagagttgtgatatgtcttatgggctattaattgtatctatacaacttgtctaatacgtgaatatatagaatgtcttttgtgacatgattttcttgttgttttggaatttttttttataaatgatacctacacggctatagtaatgccattattcacaaagcgtcaagttttagatgaccatgttatgtactcctaactagatgttatgataactcaatagctataaatactacttacgacatatataatacttagatggttaaatagatgtttaaagaaagagtacattaaaacattggattaagaaccacagtttctaatggattggaatattttgagtcctaatgagcatacaatttgttttatctagatgatcatgtcgcttggtggcaagttgctcaaaaatcttcaatgtggtaagtgacaacaaatcaacagaatagttcatgtcacccctaaatatttattcttgtaacacactatacatggctaaatggttttataacaaattgcacgtcatcttagcatctgctggcaaccttattatttggtaagcttggatatacagtaggtttgttcatcttaaattagaatgaacccgttggaaaactaaccataggcgccttgcgagcttgcccgatcaacttatacaatcaaatgctaataatgggttagaatacaataaatgagctttcctgaatggtggtatcttcacaaccacttgagatccgtaatgacatgatctgcaacacagagagttatattgtcttggagattctaaattaagtgcttaccgtctgacctagtacatttgtaaatacgattactacttcctctgtttgatatatattcgtctttttttctttaaaaagtacagacgcagacgctcataatacacggacacttatccttatgagcataaacacatgtatcttaatcttaagattgataaaatcatcacagacgcctagctattgacggtatgtcaccaaccactgttggaataattaattgtaaatatgagcacccctgtcaagcctagtatttaacctgatgggtaggttccaccacaattaatctaaccagttgagagctatgtccacttcacactgaacgtgtagagatgtagcctagagggggggtgaataggctttcctgaaattttctcaacaattacagcggttaaattaacagggcccgaaacctcctggtgatgaacaccggaacttccgggcaggatgagtagcccgaaacttctggagttattgagccaggaacttccgggcagctgagataaattaaaactgagatgaaaaacatgtcctagcaagggaagtttaggcacacagaggaacaagatgaagatcgcagaatatcagcagattcatacaaagatcatacacaagagagacaaagacgatttttttcccgaagttcggattacacgaatcctactctccgttgaggtgctccaaagagccgggtctcgattaaccccttgcctcacttatgaaaagatcccagaagaggtccacagccttcaactcaacacttctaggtcattttctagaattgagtgaccaccaagatccaactcaaaatttcttctagaaaagaccacaagtgcaagttgctctacctaggacaacctctgaaaactcagcacaagaatctttactcacttaccttgtttccttgtggaggtgaggaaaaccttcccaaactttcccgggacatccacaagatctttggaagctcacgggcaacacctaaccgtctaggagaagatctccaaaagtaataagcccaagtgacagcccacaagatatccaaagtgctcaatcaaacctaatcttcaagccatctccaaaacactcctacactctcatctaatctcataatctcacaagatatgctctagatttgagtggaggaagcaaatgaagcttgggggtggctagaaaaccctagaacatgaatgaacagaagtggaatcgccaaaaggtgacctggggatgaaatccatatatataacggctaggtgacgccatctagctgttactcacaagtttgaactggaaacctgctaggaggttccggataaaagtgccaggaacttccgggcagcacttaggaaatttttgcaaataaacggtgcccggaagttccggccagaacctccgggtagccctctctgtcccggggagaaaaacatttttcaaaaatgattccaaaaatcttttgactcatggataagactaagagcactttgtataccctagaaccacacttgaaacccctcttaatagtacggtttttcctaaactcaatttcgaaagtgaaaaacctagtctaatcaccttcgatgatttttgcacttaggaacattcgaattggggggtctccttgcattcttagccatcacaactcgctttgggactaaactcctgtgaataaacttgataaacacgttagtcccctttaaccaccttgtcattaatcaccaaaacccactagggggtttaagtgcatctccacacacatgttcgcttttgaactactatatcattttgcctgccttgcctttttttttcttttccataaatataatgggagtatctataaaacattcaacattttttaatgaatgttttaattataactatattataattggggtataattacattgtatctataatatagttacaacttaacttatatatgcacaaatataattggataaaacaaatggtgtggacgattagcaagcaagcattcagccatcctgtaattcgactcttggcttcagcatgcgtgtgtaatttttcccatcctgtgcaaatctcgaggcgatcagaggatcagaaaattcaaaagttttgagcagaaaaaaccgtccaatgtttttttaagccattccgaattacaattagcagagacacattgtaagatgaattagttacagtcagcatataacaggcaattctatacataaatcagttctatacatatcacagtatcactatttttagcctcaataccattgccgatcgcacgctagcagcttagccgcacggcgcttcatcttgccaaataagcaaccatctcactcctcctaaccgtttttcccaatttcccactagctttactactccacaaatctgcgtgacagcgaccgtacgtgcacgttacacttccgtggcgcgactcggcccgcccccgccgccgccgctgcacaccctgcaccgcggccgctcggtccaaacctaagcacaactctgtcgagactcgagagggaacgggtgaatcgatctgaacgggtcgcatcgcatcccgcgatgtacgctggcgacgcgcaccatactccatcccactccgccgcccgcacggctgcttctccccctcccgtgcgcgaccgcgaccgcgagagcccaagaaaggaatagctagcgcgcgccaggtagtttgccgcgcggggtggaaatgcttggatttctccgtgcggtttccttttcccccccgaggggtgggacggatcgggaatagtattatcgtacgtcgccgcccacccaccacgcgtgcgtgcgtgcgtgagcctgcgtacatgctctccacgaacgcaggggatatcgcgagagacgtggaggagatcgagtagtaaggagaccgaatcgatgggagagatcggtaatcggaggaggaggacagaataattaaccggtgtgtgctagagattatggagtccgacacagattagcactccactgctaactaagaaaaagaaatgattgattattgagagtggatgaatgggcaggcagggatagattattatacaagtattttgttggccgaactagaggggaactaggtggtgtttggattaagcactaaactgtagtcactataacatcggatgtttaacgctaattcaaaatattaaatatagactaattacaaaactaattgataaatgagagctaattcgttagataaattttttaagcttaattaatctataattagcataggtttactctaacatcatatagactaatcatgaattaattaggtttaataaatccatctcgtaaattagtctagagttatgaaataggttttatcgttagtttacgtttaatatttttaattagtatataaatatccgacgtcatagttttagtccctagtggtcttagattcttggggtcggagtcggagggttaagtgaagtggaaanntgacgcccattag

SEQ ID NO: 50780 - DNA, 8041 bp, Oryza sativa
cggtaaagtcatggtcctgtacgccggtgggctgtatgtgtaaaacatggaaaagttctccagaaaaaatgaaaacgtcggtgacgtctacgcagacttaactctgcagggcagtacggtgctgctgctgctgctacggaagctgtggatctcctagttacgccagccaccgttgccatcatccacagtgctagtggtacattttgtactctctcctcgtagtagtagcatgcagcagcaatagccacgggtactgcacgcggcgtcacggacggtggatcgaatcgaccgaacggctggtggtggcgggggcacggaaactactgcagcgacgcagggggaagcagtaaatggtccgaagcttaggtaggaatgaaaaaaaatagaaatagaaaaaacaaagtgtaaaacagataattgtaaaacacggaaaaaatcatcagattggaccgaaaaaaaaacacaagaatcagatgagagatatactcaaagaaattttttcaagaggttggttctcttggtaaattttctttaaaacttacgttcaataagctattacagataaattttatagaatttagaaaacttcattcctttaaatcaaatgaccaaatataaaaaatgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggcgcggacagatcccgagctcacaaaagggaagcggaagccaagacttggaccaaacatcacaggcgcgactgggaactaggccgaaaccctaaaactcatcgtagccggcttgctcctggaagaactcctcgtcagcgggatccgcttcatcttcttcagcaagggtgagtacaggagtactcagcaagccatgggaaataagtgtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaatgggccggtcggcccaagaaggcggcccaaagcgcgcgcgggggcggggaggggagagagagagccggtgggccgggtccatcccgcgtggtcccgggtgggacccgcttgtcggcgactcggctcaccgtgagcgaggtgcacgtggggcatgctagggtttggggagggaggcgcggcgcatgcgcgcggttcgtggaggacgcggtgcggcgggcccacgcgcagcctcacggctcgcggtggaccgcgtgcgcgagggggctgtcggtgacatgggaccgggagtatcatgactagaggcttgggcagccgcgatcacccacgtggcctgaccccctcgggggggggtcgggcccgagggtgatgtggccgcccctccctttgttctccccgaggggtcggaccattcccgtttcggccccgagggccggggcgccccgaccccctgtgggtttggcaccacgtatatgggttaggtgagcacagcggggctcacctaaccgcatttattgcgggttggatgagcgcgtcacgccgcatgtaatgccgcgcagcgagctcgcttatccggtccgtgaccaggcgcagcgtgtgaccggtcagatcgcgggttaggtggtggcaggtggcctgttacacgcctcgccccgtcccgtcggaatgatgagagcctccaggcacttatccctagccggagccggcgtgccaactcctggggttggcacgtcagccccggccagatacatgccaggcttcatcccaaccattacaaggaagtaattgtatgaagaagggcagacgtgcggcatgctaaactgacacatggtggacaagaatgaccggtctgtgactggtctgacaccggtcacgtcatcggcaaacaaactgtgctcccacattgcgtctgcagccggcggagtggaggtaggtatgacccgtcccatcgaagggtcattcggacaacagccattgcaaatctctgcccattaatgaaggattgacaaggtgatcccctgtgtcaggcgagtgtcggcgctgggtctcactcaaagacaagctatgacttagcttctaggagaggtggtgcatgtggtatccccttgagatataaaaggaggaccttgcccaccggaaagaaaaaaaaaggagagaaaggagaagacgatagctgatagaaaacaaagagtagggagagggtctctagagttcaaacgctcttgctctccacctctttataatttcttcatacacagatccaccagaacacaggagtagggtattacgcttcccagcggcccgaacctgtctagatcgcccgtgtcttgtgcatttgctctctcgcgaaccattccacatatcgagggcttagaaccttactcagcgcccccggccgaaccggcaaaggggggcctgcgcggtctcccggtgaggagccccacgctccatcaggggcggagggaagcggcggaccggggtctgcttgacccggtcgcggccgaggtggcaccgacgtggcgcctacgtggctgccacgtgggccggcgggaggtagacgacgacgccggtcgaaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacagcgatgaggtcacaaggggccgattcccggcggtgagagcatctacgcggctacgggaatccgttgctagcgtcggattgggcggagctacgccgagcgaggccggcgacgagcgggcgctacggagcacgggcggcgacggcggcgagcacacagcgagcagcggcaacgatcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagaaggcgagcgcccggagtccccttccgtgtcctcgctcgtgccggctcctccgacacgtgcgacggcgaacggcgacagcgaacagagcacgggaggcggcgacaatggagtggaggcgaatgggagaggaaaggaaaggggggggaagcttgggtttatatgggcgacaatgtcggtttgggagaggggaaccgactttggacggtcaagccagcgagctggcgctctggctagcagccaaatcggcgacagggaggaggggaatgacgccggcagaggaagaaaaaggaaaaaggaaggaagaaagggggcttgccccttgccactttgggaaaaggaggaggggatgggggcgactcggcagagggaggaggagctctgcctccgtcccttggaggctagcgcgcggagtggcgggggccgggtcgatgatgacggcgatgacggcggggcggtttggagcggagcgacaacacgggcggcaggcgcgggcaggcgcggcaggcgttggcggcggcggcgactggccggtcggccaccacggtgcgcacgcgcgcgggcggcgcggcgatttgggcggcatcggcgggaacggcagcgagagcggagagggaggagggctcggcgcggctcacgggcagagcggggagagagagagagagagagccggggagcgagggggagatgggccgagagggattcggcccatcgaacccgagggaggcaaaatagacttttgcggagggatttgatttgggaaggatttggattcgggattgaactcgacgatagatcggggatttgagatctgagatggcacggacactagacaataagcaaagaaacggatttcgcaaatagggtttttaagagatagtttttccgctaggcgccacgacggaacgggcgctacagaatttctataaaattcttctactaaattcttttgattcaaatggccacaggaatcagataagagatatactcaaacaaattttcctaagaggttagtccttttgctaaattttctttaaaacctagattaaattagccattgcagataaattttataggatttgaaaactccaatcctttaaataaaatgatcaaatagaaaaaatttctataaaattcttctactaaattcttttgattgaaagggtcttaggccattctcaacccaacacactagacatagtttccataagctccacatcatcaaaaaaactagtactagacactactcttacaatgcaaaaaccattattccatacttaaatttagtgctacttatctcacatgatgtcttggatattgtgtagaaccatgtctcatgcaaaacatggtttcctttgctttcctcatttattcatttgccacgtcacttttcatcttaggtagtaacttatttaatgctatagacaccattcttgtcattgggttgggaatggcattaggagtagtacgtccgctgtacgctgcacgagccggggagcccaacggttggtggctgcctgccttcgccaatttatttcgccgcaggccgcacagccgatcgatctgcagagcagcagtaaaaacgctcgtaacgacggggtgttttggaccggaggaatggcaggttccagatcgatgcaaattcgcggtgaattcttcttctgctactgctactgctgctgccgctgcgttatattagctgtgatctgggctgtgaagtcgctcgggggatagaaaaaaaaattgctcgtggctgtcaatgtgaatgtttgttggtgcagataggtcgttaggtacttgcatgatggtgagggttttgggggcggcttcggatgcaagggattgggttacttctagcacggttggtgttactacgtacgtacgtgcatgcgtgcgaatgattatattctagcttcaagtgcacactatctgatcccagatcaagtcgtggtagggttcatacactgggttgtcgatatatcagttacaccttacgagaaagatatggtgaatgcctgttttcagacaaaatatcttttttttttagaaacacaggccaataaatctatgggtatatctatacctttgaattctaaggttgtgtttgtttctaatggttgggaacctttctcctctagcacgtaaaatgaaacgacggtgttaacacacgattacttaagtattagctaaaaaactttaaaaatagatttatataatttttaaaggaactttcctttataattttttttgaaaaaatacaccattcagtagattgtgaagcatatgcgtggtaaaagagagagtagagattggaaaagtgtatgattaattaagaagagaattggagaacattaaaaagataagaaaaacgagatgaaacattatagtatacgattaattaaatattaattattttaaacttaagaaacagattaattaatactacctccatattttaatgtatgatgccgttgacttttttttcaacgtttgaccattcatcttattaaaaaaatatataattataatttattttattgtgatttgattcgtcatcaaatattctttaagcatgacataaatattttcatatttgcacacaaaatttgaataaaacgaatggtcaaatgctagttaaaaagtcaatggcgtcatacattaaaatacggatggagtatgattttctaaagcaattttcgcatagaagtttttttataagaagaaacacaccgcgcagcactttgataggcgtgcaggcggaaaatgaaaaattttcctctcagaccctgtttagatcaatttgatgtggcaattttttttagaaaaagttttggtggcaaaagatttggtattgaagttttgctagttggtgtttagatgcatggtaaagttttaccattttactagtaaagacagagagagcacggttcccaacatacttttttggtaaattttgctactctaaactttcaaatgacaaataccaaattgccaaccttttctaccagtgtttagattcattttagcaaaagtactctaaaacagcaaaaaaaaatttgttattttggagaaactaaacaggacctcagccatcttgtgccgaacacagctaattaattggataattccaaaggcgctccgatgtaaaccaaaaatcttacacattgatttcatgtattattgcgaccatagatactgttgagagtttgtaataaataaatcacgtaactggaaatagtgtgcactctactttactaattttgaaatttgtaattaataaatatgatatcgtaatcatttcgaactctcagttagtttagtgatatgtaaaattaattataatattccaatttactactctgctatgttccataatatagtaaccgagaataagacgagagtacaacaaataatctagatagacgtatccagattcgttatattatgaaatatgtttcatccaattataggctgctataatta

SEQ ID NO: 50781 - DNA, 722 bp, Oryza sativa
ctgcagccctacattgttcaaaaacactatttattcggctgattactattcagtttactgtttattcggctgattactattcagtttactgtttgttcggctgattactattcagtttactgttcaaattactgttcaatattgttcacttcgagagatattttaactttaggatctttgcagggtggcgaatcctacttagacagcctcagaagcttgtttcagatgatgtaaagtcctactcggtactcaccgtatgcctcacctatctgtctttttagaagcaacttaaaaagatattccaagtcacacttgttctagctaagagtttatcgtctccccaggcagttccaaccgaagggaacacttctctacggataccgattctccagacgcctatgcaagatgcaggctaaaaacgagaacaaaccgaagaggtttctcctatagggtccttagcataaacacttgtctagaactaacgtgcaggaatacttaaggaaaattacttcatattaaatagataagcttacatacggttttcccttttgggaaacccgaaggtaggtacaagcaagctgttcttaccttacacagcgttataacacaactccttgcttcaatacactatgcaaggtaggctaaagtcactactactaagaacggtggaatggagggtgagagcgcgcttggaagctttgctctgaatggtgtcttcgttg

SEQ ID NO: 50782 - DNA, 845 bp, Oryza sativa
ttaattacgcacagtcaagctgtctacttacaattgaaaagcaatttgttgcttggggaagttcatcatgcaggacagttgcacacttgcactgcagtgtttagactttttgtggggagccacagcgggtaattccaagggaagagtttaagctgcctgctgttgagctaaactgtgtctgtctatggatttcttctgctgcattgccttacagttcatccttttgcaaaagaaattctatagacatgaagctagcctgaatactcttgtaaatcgaggtgattgggtaataagtgttccttagcttaatcgatcagatccttgtgatctaaataacattgcgtgttcaatcgacccacgttgcatttaggtcctattgtactgaagccttccataaagccatactgcagcagcactattgggcctgcttgcttttgtcccttttccaactattggctttaacgattgtcaaccaccggaactgctcttaatgtatgtggtatttgactcttacaggaacgaggacactgtaacactatactgaataggggtgtagttcttgtgctaaattgctgacacattgaactttttattgcaatgtttcatccgtaggctggacaccagcatgtgagtttaaactttcgtggaataaactattcagctgaagtgtatttgaatgggcataaagaggtacttccaaaaggaatgttccgaaggcacaccctcgatattactgatgttcttcgtccggatggtaaaaatctgcttgctgttcttgttcatcctcctgttcatcctggtgcaattcctcctcaaggaggtcagggtggtgatgggctgcagga

SEQ ID NO: 50783 - DNA, 1626 bp, Oryza sativa
cagtatttgctgttgattggtagttagatttgtagtactaagatatgtcttatcttgtaataaattaacttattttgggacggatgggggacagatggagtagctacaattttcgcacactgttaggattattaagaaggtaaatttgctgatatgaaagagaggagaaaggagagaagcattgatattaaagttaacaatgacttaacatcaactcttaaaatttataaaaggaacctttgttgtaggaggataaaaaaggaaagagtaataaaaaaaattgttctgtagtccgtacattaattgttagagcctttatcgtctcaactattatctctgaatagtctttaaacgtactaattaaaagcctatactagaatatctacctttgaacatatccttataactcatcatactattactacaattaaattttggataacccagaattttgggagccctgtagttaaccctgaactcccatatacacgggcctgatgaaacctcactgttgattcaaacttctatgaaaaaaacatcttcgacagcttgcccacttcaaacataacataggaaatgggagtattgtacattcacaaattattactttgtaccatgatcactcctgctttaatcactattctccatacatacgattgaaaatggttcggaaaatttctggatgattgaaaacggttcagaaagtttccggattccgaactgttttcgtaaacgggaaacattggacggaaattttcaaaaccgaaaacaaatttggaattcttttcttgaaaacaaaaagggatgcagtaatagcactatctgtcagaaagcgaaataggtcaaaaactttcttggagaatatctgaaaaactaatttaaaactttttttgaagaatgtttaccgtctcaaagatgaaaatttgaacttgacaaagtgtttatgaaccgtgatattatccttatgatacaaagtggaaagtggtactattagctgctaaaattttaaatttttatctattgttttagaaagaaattggaaactcggtttccaataaatattcatcattgttttcacattcaataatattctattctgttttgatattcgaggttttctattcatattttttaataaaaaaatgtaaacgaaaatgatagatatggttcccgtcttttttgagtcgttttcattcctacttgtatgttcatatcaaataaataccacacagtcttttcttgtcaaaaaagaagtcacaccaacttgccaaaatgtgtgttagctaaggtgtggcgatcattaaaagacgcgcaagaatatgttgaccacatattaagtcaaggtgacaagaaaaatagagagtatcacgtgtggagtccgctgcaaaaatgtggcatgatatatacacttgtgacagcgaaacaaacaacagttttaaaagttttaaaaggtttgacagtgtttggcaaagtactcactcaaataaacaccctctttaattaggagggcaattttactaattttgaatcttgagacgttaagatatatagatacaacctcatattttatcaatttttaacattggaaatgttaaatattgataaaactaaaactgttactacaag

SEQ ID NO: 50784 - DNA, 2703 bp, Oryza sativa
  unsure (1)..(2703): unsure at all n locations
cgtatacctagctgatttcaacggtaatggcttctgatgagcgctataactgtgcggttttcacgagtaccgccaaaccgtgggtgacgataaccacaccctagatcaatcagatttcttacagttataaattctacnntacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccccttccccctcctccaccggcaccaccggcggcggcggcggcgcgttcttcgactggtaccaggcgtacccggcgctgcggccgctgctccgcgcccgcctccccgcctcctcccgggtcctcatgctcgggtgcggcaactcccgtacgcctctactacctcttttacctgcgtgccttcactcacactagcttgaaactatctgcgtactcaaattcaacgatttcggcgctaattcgtcgcgcgcgccacatatttttgggaatgcactggagtagtagattaccctgttgcattgttatactaattatacggtcacacctatccgttgcatgatgcagtttgatcttattttggcagttttgtcggaggacatggtgaaggatgggtacgaggaggtagtaaacgtggacatttcatccgtagtcattgagcagatgagggagaaacacgttgatattccacagcttacatgtagtgttttcattgataatttcaaactcatagtttgtgaattatggtttctatgcaaggtctatttacttggtgtcttgtgttttaagatttccagatggatgttagggacatgagtttgtttggtgatggaacattcgattgtgtccttgataaaggtaccttaagaattttatttaccgaagcttgctaatgctcttgtggaatacttttttatggaatttactgaataaattcatttatggtatttgtttatttttcaccactacacttaccttgttatgacggaattatggaaatttctgaaggtacattggacgctatgatggtaagctttacttgttgcacaaacaacattttagctttctgatcaggcatgaaatgaaaaatcatctgaccattattgttgttgcatttgatcttactattttagtgtggcgatgatgctcctcttggtgcttccaaaatgctagcagaagtggcaaggtgtctggcatgaaagtttatccttttcactcttttcaaactagttggttcccaatgattcagtatgtttcatgttgaactatttttccccttgcaggattcttaggcctggtgggatctacatgttggtacatcctctaaatctaaacaatacagtgtgtaatcattttgcgtgggatgatcttatggagcgatgatgttcttttgcagataacatatggttgtcctaaggaacgagtgcaacttttgtaccaatctggaagccacaaaaaaattgaactgtacattatgcgtaagtatttttcttatgctatttcttgattcatggagctggacataatttgaaattccagaaggaaacactgaataatggggagattcaggtttgactgattccaaagggaaacattggttccaaagattggttgattctaatgggaaatcttaaaactttgatttgacgctatgcttttaatttctcagttggacctgataaaatttactgttatcattttgcagccacacctggataccagttgaaatggagcaaaggtgtttcacttgcacaacctatcatggaggaagtttcattgacagtggatggtcaattaccacctgactatgttcttaaagatccagagtcacattttatttatatttgcaaaaagccagatgccgctaatgaagctaattctgtggttgctaatgaaggggaaaccataacttcaaaatgatcttttgtatccttaatttgcattttgttttgggttgctgacgagccttggatagtatgtgctcataataaattttgtcagatgttactgttggatgaaaatcacgaccctctttagccgcctggggccccaaaggttgccaatctgtgctcgatatttcttctcggaacttggaagatgtgacacaaaattcatatgtatttcaatatgctttggaaggggccagctgagttgtgttaagcttgtttaaaacgactgagttcctgtttatatcgaca

SEQ ID NO: 50785 - DNA, 1314 bp, Oryza sativa
caaaatcttatattcagatgatgttaaaaggtttagccttctgccataagaaatgggtgctacacaggtatccactaataatcttgctaaatttcttttagagagagtatcctttgacaatctgtgctgtagggatatgaaaccaaataatttactcattggcgctgatgggcagcttaagcttgctgactttggtctggcgcgcatatttgggagtccagagcggaacttcactcatcaggttcttttttgtggaattatatttattagaatttaattctctgtataatctagtcgattgtatacttggaacttgagaatcttgttgctgaaacaaatatgcaatgaacatttcttcaagtgtattgatgtttcttttgtatttttttaactcggtcgatattgctgtttgatgcttcgttgttctgtttatcaaaaagaacatccttgtggatattttgcgcccttatgctttacccttttttcaacaacagtaggcacctaggaagtagaaaagcttaaatctttatggatggaacaaaatgcatgtggggaagttcttatgttatttcctggacatttgagttggcagagttggattttgaataaatgtcacaggatactgatttcggaagtatgtgtccttgaataaccattttcttggtaaatattaatagtgttggaatgactgtttcattctgaattatttgtgctgattttcattcaccatcatatctggaggttctcttaaaccatctttttatcagttatgttgacgatagtcaaggatcaatgctacacttattacagcaatgctgtgtgctttgcttaaatgagtgttttttattttttattagtttcactttgaatcatattatcctgatgctgctgggcacttcagttttgaattttttttctcaacatataggtctttgcacgatggtaccgagcaccagaattattatttggcaccaagcagtatggatctgcagttgatatttgggctgctggttgtatttttgctgaactgctgcttaggcgaccgtttctccaggtttaaccgactcttataattttatgctctgtgtaatttcaatctatttataactaagcactttttatgctctgagaatgttgcatggctaagtttgctgttcctatatgttgtgataactgcatgcgtaaatgtgttacctcaaaatgttgtttccaaagccagattggacttgtagttttcaactgaggaactggaaatggtcaggctctggtgaggtgattgaactgaacctgtaaatgatttaaactttgggttta

SEQ ID NO: 50786 - DNA, 707 bp, Oryza sativa
tcctgcagcccttcctcttatgcggcccgggtcggtgctcctccagatcgtgcccgtggggctcgactgggccgccacgcgttctacggcaagccggcgcagcagctcggcctcgggtacctcgagtacaaggtggcgcccgaggagagctcgctcgccgccgagtacggcgtcaacagaccgtcgtgcgcgacccctccgtgatcagcagccgcgggtggtgggagatgaagaaggtgtacatggaccggcagaacgtcactgtgaacatcaaaaggttcggcgagctgctccggtcggcgaggctgcacctcaagaacgccaccgcctgcggcaaggccgcctcggcggcgacgacgaccgcggcgaggtaggggtggctggctaaaccaagctctccgtcaattaggtgttaattaatcaaccaatcaatcaatcacagctgttaatttgcccatgtttttttctcggtttattttttttttcatttcatttttctgctcgtttttggttggggggtttgggaggagtataattaagaagggtaaagaaagggagatcctgtaaatagaattggatttattggtagggatcgcctccgtgcacagtgcattcgttttcagttcggtgttgttactaggagggagaagaataatttatggttaggggttctcataaatcatcttcttttgttagtctatactact

SEQ ID NO: 50787 - DNA, 1445 bp, Oryza sativa
attatgttgaatacagtctaattttaagacaattataaacatgctatgcagaagctgttatcgttctttctctagactgtggtagatcctttttcatttctattaatggaaatggagggctcttgccctttgctaaaaaaaattgcagaagctgtatatactgtattcaaatgaaaaaaaatattgacacaatcaacatagtatgaaattataatgtcaaaccataaacgaaaagctatacaagtcaacttacagttcacgcaaagatgtgattatccccagtgtctgcggtactgttccatttaatttgttgtcctgcaggtgcctacagaaaagagttttttttcctacgtagtggataagtaagcattattcaaatagtttgggaattgactagctaaggaatagcttacagtcttgtgagattcctcaggttgctgagatttggaataggtccagacaagctattgtttgcaaaagatctgttcatggaaataggttaattttggcattcactcagtttgatatatatgcagcagaacttacatatcagtcagagcggtgagccttgcaatatcagatgaaagatatccagagaggcccatacttgaaaagttcctggtgtaaaccaatacagaaaattgttaccacaaaggggaaaagaataaaatcaaataatataagcaccatgaggataactcacagtgagatgacacgtggtatttggcctttatcacatgtaactccagtccaagcatatccatgaggcatacatggatctccattccaatcatcaggtatattttgaaggcttctcttaatagcttccagggcatgtgctgcagaaattgtggagtaattaatacgttaatctaataaaaatatgcatatgcagactattcaaaggtggtaatcaagtaaaagcaacttggtgcattaccaaaaaaatcagtcaatagttcaatacagatacttaaggaagcaccattgttgtggtggtggagtcatgggtgcatgaatccacccaccaaggttcaaattctggtgtccacaaatatggatgtatggatcctagttggtgcaaaggctggaaataatacttccattatctaaatataggtgatgctacaacattaacacctcacagagttacaaagtgaaatgtactgtggcccttttttttgcgagtcccatgacctgatatgcagcaacaaatttccataaaacatattttgatgacctgctgctacatatataatgatgatttgttggccacataagtgccaccaaaggcataatacataagttgattatttggttagcaacagcttgtattgatcaatactgccacgaaatttagtcatttagtttaacctattacgaaaaaagatacaaatggaagaaaaaatatatgtagcgactgacataccatcccgaggaaatgt

SEQ ID NO: 50788 - DNA, 2256 bp, Oryza sativa
gtgcctcttccctcctccccgggtcgggatttggcctctctagcaagggaggtcgtccccctgtacagtgactcttagtgacaggaaggggtagggagcaatggcgttagcggagacaatgatggcgcagtcggacatatccgtgcatggacagcgagcggtgatggagttcgctgattcggcatggccgtgcccagatctacatccctacccgtttccgaaccccccacgataaatctggccagagttagcgcgacatagacagcggcagcggccggctcgtagagacaacgacaacagcgggagggcgacgcaggtgacatcggcgcaggtgacaacagttggagattggcgtcaagaggtcaatgcaggcgacggcaaggaggccgccctggctgacatcgtcggaggtcaacgcggcgatgataagaagggcgacgacgacagtgtgccacaaaggtatgcggaggctggttggcgggggtcatcggtacagcagtgtccacgcattgagataggatagtcggtggtggagcaatagctgcgaattgactagggagagcggcaggtgtaaacctagcccggccatgccgggcaagcaatgacaacgcttctggtgtcgttctccctcctagggccgtttttgagtcgttcctggtgaaaaccatgtcttggttctccttgaggtctcaagggaaggtggcgtcagtgctcattgtcactcttcttcctggagatgtcgtctaggaggcctccttaccaaaacttctctctgacagcttgtgtgtactctctctatatgtttgtcctcttactacgacaccctaaattctgcaagttgatcatattggcgggccttgtgggggagagcggatccatttttctctttcaccctcttccccttcaatcccgaagatgtgaatagagtttgagtttggtgttcggctgttagggtttggtttagtgcggttcagcggtagtttcgttgttggtctagcggcatctggtccaatgctagcgttgttgtgtacttgtgtgtaggcaatattggtgcacggtggtgttttttttttcgttcctggctactgcctttccagggttttagccttgtgttttttcctactccattcaatgaaacaacacgagtgtctggtgcagttcattaaaaaaaatactggaaaccaacttactacttaatatgtcccaaaatatagatattattttaacatagcaccttattttgaataaagttgtttctctatcgatctttatctctcaacctctgttcgtcctctgagtcttcctctaaagtgtcatatttatcctctgtaacaattatccatttagtttattcaccaactttttttctcaaccaatcataaattttcttcaattatttctatctattttctaaatattcgtaccaatctaaaaaatacttatattttgaaattcgcttcttcgttgttttcaccacttttgaaaatttgaaaatatttatcactacacggttacctaggtatcaatttccattttactcttaatttgtggagctaaagtaatgttcagttaacgtatgcatttagaattgcatacctcaacaacatagggctgggtcattttacttagaaaaaggttaattgtattgtattggaactcgaactctccgtggttgccacttgccacatcagtttgttcagggtgatttggactttttttccacaaaatcagtataggatttaaaatagatttactagacagatccatagctcaagcactaattgccacagcctagaacaggccgaagagggccgatagaagggaaaagtacaccgaaggtccctcgacttgtcatcgagttacaaaatcatcccctaaccgcaaaaccagatatctgatgtcccttaatttacaaaaccgtttactttaggtgcatcggtggttttgaccctggttttgtcctacgtggcggctgagtcagcgtgggacccacatgggccccacatatcagcatgccacgtcaatggccgctcctcccttcctcctctctgtctctctctccctctctcacttctcctctcgggcaggctagccagcgggtggggatgaggtcgccgacaacggacgtgaggacgagggggtcggcggcgacaggggcgaccgagtcgacggcggtggcggtgacgttgaggaggttggagatgaagacggcggaagcgtatagcagtggggaggagcaaaacgatggccctcgcc

SEQ ID NO: 50789 - DNA, 3772 bp, Oryza sativa
ctttccccaatagaaaaatctgcgttgaatgggctagtgtaagcctaatttcactcgaaggaaaagagatgcacttgggcctagactctgggcttgcgagccaaggttagcaaaaaggtgggccggctggcgtcttggcgagcagctccggtcgaagtcctaccctcctgtgagctgtcgatcgtgattcgtgcaccaaaccattcgtcggattgtcggaaggtagcaaaaggaggcacagaccacaggtagctactccctccgtcccataatataacaatctaggatcgtatgtgatgtatcatagtactataaatttggacatgtctcctgtccagatttgtagtactgggatacgtcccatccgattctaagttgctatattttggaacggagggagtacagtgaacggataggttgccctccgtacgcccatgtggcagtcacgaagcgtacagggtgttactctttcccgttgcaagaacgaaaaattgctgtcaatttttgggaccagcaatccctttctcaaataatatgcacgagcaactctaagcgagatctttcattagcttatgcaggcaaaattgctgcgtccgcataggttagccggtgtgaggttgtgctgattggcaattgaccaacgcagcattcacagattcactatcatcatggcacaccgaacatcacatctcagcgaacgggtgctccaccaatgcaccaactaatgcacgcacaaatgcatagcgcaccaatgcaccaactaatgccggtagtttgatcagatatcccagatgtgatcttgccgatgggttatccccaccagtatagaagtgtttagtcacactgaagtttggatgtttggttgaaattagaatgatgtgactgaaaaattatgtgtatgaaaagtttgatgtgatggaaagttggaagtttgaaaaaaactttagaactaaataggacctatgactacaactatctttcggttgtcacgaagaccccgacgtgttgtcacgaagatcccaacgtgaacgtgacggagaagagtataaaaaaaaacacgatccgcgctgaccgccgcgccgccaaccggcaactctggcactcgcacgccgggcacgcgtttcacgtgtcgaagcgaagcgactgcacctgcacgacgacgacggaccggtctcgcggtctcctccggtcgcgccaccccgttccgactcccgtcctcaccgtccccgaccctccgcccaccactccctcggtcacttcccccaccccacccacccaccacgccgccgcgactcccccaccgttccacgcgcacgcgaccacaccactgctctgcacgcgacccgggattacactacacggtacacagccgcgcgcgcggactactggccagataacgcatcgcagattcgcgggaacacccctcgtggcgcacgacaactattcagtagtcaagtactagcgccagccaaagccaacacgagtttgcacgggcacgactccgcgccgcggcggccgtctcgtcctctctccacatcatccccgttccctcgcacaccacagcgcgcgcccgcccgccagccatcccgctgccgtgccgtctccatcttctatccctcctcctgctgctgctgctgctgctacttaccccgcgatttctcttcctcttattactcttcctctcggctctcgctcgctcgctccccgcgcgatttctccacgccgcacgccgctcgcgagttagggatcgatctcgtcgggggcgggcgggagagggagagggaggagagatggcgggggatggtgtggactgggagagcgtggcggaggccacgtccggggcggtgggcgcgctcgtcagcaccaccgtgctctacccgctcgacacctgcaagaccaagttccaggccgagctccagacgcagccgggcgcgcacaagtacaggtaagcagctcagccagcggctcctctctctctctctctctctctccctctcttcgccatgtggtggattgctgatccccttgtcaggagcttgctggggagatcgccgggttctcgatcgagaggcaggcgacccgtcggaattgggatctggctgctactgattcagtgtttgggctgatcgtgatgcactggtccgattgacgtggataacctggcgttagcggcggatgtcgtgatcttcgcataggccagttgataatttccctgggatagaactgtcgttgatttcttatttggtggccaaaggatgcagaaaaaccccagccatgtctcctttcgccagctttgttgttagaaggggggaaaggaactttagacctagtgtttgcattatatctctgaattaggctcacacttcacaaggagttcacttaatctggaatcgtatagtatgttggcactatgttgattggttggagattgtttggttcagctcccagttgcccaccaataggtgttggttatagaatggtttaaccaaataggaaggattatgcaccccacaaagagaaaaaaaaaagagagagaagggttatgcatatagagattttttttctgtggccaatcaatggactagtcatgaaaaagaaaaaaataatcagtgggtggaaataccttgtaattttttcctgaaccaaaggggtccaatacctgcttgtattgaaagccagagtttttcaggagataatatgaaagagaatagagttgggagcatctctggcactaaaagcaacatatagtacatattaggagacaccaccagattcaaagagaaattaccaaaagacaacagcagccagcatttagttcatgcaggttagttaggcatacagagcaggtcatagagcgctgaaaaattcaaatgatcttgaacctcaagtataccacaaaagctatatatttttattcaaggtcactaccctccacatcagtaggaagctcactaagaaataattttcatgcaaagatcttaatcttgagaggtattttgcctttccatattttgtttaccgatcgctccaccacaagatataagattgtagagggactttggcatgtacatgttatttttctcttccataacatccacctggatgatatggtccagttaattccttattcattaggttttgccagctaactctttgtagcatttgggatgtgcattgaccttgacattttcacatattggtacctcacttgattgcacctttatactcttaaaaaagttaaattgatttgggtgtcatgcatttttgccagcgtttgatgtatgtcctggcatccaggccttcatggtgttccatctcttctgaagttctgagttactctgtttcatacaataagtgacctcacgtgtttattttttccaggaatctttcagatgtcttttgggaagctgttcagaaaagacaaattctatccctatatcagggccttaagacaaagaacatccaatctttcatttcacaattcgtttacttttatggctatagctactttaaaagactctacttggagaagagtggagcaaagtctatcggcacaaaagcgaacttgttagttgcagctgctgctggtgcttgcacagttgttgttactcaggtaactaacgccataagtaattagctaccattcactgaaaatcgtttttacctgctgacctttatgtgttcatctctcctgtgttttcagccactagatacagcatcttctagaatgcaaacaagtgcctttggaaagtccaaagggctgcgggcaact

SEQ ID NO: 50790 - DNA, 4644 bp, Oryza sativa
  unsure (1)..(4644): unsure at all n locations
taaaacattctcacaaacattacatttatctagttctgctaatacatttcatgcagaatggacagggaaaaatcggtaagtcaacagttgtgtaaactgtaaaactaatagggcatgataaaaggatagtaagtttatatgtactagaagttgaatttacaatgcaaatataaatccagtaaatgaacttcactaagaaaaatgttctgctatgcaatattctccgtggctgtaccgctgctgttatttattactctgtttttaggtgttctcctttcagagttggataacttcttttagctactcacatattgtttttttaattatgaagtattcctctgtaaattattcgggaatgctttgcagtttgcatgatgaataaccacaccactatattatcacgaagaggaagtatataatagttctgaaacagatgaacatggctgcagtaaccaactgtgaattattgcagcagaaagaaaactgcttgctttgtctaaaagaagaaccgctaaagaaatgataatgcagctaacaataaataagagacagaagaaacctctgtagcatctcggtgaaatgccagcatgctagcctcaaagcatacagcctttagctgtgcaccattaaaatcatctgtacagcaagccaactcttcaaagtttacatcagggtttttgtccatttttcgggagtggatctacaaataatcatacagagcaagacatttaggttatgtgtgcaaagctagatatcttttcaacaactaagcaagtaaaggagggaaaaaaaaggtgttcaaggtagcttgcctccagaattctaactctagcctgttcagatggatgagggaattcaatcttttgatctaaacggccagatcgcagaaaagcaggatcaagaacttctggccgattagttgcagctattacctgttagtcagccaaagagttcatcatgtcattacttttttaaaaaataccagcaagaaacagaagtaaagtattaacagaaatcatattttagtgaatgtcataaagcatgtaggaaacatgtgttcgttagatagacaagcgataaggaacaaagcttatgtttgaagttataagaagctgaagacaatcaacaaaaatgcaagaacaggtccttaggaatatccattaggataactaaaaggctaatatgaatgaggatgtcttgatattatctttttcatggtatttattgtagctttcatccagtgatcaatattgcacagaacaaatgggcttcgctcccttccaaaaaaaaaaaaaaagagagggattcactgcttatggtcacctaaagttattcacaagttctaagaaatttcgagtccatgctggtaccatttgctgtttgcgaataaaagaagagattactgcatcttaacactacaggcctgtttgggtagtcggaaaaggaaaaaaaatcactcacaaaaagccagcttttcgtcctagtcattcattctcctcttctcatttcaacctaatccttcctatcccaacaccactaatatcccacagcccaaatgccctgtatcagtacatacgtgaatataaaaaaaataaagtggaacaggaagacatctgaagggctctgtactctgtaccaggatatgcacacacaccaaatgatttaatacaatagttccatacacagaagaataaagagatatgaaaaaaaaaacacacttctaaacatatttcaagccgcagtttgcatattgctaaatctccatctgtggttatcgaaagtcacatgagcttgtggttattaaaacatttacctttatactctcatagctcccgacgccatccaactgattaagaagctccacaattgtttgttgcacttccctatcaccactgcatggcgtgcaactagtcagaagtgcaagtactcaaacctagcagaaacagaacatacattgtatattgttgagagcaccataactgccaaatgtactaaaggtcctattataaactcgagttacttctactacaagtctcaacaggagccttcatgactttgtgccagaaatgaagttcaaacttccttcctgacatttctgaggatctaaaaattcaaatgtcttaagcagacataaaaacttgtattggaaaagaacctagaatcatttgcataaagtaaacttgcagtatacatgctaaattaagtgatatatcaactaagggtgcaggtaaaggcaatatacgattagaaagaggacatgatttaacaagtatttaacatgtcagcaagtaggaaacaaacaattgctggaaagaaattaacagaaaagacctagtgtatttgttcacatattcaaaagtgggaaatgatgaaggaacgaccatgtttgtcatacctatcaaagtgcttgcttccaattgcatcaatttcatcaatgaaaataatgcatggggctttctctttagcaagctgaaaggcatcacgaacaagtcttgctccctcaccaataagcttctgcacgagtccacaaagaaaccagtattaatctcaatcgtacataaaaaaaaaggcaaatcatgtagcactaagaaacttttcagaggagctcaaagatatcgaaggatcatgaaaaactctgctgttcaatgcctttacgcatttcatgtatctatcaaatactttgattggttttcccaaattcactgaccaatgcataaagatggaacatgagaaagatacagaatatacgcacacctgatttcatgaatagcacaacaatattttactgacagttaggtgatggattttctgttgcaagataattaccacggcaagttgtggaccagttagcttaagaaatgttgcatttgtctgggaagcaaatgcatgggcaacgagtgtcttcccagttccaggtggtccatacagaagtacaccttttggagggtgaattcccaacctctggaagcagttcttgtggattattggcaacacaactgcttccacaagctcctcaatctgaatatgaaatttacaaaacagtttattacttataggagatggggtggtataaattaacaagtaaacaaaacgctattcagtacaataataaattaacaagtaaacaaaacgctattcagtacaataataaatgaaggagtgcaaacaatgttgctattcagtacaataataaactatgtccactgttattattaccattcttaagcagggaaaagtagaaagagttgtaacttacttgtttttcgagaccaccaatgccacagtagtgttcatttgatgtactgtcaacaccaattaaatctccaggcttaagtttgctagggtacactaccccagcaataggacggaatataatctgtcattgcaagaaaaggaaacaaaagaaaaaatatatatatcagaataagtttagaacatagatgattgactacagaaaatgaaatcgagtgagctcattgcctcaagaatgtcccctgtgcataagttcatatttatctatgggtggtatagttattgcagcaaatttaggctcctgttgatgcatgtgcatattgcaaaggaaagaactccactgttgattcgacatgccagtcaggattgaacatatccgagcaatattcataaccgagctcacaggcaataggaacgtaggattggtttaattcttcgcttgcaaacataattacattgcgaatgagtcacgaccacaaatattagcaaaacacattgagtatgttccgtacacatgcacagttcaaaatgtggaataccagaagcgtacttttaacttttgaaaacttaatcaagcttgttttagtctagcagtagagacatgctgaattagtgaaaggcagagagtttgctattgtctgaaaagagaggttatcatctgtggaacagaagatatcactgcaaccctgttgatgttacaaatgacacagttctgatatattatgtatatactgcctccgtttggaaaaggatgaagttctggcctcaacgcctgaagacaaagacatctctttacagctaagaaattgacagctttgccccttactagagtaattaatgttccaatcattgaaatgccaagagaccaagcaggcccagggtagcacaaatttcaatctacctcaatcaatgcaagtagtgctgccacgtggaaacattcatatgcaattagggatagctaggaacagcagagttgagtttgagtaatggattgctctctctctctctctctcaaacgggcaggagagccgcgcatcattatataaaggaaaagagtctaagaagactcaaagaagcccattagggcaaggtttagtacacaagggctggctaaaggaataaaaaaggactatgactagcaatccaagcaaacaccacatctatggccaaaaggtactaatgaattgcttttaataggggtaatttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50791 - DNA, 3137 bp, Oryza sativa
tatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggttgattcctggacgagggttcacacacaagtaagcgtttggaattttggatagaaattccgggcgtgacaagttggtatcagagcatctttgaccctaggttatgccaaatggttacccatagaagccctctgaaaaatattggaaaagtagaactgttctcctccctttctcttttaattaaaccaaactaatggcacatgcacttcataatctcttttaatggttctcattaaaaatttattccagtgttattagtactgtacatctactactgtactaatggctcatttaccagcaaaagttttacaatactgttttatttaatcttgctgcaataaaataaatttagcatgctgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtctaggagttgcgtacgatgtcctttgtcattggatttgggactgctcctttttatgcccagattcctcatgatcgtcatgaagagaagtgacgagtcaaagtcaccttgaacagtaatagtgaagatatcccctcagtgatgtttgaagctggaggaagaaactatatccatgcatgtcaggaggtggcaaggatcgccataggagagctccgtgatcgctacagtgatcaattggccgacactgagtatcgccaccatcctcgccaacctcagggaagtgaccgtggcagttaccttgagactgaaggaattgagaatgatgctaccacgaagcatttggtggagatgttgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctctatttgtccctcgctatcaactggcgccaaaggttcgtgtggtggagaaagaagttgctccagctcaagcggatcctccggtcatcatcataagtagtgatgaagaagaagaatccaagcgcaacaattctaagattgagtgggtagcaactcaagatgatgaagacgagccttcaatcgacctccgatgcttggaagaactagagtgactagttaagtcgttgtcttagatcgttgtgttagtttgcttgcttaaagtttgcttgtgtgtgtgggtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgtacctccacagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgtatcacatcagttgcatggccctgcctctgaatggtgggatcacttccgccttaacaggactactgctgaacctatcacttggcttgaattcaccgctgctttccggaagacgcatataccattgggagtagtgtctctcaagaagaaggagttcaggtcgcttactcagggatctcgctctgttacggagtatctgcacgaattcaatcgtcttgctcgttatgctccggaagatgtgcgcaatgatgaagagcgccaggagaagtttttgggaggacttaatgatgagctttcttacccactcatggttggagatcatcctgatttccagaaattagtggataaggctattcgtcaggaggacaagtacaatcgcatggagcagaagaaacgtcggattgctcaattcaagacacaacagggaaataatcagaagccacgtcttactttaggaccccagtctatgccacagggaggttcttcgtctgttgttcgtccgcaacgtcagttcttcaacaacaatgctggcaacaacatccgtaatcaagctccacgtcctgttgcagctccagcacagcaacaacctgctaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcctatctatgagttttgcgggaaatcatgagatgga

SEQ ID NO: 50792 - DNA, 3625 bp, Oryza sativa
gttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccaaataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcaaatgtactgttatgtcttttggacttaccaatgcccctgctttcttcatgaacttgatgaataaggtgtttatggaatacctagacaagttcgtggtggtctttattgatgatattcttatatactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgtgtccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctatcggtttcttggaggatgagcaaggaactgtatggttgggtaagagaatctgtgtccccgacaacaaagatctaaaagatgcaattctgaaagaagctcatgatactttatactccattcaccctggtagtactaagatgtaccaggatctcagggaaagattttggtgggcaagtatgaagcgtgaaatcgcagaatatgtggcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgactctatttgggtgatagtcgacagacttaccaaagtggctcatttcattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcgggacggatatcctaagggaagcggaagaaaaggtaaaggtcattcaagaaagattgcgagtggctcagtctcgacataagagttatgccgacaatcgccgtagagatttgagttttgaagaaggagactatgtgtatcttcgtgtcacgcctcttcgaggggttcatcgttttcacaccaaaggaaaattggcaccgcgttttgtgggaccttataagattgccagtagaagaggagaggttgcttatcagttagaattacctcaatctttggcaggagtccataatgtgttccatgtgtcgcagttgaaaaagtgtttaagggtacctaccgaagaagctaatattgagcagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctaaaaattcaaattatataaattgttgtttaattggaatttctagaatttattttaaaaaaaagtcttgaaaataagatatagttctaattaataaaatccaatataaaaagtggccagataaaatttcattaaatactttgcttaattctataattcctagatttttctgggatttatttgagctaaggaagtattttaataaatggaattgcatttaagaaataatttaaattgaaaaaggttttaaaaagtcttcttttggctttgggccgaaagtcggcccaaaacctctcttctctctctcctcggcccagccggcccagtccgcagccgcccgcgcgcgcgtgcgcgttcggtcgctgacaggtgggtcccacctgtcaggcccgtcgtcttcctcgggccgaaaccctagcgcgccgccgccgagccgccgccgctgtttccttccaatcccgccgtttttttcttctccggtcgaatcaaaagaggagaaac

SEQ ID NO: 50793 - DNA, 8772 bp, Oryza sativa
tgtcttctgtagggactgtagagaatggtcttcccatctcacttctttacaggtgccttggggggagcagggccacaggtgccatactgatgggactagccacagtggttgggctagtagggggcatcacactgattggaatgacatcttcaatcatcctttcttgagggggtaaaatagactcaaaaggttgcagagcccatttagattcatgctggcccacttaaggagtggaaccatagatggactttcttggcaggaccaatgccgaaaagttggatatctttaaagcagcaggaataggcttgtcgtggatcaaagtttgcatgataccctttgctttacagagcaagtcaaacttgtccagtatacccttcattggataaaggtaggggtgacttggagattctgttttggcaattctattcaaccgagctaaaaattcctggacttgcggctctagaacaggatcctagattggtgtcatcatagaagaagggcaaggtgtggccatctgctgtggtataatcaattgtcctgggttctcctcaatctgccccattggatgatcttggccccatgcatcttcttgttgttcatttgcagcctgttgctgctgcactgcctcatcccaacctccagctccctggttaccagggttgccaaactgccaaacattgccagcatcggggtcatcatcagttgcatcatcagggcctggctgaggaccagcaggggggaggtcctcttcaggggggaatttataaaatctccctgaagcatgaaaaccgaaacagtccaagattctcccccacccccagcaccaagaggatcaaagaggacaatctttctcggcacagaatcctggtccctgtacttagctctaacaaaaaacccttcccaacattctgtccgcatccgcccaaaaagttaactgaccaaaagaagcaactgccaggtgcacatgatggagatcaataaaatctagcgggaaatctaggaacataaaccagccttctctatgaaagtttgccgccctccaattaggaccttggtcatgattaacaaaagtaccagggtgaaccccatcatagaactcaggcaaagagaggaccaaagcatccctattcatggcagacctcatctggaaaaaacctaccgcaaacgggtgccggaagctgttacgaacctcgtagtgaagttcatcttgaatgaagttggcaatgagggcccaatgatgatcccagtcttgctccaaggggattggctcaacaatggccacacaaaagtcttcatggcaccgagcagggcactgcgggacagtgaggtcaacccgcgggatgcatgaacagcgagcccctgccttaggaagcgcagcggattagggtttagattggccattgggggaagagggaagctatgggtgggaagcactgtgcattcaggagaggaagggtttctagaggaagaaggcgagatttccggaggaatagttttggccttccaaactgcagtagtccgagccgacggtttcggattgttacggtgcggggcttttgtgggcttagaggccaaacaggaacgggctaaatggcccggcatgagacaggccttacatctaagaggcctagagcaagaagccctcgaatgacccctttccaggcaacggccgcaaagattgatttccaaattcaaattgggtgacaaattaggatcccgcgtacctctggtatgcgaaattaactccgttgccggaatgggcagcggcgagacgtcagccgccttggagttcgccggagaagagcctgaacccatttccctctgctcaagctggtggaaaatagagattcttcattggtcaggcttagaggcacacagggagtcttttaaacaagaaaaaacatgcttgattgagatatcatgattctgaacagcttgagcataagaacgatccggccgccttaaggaagacgaagatcttttcttgggagccacaagcacccattccttttcctgttcccgactccaagagtcaaactcccactgccaattcggccccccatgtctccagaggaagaaacgaagagcaaaatcatcgcaagtataagatttaagacgataaacccacaaacccacttgcttcgatgtcacaccctaaaaattcaaattatataaattgttgtttaattggaatttctagaatttattttaaaaaaaagtcttgaaaagaagatatagttctaattaataaaatccaatataaaaagtggccagataaaatttcattaaatactttgcttaattctataattcctagatttttctgggatttatttgagctaaggaagtattttaataaatggaattgcatttaagaaataatttaaattgaaaaaggttttaaaaagtcttcttttggctttgggccgaaagtcggcccaaaacctctcttctctctctcctcggcccagccggcccagtccgcagccgcccgcgcgcgcgcgcgcgttcggtcgctgacaggtgggtcccacctgtcaggcccgtcgtcttcctcgggccgaaaccctagcgcgccgccgccgagccgccgccgctgtttccttccaatccggccgtttctttccttctccggtcgaatcaaaagaggagaaacaatctccgggatctcctctaccttttctcctttggaatcatcggttaaatcgctttggaaagctttgggatcgagttcgattcggatcggttttctttctctccaagccgaggtttccttcgtcgttgccgtcgccgtgggccttcgccgccgcctccgagcccctttaaaaggacccccggagtcttctcttttcgccgccaccctcgccttcacctctcgtcgccggaagagctctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccggagatcaccggagcagcttcgccgtcgttgacccgaaggttcccgccgcttcctcctcgtcgccgtcgccgtccgttggtcttccgccgccgtttaggtcaccggtgagttcgccgtgttgtcctctacgtcttggtgccctccgtttgcgtcctggcgccgccgttcgccggcgagcgtgcgccgcccgagccgtctcctctgccgagccgccgccgctgtcggtgacgtcaccgctgacgtcatcagggtcgtccgccgtgaaccgccgtggacccgatcgatctcggccgtccatcttggatcggttagatctcggccgtccgttcgcgtgaaccgccgcccgtgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcctaaacacaatcctttgagcatgttgatcctatatttaaattctctatttatttcaactgtgcatttattttcgaatgtcaccgggtggtgtgaacctgttcctttgttatggcctgttcgcattgattactctattccttgataccttgggttattacaatttgactagttgagctttatttatattggttcaactagatattagatataattgcttagccctgcttagaaacattagtacacattcgggataactaatgacttactaatatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgtaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctttaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattcgaacagaccacaaaggagtaggagcgatccttaagatgagagatagcgagattggcaggagatcagccaatggccgccctaagggccaaagccaccgaagaagaagtgagatgaaagctagcacggggaagatccacaactaatcggaaaggtgttgaactgaatttcgaagaaaaatggaccggcgaacggaagcgacgccaggcctcctcacgaatagcatcgccgggagagattccatcctcccggtggtgccggcgtcaccatggacgagatcaccggagatcgcccatagtcgcacaccgagaaaaccggagcctagcccagtcccctgaaaatgtagttccgacacaagttgaagacatggtgcatgacgatggttctgttgaggacaaaatcgacctagaggaaatgttacgtcatgcagaacccgaggtgctgatgggatcggctagagggttaaataactttgaagctttacaaaaggcagcaaaggaagttttgtacaatgagtcgaagggctctgacagtgagttcacaacactccggtcagttcttgaacttatgaggttaaaggtgaggcatggatggtctgataccagtttcgacagtctattagaacttttgcagaaaatgctcccgagacctaactcactaccatccagcacatatcaagcaaagaaactcatatgccccctttcacttggtgtggaaaagattcatgcgtgcgtaaatcactgcatactgtacaggaaagagtacacttctttagatgaatgtccaacatgcggtgcaagccggtacaagtcgaatagcaatactggcctaaaaccctctgaagcaactgagggacgacagagaaaaatcccgcagcttgtgatgtggtatcttcctgtcaaagaccgcattaaacggttatactcaaacccgcgagatgcggaactaatgcgctggcatgaagaagggcgcaagaaggatgggatgattcgacactcggcagatgctcgtaagtggataaactttgatgcttagtatagagagtttgctaaagacccacggaacattagattttccctgagtacagatggagttaatccttttagagacatgagcagctcacatagtacttggccagtgcttctcaccatgtataatcttcctacctggctttgtcaaaagcgaaaatacgtactactctgtatcctcatacagggaccccgacagcctgttattgatattgacgtatttcttgaaccattgttggaagagatggctgatttatggaaagagggattgaaagtgtgggacgagtacttaagggaatacttcacagtgaaggccatcatcttcgtgaccatcatcttcacagtttcaggtcaaattaaaggtaaaacaggatgtgtgatctgcttgaatggaacgtactataggtatctcccgggttccaacaagcttgtgtacatgcggcaccggcggttcttgaaagttcaagtgccttaatttggtttcggtgattaatgacaaatctatttatatgagactaacgtttttatgagcctttatttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatgtcatctctctatattgtttatatcgggttattatccatcaccaaagagagaaaagaatgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatataccacttcttatctcctacttttggataggttcatatatatgatttccatgttattgatatataagtgtgagactaatgtttactcgaatgttatcttatttagtctcatttacattgagaacatggagatcatgaaggtatatgttttatgttggtctacatcattactacatatgccttcactatatgtataggataaacccccattggtcattctctaattatgcatacacttgcatctcttgtatatttatttgtatgcatatatttagggggagcaaatcctatatatttattgtgcatgttctagatccatgttgttcacctattatttatatcgaatctttgcacttgagcttgcatacgagtatatgaaacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaggtcaagcttgttatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtttgatgagttttctcaagtcctaaaccaagagagaagtgggcatgtccaataggagtgagtgacatcttgtgggtatgtccggtggatatcctttggagtgtgagccctttatccttgacttaagttgtgtttattgcatgtatttttcatgggttggatggccctttgaataagctttccatagagtccaagaacgccaaattccgagacccgagtcaagagatatcgccgttttactaacggtcagttaagctgaaaagtgacctgcggtctgaccgtgggccttaggccggtctgaccggtcctgttagccggtctgactggcgtgataaggccggtctgaccggccccactggtctgttgcattggtctggtttttggtggcgatacagagccgccagagtcgcaaccggtcagaccgagccgatggcggtctgaccgagcggtggacggtctgaccggctactacactgcggtcagaccggccaggttgagtgggctcaatgattgccctgtaacggctagttttctagccgttacaaagtagtccggtctgaccggccactctatggcggtctaaccggcagagcacagagttggggatttcgacataacggctagttttggtggttgggggtatatatacccactccccagcagcaagggtaaggttttggcactccattgcattatcttgaacccttgcaagagctttcacacccttgtgcact

SEQ ID NO: 50794 - DNA, 2476 bp, Oryza sativa
ccgcctattcaccccccctctagtcggcctccttgatcctacagttcctacgcacaaatcacaagtaccgcaagatgaaggcggagttcgatggtactaaagagactgatcctgcaccaaaacctacatcgggagaaaaggtgtgtgcaatgacagagaaaattgtttgcgagtttggaaaaatgacaaagaaaccatcaaaggggacaaagcgcaagaaacccgagaagaatacgaaacaaggggatagtaagaagcaagatgatagttcaaagccagatgataaactccctcccccattcaagaagcattccatattttttaagtacctcccgtactggaaagatctggaggttcggcatgccatagacgtcatgcatctagagaagaatgtgtttgacaacatagttgtaacattgttggacatgccaaagaagactaaagatggtctgcaatcaagaatggacctagtcgagatgggaatcagggaagagttacaccctcaagaaggagaaaagaatggcaaagtttatcttccactagcctatttcacactgacacctgaggagaagaagtcattttgcaactcactccgtgatgtcagagtgcccataggtttctcatcaaacatcagtcgactagtttcaatgaaagatttgtcggtatctggttataattcacacgactgccatgtcttgctcaccgtgtttcttgcaattgcaataagggccataaaaccggagcatttaaaggttgctatcacaaggttgtgctactttttcaacgcagtgtcacagaaggtcattagtctcgaagagttaggaaatctccgtacattcgcacatgagacatagtgccaacttgagatgtgtttccctccgtcattttttgatatgatggagcacctcattgttcacatagtgccgcagatggttgcgcttggcccattgtacctccatcaaatgtggtcatatgagcgttacatggcagttctgaagggttacgtccgaaatcgtgcacatccagagggatcaatggttgagggttatagtactgaagaggttgtcgagtgctgtatcgattacctcaaagatggatatgcaattggagtacctatgccccgacatgagggcaggttgagtggtaggggaacaataggaaagaagagatttgtcacccatgatcacaaatcattccaagaagctcacttcagcgtgcttcatcagtttgctatcgttgagccgtacatcgatcaacatgtcgaactaatacgcgttaacaataagggtcgcaccaccgagtggataatgaaagaacacaagcgtctcttcatagattggttgcgagacctagacttacctgagggacaaactaccgatgaaataactatgaagcggttggcttttggtccatcaactacagtaaattcttggcagggatatgacattaatggatactcatttagcacaagagcccgagataataagacatgtacgcaaaacagcggtgtccgtgtggagacaattgatgaagccggggaaaaacaatcatacttcgggtttattgaagaaatatgggaaatcgactatgggcacacaatgcaattccccatatttaagtgccagtgggtaaaatacccgaacggagtcaatgttgataagttcggtcttactgttgttgacctggcgagtgtgggtcacaaggatgacccttgggtactcgccaatcgcgtggcacaagtgttttatgtgaaagacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccgtgaagccttacatgcgcatggacggtgtgggcaaaaatgttaaagggtaatgattgttgagtggcatgtaagcatctaagaagttagtagttatgtaatggtggtatgtaaggtgatgtgtgatcatatcgcaaattgacgaacaattgtacttatcattttggtggtatataattagtttgtactaatttttatgtgcaattaccatttgtagtgtaaaaaatttgttaaaaaaattaaattagtaatatttgaaaagtgtaattatttttatgtgcaattaccatttttaccatttgtagtgtaaaatatttgttaaaaaatttaaattagtaatatttttatgtgcaataaccatttatacatttgaaaagtaataatactaaggtttgtatattttgtaataatattaaggtttgtatattttggaataaatatattcaactatgtaccaattttcacaggcgggcggtccgcctgcgaaaattgttatacagagtagggtttacatcttcgcagtcggacggcccgcttgcgaagatagtaaaaacgatct

SEQ ID NO: 50795 - DNA, 3685 bp, Oryza sativa
gccgcccgcctgcgaccttcactctccgaccatcgtcctccgccgccgctgaccgtcgtcgtccgcgcgctgtcaccgagaccgccgccccttgctgccgctccaccgcgcgtgagctccacaactctgccgccgccgccgccgacccatccaccgcgcgcgagctatacgccgcccgctccaccgccgccggcccctccaccgccaccgggccctccaccgcgccggccactccaccgcgcggcagccgctggcccctccaccaccgccggcccctccaccgcgccgtcggccgcccctccaccgccgccggccaccacctctctctctatctcgctcgcggccgaacggcttcatcggccgatcgtcgtccacgagcgaagacgtcctcggccgaacgacgtcttcggccggtcgtcgtccacggccgaacctcgtcgtcggcccttccttcgtcatccacgaccgaagctcatcgtcggctgttcgtcgaacacggacatgtgtgcatgtgggtgtttctttttatgtgtgtgcatgtgggtgtgagggggtatatatgtgtgtgcatatgggtgtgaatgggcatgaggggtgggtgatatgtgaatgaggggttatatgttgattgtgaatgtgaatttgggaatgtggatgatatgtgaatgaaattgggagggtatgttcaattttgcaggatatgtgaatttgtcaaattttttaaataacatgtgggagggtatgttaacattttttttaaaaaaaatgtggaggatatgtttgccttttcaattttttttaatcaacatgtcgatgaaatgtaactgtcaattagtgcactacttgataataacatatcaaattttgtacattgtatgtactaattaatttagcataatagtaagtagtaattagtttcgcaatttaaatttgtttgtattaattaatttagcataatagtaagtactaattaataatatttcacaatttaaaattgtttgtactaattaatttagtataatagttaaatttgggaatctcagagaatttaaatttgatcatacgacatattgttaatatacagtttatttttgtacaaagttgtttgtactaatttgagtaatttaaaatgtggacgataactcttttttttatattagaggtttgaaacgatggccgatagaactaaagggactgaagagaagggtttaggggagcaagagcagtcccttgctgttgtggttgctctggaaccaacggtcccaccggaaggtagttccgacagcgacgtagctgacgaagacgaggagtactcgtcgccaagcgatccttgtccaagcccaagcccaaagagaagaaaaaagggcaacggtgaagaaggcgacaaggactacattccccctaaagaaggggtaagtaaacttaatatgtaaaatgttcaccgtgataactattagcccgagctaattcgaaacttccatgtataccttctcgtaggaaacggcgccacggcgatcaaaacggcagccgaagaaaaaagttccgtcgaaagatgacgacgtaccagctaacacaaccggcacaaagaaaagcgaacggtcagcaaaagcgaagaaaaggaagggcgagagaagcgtgaatagaaaggatgaagggttccatgttgttacccatgtttcgcctaaaggagagccgctcgcccctaagacggcacgtgcgaaattcatttcacagtgtggcataatagtaagggaaaagatccccatcacggtcaaggactgtcattatgtatcgaatggggataaggaagtcctatggaaagagttgaagaaaatcttccagttcccggatggatcagaggcagcagtgaggaattgtgcactgcaaacaatggccaagtcttggtgtggttggaaaaccaccttgaacaagaaatttgtgaagacgggacgcacaccattttcgacgtatgccaacataaccccgaatcagtggaacgactttctgacgttgaagaactcctcggaagaaattcgaaggagccaaaagtatgcagagttggccaagaagaacaaatttcctcatcgcttaggctccgcgggatacgcaccaaaggtggagcagtggacaaaagaggaggaggaaatgaggaagaaggggcaaccggtaccaatggaggagtggacacagagatcaaggaactgggtaagaactagaactccgaagatcacggatgaaggaaaagtatcgtttgaaaatccggagctgcagagtgttgccgataaaatagaaaatttatccagttcacaaaaaaaagatctttcaagcctaaaagggagaaagatgtgctaagtacagcactgggtactcctgagcatgggggaagagttcgaggtatgttgagcaagatgagttggaaggaagggttcaaaaatgacccccacaagaagcgtgaagcgtacaaggataaacttagagacgaaggggctgcggagtttgaaaggcaaatgatggatttctgcgtcaagcacatgcttttgcctcaccccgaaaccaaagaacctgagccagattaccccttcaatgacctcaaggagaatacaccctgtagattgcacgttcccagattagaatgtcgaacaagctttgacgataaaggtatcacaaatgtccagcgtgatctttgccacttcatccaccatgagtgttgtcgtgtgaaaggacatttctttgacccagagggtgccctagcagcaagtgacgaattcaaggatcttcaggagtggaacactgctatgccataatgtaactagatgacgttatttgaagtgaaaatgtaaaaaagtattgtaatatatatattttggcaacacttttgagttatgcaatatatgtagatttctctgtaccaaatgcttgataatcttccaatatatgtatataataatctacctgcaagaatttctattaaataatttaaaagtaatttacgggcaaattattattaaatttcaatattttctacctatcttcgtaggcggaagtttttttttttgcaggcggccgattcctatttttgcagacggaccggactagccaatgtccacctgcgaaaattatcttcgcaggcggacggccgccccgcctgcgaagatcagcgatcttcacagtcgttggcttacaggcggacggtcgcctcgcctgcaaagacccttttcggctgcttgcgataacgcttttcctagtagtgtgcatttgccttttttattattatttttatatagtcgtgtgttttctattaatagagctgacagatctgtttcaacaaaacgcatcatgtataagaagtaaataacacacaatttttttagataataaataacacacaactaaactacacactagactttttcttaataaaacatgcataacttttaactttttgcctctacaccaatatttaagaatacacaggggtgaagctagcatcaaaacaagagaggtgcactaccattgaaaatctagaaaatttcagtataacactgtatattctagtattttcaagtgagaaattaaaaattgggggggtccatgtgcacccaagcacaatatagcttcgcccctgagaatacatgtttcactggtggagaaagcctttttactccctgttggtaacccccctata

SEQ ID NO: 50796 - DNA, 5907 bp, Oryza sativa
atctgtgaagtgtaggagaggataagggatagggattatatactacgtattaaattttagtctcggttggtaatactaactgggactaaagatcaatataatttttagtcccggttagtattatcaaccgggactataaagatgatctttactcccggttggtgtcaccaaccgggactaaagatcctcggccccctgacagactactgacacgggatgaaccgagagtaaagatgatttttagtcccggttgatgttaccaaccgggactaaagatcataaaatatcaagtgtggtggtgaagtagtgtataatataactccacttagctgggtttgagtccataattatgactaaacactggtggagaaaccatctttcgtcggtcagccgaattccacaatagtcccggatgcaataaaaaccggggctaaagatgatctttagtccctgttaaaaagggtaatgggcatatttgatctttagtcccggttcaaatgctgtcaggtcctgtcaggccccccgggatctttagtcccggttggtacaaccgggactaaagatcatacctttagtcccggttggtagatctcagggatctttagccccagttggtaacacaaaccgggactaaagtcccacccctatatatatgtcttcttcctcctccagctgcccgagcaagcttcaaaatttcttcacaaaattagacgagatgatccaggagaagttgacgggcagctaacgaagaagagaattcctgctaaggtgatgtggtatttccctataataccacggctaaggcgtttgttcaggaacaaggggaatgctagaatgatgggatggcacgctgaagagcgtcaacaggacgggatgctgagacaccccgccgatggttcgtagtggcgaaacatcgacagaaaatttaaagactttggaaaggatgcacgaaacatacggtttggtttgagtatggatggcatgaatccttttggagagatgagcagcggccatagcacttggcccgttacgatgtgtatctacaacctccccccatggctatgcatgaagaggaagtacataataatgccgattattattcaaggccccaagcaacctggtaatgacatcgatgtgtacctaataccactggtcgaagatcttaaactgttgtggaagaaggaaggtgtccccgtgtgggacgaggacaaacaggaggagtttaacctacgagcgctgttgttcgtaaccatcaacgattggcttgcacttagcaacctatccggacagtccaacaaggggtacaaggcttgcactcactgtatggatgaaacagaaagtacgtatcttaagcactgtaggaaggttgtatacatgggtcatcgtcgattcatactgttgaaggtgatgacccatgtatacatgaattgacgatgacccatgtttacaatagaaacagaaagtacgtatcttaatttcatccatctcctgaaggagcagcattacaagacgttcatactgttgccgtacaacacagagttagtttaattttactgtctttctataccaaatttcattctcgtacgaacatgctaagtgtttcatatgtaatgcatcccacgcacattgctgattcaactgggtgcttttactcttcgacctggaggcctgcaccgtcaacgtatatgactcaacggataaaaagagtctacgtttgacaaggttttcgaacttatagacaggtactgtcataagttcctatgttaattaagaatcttgttatagttaattgctactacaaatcatagctttaaactccatgtagggcttggtatcggctccgtcatttggtccgcggcaaatggagagaaagacttaggcggaagttcaaatttcctgtgagtacacatactctacatttatatttctccgattcaaatacatacaagtgtacattaattagatctctcgtcgtttgtcatttatttatagtgcgcaaagcaaaagcagggaactaacttgtgcggctactacgtgtgcgagtattgccactgccttgtagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggcggttcaagaacaactcatgggattcatcaatgaacaaatccttgatcccaagggtgaattctactacgacggaaatacaattcatatgtccttagcttctgagatagcgactactactacatcgaaatcgtagctagataggacatataatggattgtaattaatacatgactatgtttctatatgcatgtgtacacattttctataatgtaaatatatattttggtcatatatatatatatacatatgcatttgcataacatatatatgtataaatacatatatattatgcatgtacatatgtattgaaacatatataaatataatataatatatatatatatatatatgcatatatatgtattgaaacatatatatgcatggtttatatatatatatatatatatatataaaccatgcagcaacagggccatgcaaaaaaaaaaaaaggtcagctcgatctttagtcccggttggtgttaccaaccgggactaaagatcgagctttagtcccggttatttcacccgggactaaagatctatctttagtcccggattggtagtcccggtttggaaaccgggactaaagggggttacgaaccgggactacacacgctttctccaccaatgtcattgaaaaagaatggggtaaaatgtccgatcatataaggactacatactatttaaaatataggttgtttataaatgataaattgtgtaaacaattttactatataagtgttctcgtaatatcacagtgatattactgattttgatatttataggaaaaacctaagtagacaaagttgtaccttattgtccttgtccggtctctctatgatctaatcattttgaaattgtttataaataaacattgagcctaaaaactggggcatgtttttatcctcagaggttgggtgcggtggcaggaagcggaggctgaaaagcaaaactgtgtgtcccagcgaagactgtggccaagaatcgggttgggcttggcagccatggtgtaagggaaggatattttgtccccagttacccatggctgtgctagcatgagcttggttatgaacaacggagaaacgtgaggtgggggaagtcgggctcgacaccatggtaaagcgcatcactgtgattggggtaacaggtagagtttgggacatgtgtttagtaaggtggcggggctccgcttggcttgagccgtttggaatgtgataccattaggccttcttcggttaattctcaagagggaaggactgacggacgggattgacgggataaattccacatctcaataaaattgggaattattccccctccaaatccttctcaatccccttgcatgtgggattaactaaacaagaccttaagcactcggttagtgtctcgtgcagtattactcgatctagaataagaagggtagagcttcaggatatatttatttaaggataaatggtggatgatggcgagaagcagagaagaggcatggggtgctatttataggatgctatggagattgtcaacatgtcaaggcagtgaccgaatggaagggatgaactcaatctgagctcattcatggctacagcggtacgcgagctgggccgtggacacatgctggctcagccaatggcaacagacggctgaagcagtagagatggtgtcattgttgatgttggttgatgttggtatttcttagtgaggatttcctagtgatgaacaatatctacataagcttaatttaatcatatcgtaatacttcaggcactggcttgctcgctactaccagaacacgctctactctgtacccggatagggaggactgtgataatctcaagggctgtcaccacctctacaccaacctctaatgaactatgggatatgcagcaatcactagtaattaataacctagacaccatgtctatgcaattaattactactctagcgctagctaaacactaaagtactcactctctattaatgaacaatagtgaacaataatccagtatgttaatagaaactaactaagagataatcctcacaaagcaaatctcaattactcaataaagataatatcaattaaagcagaataattgacaaggtacaaaaggtaaagaggaaagtaccgacaacttcggaatccatccgactcttccttccttactttctccctattctattgtatataaaagatacaatagagcctcttataattcaacttaagctcggtgtgtcttgaaataaaacatgtgagctccttttatagccttcgtatgagggtttggtagttagaattgtcccaactaccccttcaccgtcattaggacgctatctggatcgtccacatggaaggagatggcgaatagcgccgatgttggtttggacgaaccacgtgagtttgattctcctccttctttatgtatatttcttctcaaccttagtagtttatcacatgcatccaaatatataccaacatttgtgcaatttgttagaaataaaccctgtcacgatgttggatattttaaattttcaggtttatacaggaattgacgatgttaatttggtatttaatagccgtcaaacagtgggcagcatgaataagcagccactcgtagcaagaagcaacacagtggcagcttgcatagccctatgggcgctagtgcgctgctaggcgtataggaggagcggccacagctgtccggcgcattgccttgcgctggcgctagcaaaggctagggagggtgagtatatgtggccaatggttgagccacccatgccagcccaggcacgtatcaactgttcatgatgcatgcacggcccggcccgtctggccgtgttgtgcttgtgctgccaccaaggctcgcatgctggcatgacatagcacggttgttctagcaggccgacatggtatggactgggcgtctgggccacatggatgatggtggtaggcaccaagaataaagaagagacggtgatgcttcttggtgtaggaatggagggcgagaagcttcttggcggcaaccggtgaacgtggaggttgtcatggtcatcaacgaggaataagaggatgcggaggcgtggagctggtaggaagcagcgaccaagcagtgcaaccgggatgcccattgttgagcatgcttcgagcaaccttgcaggcggcggcagtcgatgatacaggagtcgacagcagccgcagacgatgcgagagtcagcggcggggatgaacaatgcaggaggcggcagcaaacaaaaccctaatcatagccatctccatgatttcgtttaattgtttttcagcaatcgtccaagccttatacgagctaacatgcctttcttagcccacgtgcctaaaacaaggttgtgacggctccacactgcttggctccttactgtgcatagcctgggctccgactttggaacggctagcatgacactgccaatttgggcctcatcgtcatgggcccattccatgatgggccaggcctcgcctgttttggctagctataaggctgagtgatctggctaggctttgggtcaacttttttttttagaatttcacagtataaagcacactcacccctatgaacacacgcacgcaaaccctacccctatgagcatcttcgaagactgggccggcaaatcctagagattgacgaagtcaccataggcgcctcgctgttgacgggtacg

SEQ ID NO: 50797 - DNA, 2026 bp, Oryza sativa
aagttacgaactgcacaatggaaagtttgttcctgtcagattaggaaattgaataggtaaaaatgtatgcacaatttatatcccaggcatataatacctaccaaaattgttgtttaaccgatgggaacagcacagagaagcaaccacgttttgcagaatcgtgtcttcctcatgtttgcactttgtggagatcattggagaaaaaaaatcgcggatcctggctctgtcctggaggtaacccattttacagattgacatcatcagcatggattcctggaagcttgaaagaacgttggcaggcatattaggtttcattagcagtgttctttaccttaaaaatattgtactacatcaaagcaggctgagggcatgcgcacaaagattcccacatggtatgaggtatttttctctaatagtccatccaattcattacatcagtctcaagaaaaacaatacactctaaaattaactgcgatgtcattatgttttattgaagaagaataacaactacatgcaattgtttttttgccacaatagagaacgcataaaaaggggagatgaacatccaaattttaaagcttcgaaattcaaaattatatgattagcaaagctcgacttaccttagcaatggttgaaaaagtgggatgacagacgatgaaccaacaaaccaaagcccccaaaagggatttcactatacagaactaaaaagaaaaaataaactactgctccaggataaagattaagtaaaagtaacaatacgaaggcatcaactgtattaatcctcgatataaataaaaacaatctatgtgctttactgataagaactaggtagagatcataattctcaataagctgtgcactcccattgaacaaatcaaggtataacagaagcaaaaagaactactgccttccaaaagtaggcaaatactccaagaactacataggccaccgacagaaatgaagaaaagaaggccagtacagatggtttcaggtttaaacaataagataccagagcaaatacagacaacatggaaagagtaagggacacttgatttcagtggctgaataaatagttaagaggcaaatcaatccccagaaaaagaattagatcatgaattatttttttcttcaccagatcaaaaccattttgttgtgatactgagtgtgcataacaaaacttcacggagataatatttttggttaactaacatgcattccactgtaactgtatcaagcagacataataatggaaccatcaaacctatgactaggaaactacatccaacatgcatatggcactgccgaccttattaaatcataattttagtaagtttcactttgacaccactacaatataatggagaactaatgcaaagctttgctcattttgcccattagatatatgctacaaacctatcaagtggatccctctacatattttttttctttccttatttgatgtaactgcttttagattccgaaaagacctttttttttccttttgtgaaaatggccagttgcagagtgccatagcagaactacaagaatagcatccagaaatagataaatggtactctctctgttttttaatgtatgacgccgttgacttttgagatatgtttgacgatttgtcttattcaaaaaattcatgtaattatcatttattttcttgtgacttgatttatcattaaaggttcttaaagcatgacttatatttttttatgtttgcacaaatattttgaataagacgaatggtcaaacgtttgttaaaagttaatggcatcatatataaaaaaaaacagaggtagtattaaatagaagatgaatatatgagtaaaatacactacatgtcgctaacctgtccacctgcttcacttaggtccatgaagtttcaatctacagtttaaggttcctaaacctatctaaaccgttcactagaggtccgatattgccccacaccacctacatggaagccaaacagtaccaggatagacaggagtgcaccaacatgcacagtccgatcaca

SEQ ID NO: 50798 - DNA, 3248 bp, Oryza sativa
cttttccaccactcagcaataagctaggacctggatacataagccatgaagtaaggcacaccatcaagtccatactatcttgaaagaacaaaacgtccaatttgctccatccaatcagtcatatgaattaatcttctcacgtaacagtgatgcattaaccccaagaagatgtggacttaactctgacactgcctttaagtcttgtattgagatcgagttagggcctgtaggtataataataccctgcccatgcacatgatttttcagtgatacgccatttattagcttacgtgacaactgctgcttcagtgatgcatggcttagtttcccaagctgtgatcttgttccaactagctgcacacaagatccaatcaactgctttaagaaaacatcaactccattattcaacaaattagcacattctactgagaccccttccaaacctgctgcttctgcaactttttccatcctcttactcagtagcatagtatcacataactcaccaagttcatagcaactaacagagctatcatttggagggacagaagcaatggctgaagattctgaatcccaccaaaattaactggggaaaattgaatccccagtggagctcgcacgggaccttggatacggtgtatattttcacctcccgagttttcaccataagatatagcagaagggccattgctgtgtgaaggctcaagaaaactcggtggctccttttcataatgtaatcgcttgttacgtggctcagcatgctcactgttctgaacctgttggcatctcttcagatcactaaaatttggagcaccattctccctgataataggcgctccctcctgctcaatggtcaatgatctattgtctttgacatgctggattgaaacattaccattgttccaaacaggatgaagtatctgttctgatttagaaacatctcctgctaacttgggcgcatcaattgccggtggaccatttgcacggcatgcattgtggagaatagaacggatgaggtgattgtgcaatgggaggttctcacggccaagtgtcacaagacagagcttatcaaactcatttttgttcaattttgatgataagaacctctctagatgctgaaagtatttctttgctcgccctggcccaatcctcttaatgatgttggacttaatctcacgaaggtcaatacgagtgctctgtcctgccgtggatgacggtaatggttgcacagttggtgcaggttgcactgatggtggcgtagaggacggcatgtcttagaaaagatatgccatgtaaatgtaattgaaacacaacgtagaatctcagtaaaatctccaccaagtagtgtagccctcctccaattcgacccctcttagtataaagctagccacaaaatgtactgcagtgaacaaatctctgattaggaatataaaatatgtaaaataataaaaataaaaataaaatgccagtagcacattggattatccaagaacaataaatcagtgaagaaaatcttctacgtatgatataatgccagctgctttctccttttacaatgaactgaatactgatgatggtggttgctcaaccaacacctggctcaacaagaatagaaggaaagacttattgaactacttggctataataaagcctataagtaaagactggctaaggacctgattcccctgtaaaccgtgcatggcctgcctcatgcagctcatgccatttgaggtgcccagctcaccattcattcacagattctgtaatgaaattgagactgctcgatttttttaaaaaataaagtgaggatatcccttctagggtaggatgtttacttgaaaataacaatcgcctgttccagtagcagtggccagtagacttgcacaacaaaactatccttgcacttcctaatcctacatgtaaaagttaaaaacaatctctaaaaatttggagatacaggggagggataattcaatagcaatgaaaattttagaaaaaggaaactccgtaccagcaataatgaatggtaccaagcaggaaaatcactattcattatgtctgtctttcatacatctttcaaatacaaaatcaagtttgaccttggaattctacatggatacaaaattgtctccctaaatgtccaaattttgatttttgagaacttttacacgtgggaagcagggaggtagcatcatatgagagggaagcaccaaacatctccttgatgaaggctcctccaaaccaatacaatgtgaaatagggagcaggaaggagatagggatgagagacaagtggggctgactgccacaaattacttttaccaaggttatttgataaggccaaatccttgtaaaaagaaaattacttcactaaaatgtgttaatgtcctttcaggacaaatagttttgtaaataaaataaagaacgtaattcctcagtatgttctggatccttatagaattgtgttagtgttggcatttggcaaaacttgaagaagtgccagcaaattgtgtggtcattgaaatcaattagtactagcttctaggtaagataagcacctattaaactaacaaaaagaaaggaaatttgatattggcatgtatcatgtacaggaataaaaaaggccactgaatgggtgattctaaaataagtgtttaagtttgaacggccaacctacatgggttcatgtgccttggaaaatcagaaattcaggattccgctcgttcggaacatgatgttttttctttaataaaacgaggtaaataaaaaaattcaccacaaaaggagattgaaaataattaataattgaaatacccaaaccagatactgttcctaaaaaaacacatggcaaaaggcactccgcaccaaattttgcgcactgttcataactataaaccattcgagaaaaccaaccatgaagaaacaatatgaaatggcaggtcaactgtacacgaagagtaacttccaaacgaaacctaaaacagaacagcagaaacacagagtttccctgctccaactatgcagtttttgcagaccctgcaaaaaatccaagcttgacagcaagctttcctcatgtgaatacaggtaccacccaagaagaaaaactgagacatcagccaactgagcaagatcacataaaattgtacctacaatcgccccccccccccccccaataaaaacattgtacctacaaaacaagaaaagaaaatcgccaactgagatgcatccagctctccttcactcacaactcag

SEQ ID NO: 50799 - DNA, 4899 bp, Oryza sativa
atactaaattaagtgtatgtttgaacagccgtactccatgtgcctttgaaaattaaattcaggtttccgcttgtttggaacatgatgttgataaaacaaggtaaacagaaatactgtccatgaaaaaacacatgccgaaaggcacaacacatcaaattctgtgcagcgctcatcaccataaaccatataagaaaaccaaccatgaatgaacgatatgaaatgccaaggtcaactgtacactcagagtaacttccaaacaaaacctaaaacagcatagcataaacacaagtttccctgctccacaaaattcaagcttgacaactaactttcgtcatgtgaacgaagcctaccagaattttcctatccagaaaccatgggaaaaaaactgagaccagctgccacctgagcaagatcaaacaaccttgtacctacaaaacaagaaaagaaaaatctccaactgagatgcatcaagctctccttcactccaactcagtttctcccgattcgaacgagtaagcaaaggaaaggcttcacactcgaattaatcaaattattgtaactctaacaaacagataaccgaaatcacaagctccaccgggtgactgaacgaactgtggacatagtcacaattcaaattttatctccaacttacatggacacgagctcctctgatccagtgccccccattacctcaacccgaaatccagataaaagctagggtttcgcaccaaattcaaactcccgagctcatgccgtcgcaccgagctaagggaacatccccaaacaacgaacccgcgcacatcctgaacctgacgagcaaaaccgcgccgcccccgcaacaacgcgcagctcaaaccaaatcccagcgcccccgtccccatcccctctgatccaatccggacaaccccaattccgccccgggacctgcgtcccgcccccgaattcgaactccccggcgcccgaatcaccagaacgaagccccgccggcgagtggcgcgccgccattgccgccgccccccgcgcgcgtggcgggtacatggatcgaggcagagttgggggtggagggggattttgaaccggaggggggtgggggggggggggggactctcacctctgctgcagcttccgcgcgcggggcgcgttggaacgcggggggaggcggggaggcgatctccggccgcggctgctgctgctgatgctgatgctgatgccgctgacgctgacgacgctgctgctgacgcgtgcgtgcctcccgaggcgcgctgcccgtcgtggagggaggggggcctgcttgggtggccgggggttagcacaagggggtagtgagtccgggcggcgacggcggcggcggaggaggaaggcggccgcggcggaggaggaggaggtggaggttgctggctgctgcgttggttggggtggtctctctcgctttggcttggggtggggcttgtgtgtgcagttgtttgtctgtgttggtccgtctcggcctcgattcgatgttgtagtgtggttcttccttccatccatctcctttgccttgcctctctgttgttgatctatccatctgatgactatctatctgctgtcaacttcttctccctaccgttttttttcacttttattcaagtcacctttggtgtggccagatgagagtattaggttagtttagtgcttgtaggtaaaggattttcgtggttgctaaaagggatatatgaaaccattcttagccgtcggtcgagatagatcgaacggccggcaagacttcagtatctcctagcaccactcctccatcaataggagatacaagtgcgaaagggtactatggttctataggtattttgcggctaggtttaaggctggcatagataataagtttattctgtaatggctacatcgattctctcctagtctctaggcccccacgcacaccgccgccgcctctactttcttaagcactggcttcttgccttccctcagttgtctatcttacatcgcctatgtcctctccccagtcagaagtacaacaacggcatttgtgggcaagtaagcagtttagatctaggatcctatttgattactttctccacctctaaggacatgtcatggtgctcatatgtagctaaagtttttagagtaggccagagttagtttaaatttaggatacccatagaaggagaaaatcaaataaatggatggtattacagctcaaatatcaaagggattgtcttgactaatcaggatgtaaagctttgaaaaaccaaaatgttgagtgcccttataaaaagctctagaaaattaaagcaccaccaaaaagaaagtcaagatattctcttactacttcttaaaaaaagatgacaccgttaagaggatggaagaaagggactaagcacaatcaattttgtactccctccgtttcataatgtaagacttcctagcattgcttatatttatatagatgttaataaatctagacattatgtgtgtctagattcattaacatctatataaatgtgaacaatattagaaagacttatattatgaaacgaagaaagtaatatggaagagtttgttaaacatttatttacacaataccttatagtagttcattttatgtggattgttagtggagtgtgctttaaatattgtaatgatacacactaattgtttggagcatggttgcacaaatctatatgttctatatagatacaacccactaaatacctaaacttcaacatgcaagtatagtaattattatatagggctttccgatctttcaatgagaagaggataactttgattttggggaggagtccacattgacagtctaactacaactaccacacagggtgttgcaccatagcaactggtacaccaatgtctaactacaactaccacagggggtgttgcgccatagcaactagtacaccaactctgaattgttgttgttcttgttgtgccaagaacaaccttgaacctactagcaatcgaagaacaaagcaagaacaaattaacaagaaaacagtcacaacacttgctaaatatgaaattgacacacactaagttgggaggggggtgaatcaagtatccgagttgtctaactgacacatatgagtacaatgaagtagctgaagctaaactttcatgtaaacaaaattcaagttgcaaatggtagctacaaggggtttatataggtggaaaatcaaccgagcagagtggtaggagcaaaccctaaccttggtggatccctaatatgctctactgaatacaagacccaagcccaagttttttgtctagatgttgtttcgattattctgggtagctttgctcaaatctaatggtgaggatggactaacttgagagtaaacaacaatatcttttaaatgagtacttgtgaggccaaaacggaacagtatgcgaattccacggtcgtttgaagttagttttgtctcagatggccgaattggattccagtgtgcgggggagttgatctccatctcttgatgtgtcataactgatgtgtacatcttccatatatatgcaaccccaaccatgtaggttacccctaaacaaataaaggtatatatctccctcattagttggtgtcatattcttaatgcaatcaaatgagagcttgtgatgaaacgacttcatccgatgatatatgatgtgagcaacgattttatgcatatttgtcatggtcacatcatcctcccttaatttctttatagaaaactatcgtcggttttatatttatgtggtggttgttgtgtagtgcatgatcttgcccatagaaatgtgcaaatgaaaagcacactaaacttttctcatgtaatatcatcaattatttttcaaatagaatggttctctaataaaatgaatgtacatggcaatggagatgcacaacaaaagtttatgaattacattgaaatcactctcccgcaactcatcttgcaccccttcatagaagcaaagtactcatatcgtgcatctaacttgttgtatgccgacagagtcgggtgatcagacccctcctcttcttcaaatgtttcctcaaatcaaaactacaaaaaaaaaacttgagacaatatatctctttagtttgctattttcttgcacaaccataggaggtttcaaatctaaatatgcataaactctgtgcaccatataaattgctttattactatattgcatcatatcgtgcatccaactcttggcagtgagtgacatctccattgcaatctagtcgatggtgaagagctcacctgacattggccgacacgtcgatggcgagcttgggagagcatcactgacagcaacttggcatggctagtcattttgtcttctgcattgcctaagaggatggtgactccagcagcaacctccggactccatggatggacaccatgaacctgtagaaaagaaggaaaaaacgtagtgtaacatagaagcagattggagtgcatggccttctctactggctggctgttcaggtcatgtgcttcattgcctctacgacatgtttgtacaagcttgttgtttgtgtgagcggtcgtgtgccgcccatggtgtaaggccttcagccttgtagatgccttctgtttcactttattgcgtctccctcctctgtatgtgtgtgatggtctaccttttatagtgaagatgaggcggttcccatccattgcgcatgcatggctgatgtctcaattcatggctagctaattgcctgagttttgtgatttgcatttcttccatgcgttgtgattcttccaattaatagggatcctactcagcataattccatccgagttaccggggcaagctcctttccaacctggcgtgatacggatcgattatttccttgtattcgtatacacatagtgtacaacaaatctcgctttt

SEQ ID NO: 50800 - DNA, 5958 bp, Oryza sativa
taagtacatgtgcccatgtatgcaagattgtgccattagtggcagataatcactaactattatttctaccaccatttctagaattagtacttggacacacgcatcatttcttttagctcatttaaatgaaatgtacaaaatatcatcgaacaatgttcattcaaaagttgagtcatagttataagtgaatcatgatcacaaaactcttctttaccacaagcaatagcatctgaatcaatatgtgttaaatacattttagcaataggttccacacttgattgctctatggtagcatgaaaagtggacatgtgagaacagtcaccttgatttatccatttttggaacatttggcatgtgtttggtttggggacgaagtgggatgggttgggttcatccctattttctggaataggatggttctattttttgtttggttagagagatggagcgcaccctattttttgtttagttagagggatggagtgagatggaatggttccatcacctgtttggatggagggataaggtgggatatccggataaaaatacttcctcaaatagaattggtgaggttacctctcacatgaacaatatatttttagcacctacaaaaatttaataaactctcacacaaaaaatacattcgtagcagccccaaaaatttaacaaaaagataaatatgttgccatatcatactcaagcactaattaatcatctcatcacaaattacttgcacacatcacaaactaattcttgctcacataaaaaaaagtctactgaaagaacatgtacagatctgaaacgaaatccccatccaatgttgtcatcgggattctgggaggattggagaaggaagatcgcgcgtgctgctgacgttggaggccgatggcggatggaggctggttggacaccgccatggctgccgccggctcaccccagctcgcgcgctcctgccgccggctcgcccatgctcgcgtgctcctgccataggctcaccctcgcccttgctcgcgccctcccatcgccggctcgcccatgctcgcgtgctcccatcgccggctcgccctcgctattgcttgcgccctcccgccgctggcttgccttgctcgcgcgctcccgccgccggtgagagaaggagaaaggaaaggggtgcggtgaaaaaaaaaaggtaggccagatggttaccgcgcgcgtgcgaagtgggatggcgctgtccgccagattttcgcggatgagatcgtcccgaatattggaggaatattctctttttggaaccatcctatccctcctaatctctcaaccaaacacttggttttgggatcatcccatcccatcccgggatatccctccaaccaaacacaaccttggtttatctcagcaccatttaatttatctttctttgtttagaaaatgtaggtgcatcagtcttctctttcttctcaagtgatgggaatagcacctcgatctcgttttcacaggtttgctgaatgctttgaactccctacaaaatgttagtaacaagaagcacaagcatagcatgttgctccctcgtgtcctccaaaatttcaatctcaacattgcaagcaagcatgaagatgtgggctatatgattagatgtcacattagcaagcctaacttgagtatctaaattaagccctttcaagaatctacttattgtgcattcattgtattcttttaaactgtagtagatgatacaaattttaaattcatggaattactcctacatagttttatcatcttatttcagatgttctaatttcttaaggagaacctttttataacaagaaagcacaaatctctttctcatcaataacttgcattctccccaaatttcaggtttgtcaccaacatgattccaccaaaaggatacagaagtggtaaacttcttactagcagtcttaatcatttgaacattagaaaaatcatgcctctcaaattgtttgtctactgctagctcccaatcaacataagcggcataatcaagcatatcatcaaagaaaagcaatacagattctactcttgcatgattataattgggtaccttataagcgtcatgtatagtactcgctgtgtcttttagcaggtgaaaaggttggcattcaacatgataaactccagttcctttgcataacctgtcagggttatggataccacatacccaatagtagtcgaataagctcggcaggacccaccatatatcaaattttatacggaatcatacctcgtatatagaaggagttccggataaggaaggacggatagagttctatatagaaacaacaaggactactcggattgtatccataatggtctccctagttctacttggacaaggggacacctatgggtataaatacaagccccctaggaggagaagggacgagccacaacaacaacacacccaccatagacgcgcaaatacacaagccaacacacgccaagacgagccgccggatatcgacataggagataagcctagacaaacccaatatggtgtctgcggaggccaacaagagggatctaagctatctctgatctcaccgagtgcagactcgaggaggaagactaccctgtcgtcgactacgagttggttatccatgccgccaagtcgacgacagctagataggttatcccaattattgtactggtgtgattacgatgaataagagcaacactagcctcggctaacaggatgtagggctattacctgtcaaataaggggcccgaacctatataaaaatccttgtctccatctcttttacctcaatcttgcatataccttggtacgaacgatccccataccatccaaataccgtagtcgcgatctcataccatgattagtagaaaacaagaaaaatatagcctatcaactattgaacttggtgatatccaactccctctcaatctcccatcttgtgcaactaagttcttacatgtttttaccatgttatgtagatggtgtttagcaaacaacaagaacatcaacaatggttagttgtaccggaaccaacaacaagcacgagcatgtgtcatagtagataaatatgtggagctacaggaggttggaagcaaaatcacggtacaactaggagctataggagattgaataaatgctcaacaatgatactatgttgctcctagcttaaacttagttagagacacgagcttggtcacaagcgtagccattcaaaatagcactaaaagaacacaaacaaaaacaacaagaacaacaacttctcttttcttcttatgtattgtttcttctcctttttttcttctcttctgataccttttctttcctccttttttttatcatttgcacaactagctcaaagctaaaacgtttcacaagaatttttgtcagtgttctagatataggacaccctatacttatgtttaagctcggcggggtccaccatataccaagtcctatatataatcaatcctcatacatatgacaaaagtcctaagtagataaggaagaagtcccggacaaggaaagagaaatagagtcaattttgcctcaacctaagctacttggattgtatccataattgtccccctagttctacttggacaatggggcacttgagggttttgttgacagccgttaagtaccaactatgaccttcaactcctgcataaaaaaatacaaaatataatatcaaacttagtagtgagggtttattactaatcgtttccacgagtattggtaaatatatgtgtgcagataattttggaaaaaaattacacctgctatgtgacgaaatgtacctccgactaatcatgtgcaagcacaaggattggagggcccacataccagtcaaaaccgactaaaattaagcttatccacggtgcaccgccataacggccacttttcagcctcaccaaggaaaggttggtggctgaaggtggtggcctggcagccttggtgctcccggccaccgacttccacgtggtgcctcactatcaggttcccaatgacgataggagtgtttatcgacttaacaaccgatctacaaccgtcattgagctgctataaaaggaggaactcacttcactcacaacacacaacaaagtagagtacaacccactttcatattttaggcatcactttagtagtgtggagaaaatacgtacagagtgaggagaagtacggaggagtgtcgaagctgtcggcattctctcctctcctggacctaggcagaagcttctttcataaagtaagtgctcgagattttcttttcgatatttaattacttactatcagggttatgagtaccacatacctaatagtagttgactaaatctcgcaggacctaccacataccatgtcctatacggaaacaacctgcggatataggaggagttccggataaggaaagataaccagagttctacatggaaacgacaaggactactcggattgtatccatattggtttccctagttctacttggacaagggaacacctatgggtataaatacaagcccccctagaagtagaggggagacagacaacatagaggatcaacacccaacacaatcaacatagaagccacaacatagaagcctacatacgccaagacacgccgtcggatatcgacttcagagataggcacggctggtaccctacggtgtctccggatactgccaggagagacgaaagcgctatctctaatctcgccaggcacggattcgaggagaaaggctaccctgttgtcgactacgagtcagatcgtcagaccgctatgtcgacaacagttagataggctagcccaaacattgtactggtgtgattatcatgaataagagcaataccggcttcggccaacagaatgtagggttattacctgacaattcaggggcccgaacctgtataaaaatcctcgtctctgtctcttttacctcagtctcgcgtatatcctagtaccaacgatccccatactatgcaaatatcgaaattgcgacaacaaacgtcgacagtggcgcgccaggtagggggattcggctgtgaggagatccaacctgtccaagtacatcttccgacaagatcggaaccatcgtcgtcaacaacttggtctatcgagatcatccaagcctcaagcttcgcggcgtaccaaaagatgtcagatcgtatgatgtcgaacgagtacgcaataaggtaattggtagattggttttttaaattgatctactaatttcgtagatacatccggcatgtatctacaaaggtacgcaatattttatctgcaatttgtcgtacctattcagatcatacaacattgtcagatccatgatttattatgtttatctagagcatgtttttatacaatatctattatgcgagtgtttccggtgttaagccgacaacggtttaacgctgggggctcgctctatttccttctgtataaatcatgcttgtttacggtttacataatacctgatatttacatctgctcgttatatcctgataatactagaagatccatgcagttttttgagtatatactcgattttatctactatatatcttgtcttctagataattctactcgttcgctagtcctcgaaccagtgcgtagcaatctctcgcactgcaacttccattggtgttcgagagataattctacacgttcgctggccctcgaaccagtgcgtagcaatctctcgcaccgcaactttaattggtgttcgagagataactctacacgttcgctggtcctcgaaccagtgcgtagcaatctctcgcaccgcaacttccattggtgttcgagagatgattctactcgctcgctggttctcgaaccagtcgacagcagcaatctctcgcatcgcaacttccattggtattcgagagatgattctactcgctcgctggttcccgaaccagtcgacagcagcaatctctcgcaccgcaacttccattggtgtttg

SEQ ID NO: 50801 - DNA, 7058 bp, Oryza sativa
ctcgaccagcggtgtagcgattctcccactacctttacttctagtggtcgagtttagagtacatctggttcttgaccagcggtgtagcgattctcccactatttctacttctagtggtcgagttgcgactaccacctggtcctcgaccagagatgtagcgattcttccattacctctactccaacaaagttgacatcagatacacaatatcgccaagtgttttacccagagatcccttaccacaaaagacacctagcgttgaaacctatcctactatccctttacgccgtcttgacaaggcctccgaggaacctaaggaaacttcggttggggacgcccagagtcgataaggccttgttggatccttcagagacgaaagaccatgtaagatctggtcgtgtaagagttctcgcagtgcgtattaaccaagccgtgtaatcggaaatggattttccaacttcacggctgggggctaggatcaatgcttgttcaactgaggcaggtccaaggtccaagagccttatcttccgagaacgattctccgatgacaaggctgggggctagggagagtgtataactcaacaaactgactaatcgaagtcggtaaaagagtagacgctcatatacaaaacattggtctgtaagtttaattcattttcggttttccatacatatataacatgtcaccctttgagcattcgttcgggggctatttctatctaatatttttttctgagtattgatttcaggaaaattctagccgacattatcgaagaccgcatgtctctatggttctacaccaagatcgactaaggcgagtatgaaaaatgtcgacaaagctccgtcgtagattctgcgccttcttgatcactcgagaacggttggtggatctcgacaaggaatacagaatgaagaaatggtgtacccgccgagataaaatttcttgacttcaatccaaattctcgattacagcaagacgggagacttagtcgtatgctctgtactttctcggttgacatcagagattgactcagacaaaccctttaggtgcccgcacgaggctgacaaaggaagtctaacgttatctctgaactcaccaagaacggtcacgtgagctcgataacagttcctccaaggtctgcggttgggaatatgaactcgttcatttgcattgaagtcaggggctactgtcagggttatggataccacatacctaatagtagttgactaaatctcggcagaacctaccacatagcatgttctatacggaaataacctgcagatataggaggagttccagataaggaaatacaaccagaattctacatggaaacgacaaggactactcggattgtatccatattggtttccctagttctacttggacaagggaacacctatgggtataaatacaagcccccctagaagtagaggggagacagacaacatagaggatcaacacccaacacaatcaacatagaagccacaacatagaagcctacatacgccaagacacgccgtcggatatcgacttcggagataggcacggctagtcccctacggtgtctctggatattgtcaggagagacgaaagcgctatctctgatctcgccgggtacggattcaaggagaaaggctaccctgttgtcgattacgagtcagatcatcagaccgccatgtcgacaacagttagataggctaccccaaatattgtactggtgtgattatcatgaataagagcaataccggattcggccaacaggatgtagggttattacctgacaattcaggggcccgaacctatataaaaatcctcgtctccatctcttttacctcagtctcgcgtatatcctagtactaacgatccccataccatgcaaataccgtagtcgagacatcaaacgtcgacaataccgcccaaagatgattaaaaatgtatttataccatccaaagatgatttgggtgggaattgcttatatgaagtatatattgggtgcctataaaaaaattatatattgggtgggaattgcaagacctggatagtataacaaggtgggaaaggtagtatgtttccttttcttgagtagggagtggttatacccaggcaagtttacacgttcatttttatcagaatcggtttttctatttttctgatttttttttgttcgttcatacgactaacaccctcgtttttacgcttttcaaacggctaaacggtgtgtttttttataacaattttctatacgaaagttacataaaaaaatcgtattgatccattttctaaaaaaagaattagctaatacttaactaatcacgctataatggaccactctattttccatgcgggagtgagttgctccaaaagtaacgaacacatcctaaatttaatcgtgccaacaaaaagagagagagaaaagaaagatgggactgggcctgtttgacgctaatttagagtattaaacataaattgattacaaaacccatttcataaccttaaactaattcgcgagacgaatctattgagcctaattaatccatgattaacatatgtgatgctatagtaaacattggccccgttcgaatcctctagaaagagaggataaacttttggattttcgtgacacgcttttcaaactgctaaaccgtgtgtttcgtgtgaaaactttctatatgaaagttattctaaaatgtcatattaatccatttttcaagtttgtagtaattaaagctcaattaatcacacgttattaccacatcgttttacgtgaaacacttgatcttaatcttcatcttaagaagattcaaacaccaccattatctaattatagattaattagacttaaaaaatttatctcgcaaattagctgctatttatataatcaattttatataagtagtcagtgtcaaatatcctacatggtaccagggtttcccaaaccgccggggccagggttaccgtgcctcggcggtaagcacggttaccgcgcggtaccgcggtaaccgtgaaaaactgtataaaatcgtgcaaaatttatcaaaaattcaaattattttttaaatttatttgaatttgaggaggttatcacggtatttatattaccatacccccgcggtaagctcggtaaccacgataaccacgcagttaccggggtaatgtaaatcctggcacagaataaagtttagtcctcgtccaaacacgacaccaccaaaatcttttagcgtctagaaccattgtgcgtgagtatctctctcaaggagaaaattgacattgtgccattctcaaaagtgggtttcgtccaaataccacgctgggagtgggctttattaaaatgccactttcaatcgaagactacacgctataatgctcgaacggacaaaaatacccctgttactaccttcttccacctctgacaagggatgcctcgccggctcgcctctgccacgcccacctcatccgcctccacctccgctccccttcctccctgacaaccctcgcttcgtccacctccacctccgcaccacttcctccccgcctcgaccgtccccaaccgatgaccccgtggtcacgctccacgccatccgcgccaccgacgccgacgtcggcggtctccgtctttcgtgccaacccgccgtcctagccactcccgttcttccagacggcggaggcgcacccgcacggcggagtcgttggtgggcatggccatggcgaaggcgcggcgcggtggtcatcggaggtgcaggcgacggcggcggtggccgggacgggtgcgagggctcgcggagggcggggctgggatgggggcggatgggagggggcacggggaggggagccatgggaggggtccccgcaggggcctttggcctgtggttctccatggaggagagctcgcgcgaaggcagatggtggccgccggcgagagctgatggtgatggagggaggaagaagatgagaggagggtaatttggtccgagatagtattttagcgtgtaaccatgtgttgaaagtggcattttaacgaagcccacttccagcatggcatttgggcgaaacccactttttgaggatggcacaatatcaattttctcctctctcaagcccctccgccgtcccctcttgcgttttggccgtctcgtctccgctcctcgcgccctgcgccgatctccatcccgcgagcagatcagggtcggcgatctccatctcgcgagcagagggggacgccgccgttgtccctgctgctgcttccgccacatcccggtgagcatccgcatccgcatcctctttctcattcacccccccctctctctctctctctctcacccactttttgtctcgattttgcttgcgtgaaccctagcttcttctcttctagatctggaagaagcttttctctaaatttgagagccctaaccttaatacaagtaacagtttgtttttccccccaaaaaagtaacccccatgtccgcccctgaattactaatcgatggatgcagtaggactctgctgtggagaacagttcgagaattatagaattattatatgacaggcttgactgttaagcatgtttgttcaactctgcatttattaaatgtgaatccccatgctttcggtggtacactgctgaggcgcactctttttggtatagccaatagatcatctgtttcctgtatagcgagcggtatccaactgcttggatctatctgagcatctagaagtgataactttcataatggtgttgcaatactatgtcattgtcttgtaaatatttagttcagatgttgatcaatgatccactgatctttcggcctgtttagatcccaccccaaaattttacaccctgtcacatcgaacatttgaacacctacatgaaatattaaatataggctaaaaaataactaattacacagattgcgactaatttgcgagacgaatcttttaagcctaattgctccatgatttgacaatgtggtgctacagtaaacatttgccaatgacggattaattaggcttaataaattcgccttgcggtttactgacggattctgtaattaattttcttattagtgcctaaacaccccatgtgacaccctatataatatctgatgtgacgccaaaactttacacccctggatctaaacacccccatgatgttcattccatgaacaaagggctttcctgagatgaatgtatccccatcttctgtttttcgattgcatcatgctatgttctgttgctgatgttatcacatttcaaggacaggatatcccctttaatgatctctttggttggttcatgttttgttgttgacacatctttggcccaacagccaaatataaaataattggtcaacataatgctttttgaattttgaattgcagcattttgagcaattaaggaggtgtcaacattcagtacaagaaatggtatgctatgattctcctattttaacggtctgtgtagtcttgcattgtataggtatgcattcctttgtgcttagtttgcttacccccactctgttcatttgttgcagacttacataagggatgaagatacaagacttgagaccactcgggcgaggcgtaatagttccctctttctttagttggaaacaattcttttcttgggggctttctgttattaaggaatccaagaaagcagtttaggcataattttgaacttctgttttgcagtgtcgaatgttctcaaaaggcatgaagatttgaaagagcgcctctcacggtactcccttttgcatgttctttagcatgtaacatctgcatctgtgcataaggaaataatttaataccctattcaaactgccagcaaatttattgaccatttttttttattgaagaacagattctaattgaaaccaaactcttgcataaaacaaatatcttatgagatggatacttcccctcaaatatggctcctctaatatgtaaatatgaattacttaggatttcttataatcgtatttgttgcagctatgttcctgataactaggcttactattgaatggattttatcttcctgtcatatttctgaattctgataaacatatgaatgcatgggctaagcttttactttgtttcagggattctgataaactgatttttgagcggctacagagagaatttgaggctgcacgaactgcccaaactgaaggtacagtttgctaacattaccatgaatctttgtgagattctactagaagaaataagcttaccaatgattatcaatatccatgtaattgtatatttgtgcaatctccttttcctttaagtttgcatattttagtattctttgctgcatattccttggttaagatcaactttgtacaaaatcaacctccacaaagactgctcaatttgcaaaataatgctcgccgagccatttctgatttctttgcattttgaactttgaaattccaaatggtgttttaaatttcatctctcaagttatgaaactgcattttggactaaattaaaaaaaatatggacacaaatgttcataagatagaatttaatgtggtcactgttcagttttttttctttttttttcttgagcacacaggagtcacctgtttaggttgctccttgaattccgtataaaccatgaactaacaagaatccatgcatgtgcatggctgaaactattgagcggttactgaaaaattaaagagctttgttagtgacatttttttgaattcaaaatcattaatacagaacataaaatataattgtaaggtaagaaatgctagctatttgcaatcctagctacgaattttgcattgaaggagagagtgagattattattctgttaatgcttctgttcacaataattcttttgttgtcatatttttatttgagtaaagtgcacgggcggtccttaaacttgcaggggtgtgtcatctaggtccctaaactctcaaaatatatatccaagtccaagaacttgtcatagggtgtcatttaggtcccaaatcgccccagcccctataggatcctacgtggcactgatgtggcatgccacacggacaagacgtggcatcatttt

SEQ ID NO: 50802 - DNA, 15673 bp, Oryza sativa
atttttcttgagggcataaatcctgtttggttctatacctatgttagtccttccaaaatttgtagtgcccttaacatttggccactaaagtttgcttccagaatctggtacctcttcaaaactcggcaatgttcaagtgattctagacacaggttcttgtattttgttggttggtcaaatcctcagcggctctgcctaggaattcccagggctgctgctgctgctgctgcatgctcatgtaatttgagtgattggttgcaattaatgcattattggtttggttgtcaaactttgtgtcccatttaaaccatcatgttccttctgacaaaatctatgagacaagataaacctttgctatgttgggacattgcaaaacattaggtatcatatggcctcgaactatagtcaagccaaagagaattttgatgtctagatggcttcaaatcaaattgtctcacgattgcaatccaatcacatgtgctaacaaagttttggttatgtcttattttggttgtgacaaaattttggcatggcacagcactattacagaccaaatggccccatatatatatagtttagtttggtcacatggctttcataggccaatactacaagtcataactatatgcacagtataacacagcatggtgatatatttatgctcgtcttctgattgaagattacattagttgggctttttttccccatttgatagtttcacactccgtatacctgctttgcaaactaatgccttatttatcaattttctcgagacaacaaaaaatcaaatatatgagctttagttattgctagtgtacaggtcttttctttttttttttttcttgtggatcccggaaatgctgttatattctcaaacttctttttacaaccatcatggcacacagttagtcttatcatactagtatcatcattttaattagcttttatcctcctgcttcaaaccattgtttatcctcttatgccatctttttatcctcctgctttaaaccatctttttttgttaaactttctacatcaatgttttttcattttgtagagatcccaatagatgatgagcagtggaacgatggtttgctggcaaccatccgtgaaaaggtacttaatcagagcaccttaatgtactcatctctcttgtgacaagagacgtattatctgtttggtgcattttgagttttgtatgaatttgcttgtctcgtagaccaggtccatatggaggctgataggaaggccatggctaaccaagcaaatgttccagcagatcctcaattccagtcaaggactacatatagagtaaaaaacaaggtaaaacaggtagcattattctcagagtagtgatttgttcatgctatattgccctttgtgttgcgttacttcaccatttggtcctccaaatgctttctatgtaaagttagattagtagtggtagattaatgtcgtctgggctgagtgtgtttgtgatgatttttcattccgggttctgcacttagagtaggtaaaacatccgcacttgtgatcaccacaagttctagcaatcacacaccatttgaggtgccttttaccagatcgtgtattgccgtgcagtccttaggaatcaataaaaagtaatttatgtaggtactaggtccacattatgttaatgtttcctcagatgaaatttatcttcatgacatgaatgaaggcttgccatgctatttttcagcaatacacctattctgttctatttttcttaatttgatttttatcctgccacatcaaaactaaatttcttccctttgataggttatctattgtttggatggtgcgagaattggtatacagtatgagacttattttgctggtaactcatttttcattctcagtttttatttttatttttttaactgtaccatgttatatgcagatttagtgttttacaaggctggagagcacatttactttgcatcaaactgttttaatctctttgttttggcattttggaaactctgatatagttatacggaaaactggtacataaagcatatgtcatatctctaaccacattatttgctgttctaaataaacatgttattttgcaggagaaccttgtgaaatttatcattgtgttttggaaagcaagtcattccttgaaaagatgactgtgattgagcacaccttacctttctttctgccaatacgagaagtagaaagtgaatttctatcatctaatgctattgtatgttttctaactgaacttgctttttatatgccaattatttgcacgtctttgtacttacatggagctttttcttacagaaatttattgatcatcttgaagagattttgcagtcttatgttgacaggagggagcaggtcagatatatagatatattattacttcccatatcttccactatgaaatgctaaaagcagatgaccttgtgcattgtgctaaaataacatagttggagttaaaaaaatactgatgtttaaaagtgggcccagttcatctttctctgtgaagcataactaaatgtggtttctgaatgttcgttttgctgaattgacaacttgaaagattacttggttcatgtttatatttgttcagtttgtaaatatgcataacacaggacatgttgcaaagtgaaccttaatatttcttgttctgcttttaatgtttaacatgcttttattaccagaaaattagataggcaaaatctaaggtatagctttagcagctttttggacctttgcaccattgcagctagtttaggctgtgcttagttcacgccaaaattggaagtttgattgaaattggaacgatgtgacggaaaagttgaaagtttgtatgtgtaggaaagttttgatgtgatggaaaagttggaagtttgaagaaatagttgggaactaaactaggccttactgaagaacacgtaaaattggaaattatcctacttctatctagttgcattcattctacttatgtgggaacttctctttatcttcttccgtacgtaatttacagatatgtgaatttaattcttatgtacaaattaatgcaaactattttttggacatccagctgggaaccatctttgaacaaaaattatgcatttatttatttattttgacaaaaaaaagtgtgctctgctggtctactcagttatttacattacataactttaacagtaaattgtcaattctaatatttttattatttcattttcaaggttcggcttatcaaggaactatatgggaaccaaattggagaactgttccacagtctctcttacaatttgatagaatttgtaatggaggattttgagtggtaaggataatttatactttgctaattttcttttagcttgttcgtactaatgtataactgaacgtaagcatgcaacgtagttgcctgtattatttggagtattttgacttcattgtccaaatgtccagtccatttgctttataggctgcacgttatacctcttccagacactgaaaatttcccccctttttccccttgagcagcaaggttacagtcagtatccgatactcagatctattgttcaccctgccaagtcaggccagggtcctggcttggccacttcgctcttcgcggggaatatcagtaactgagcgcagagctagtcgctcagcatctgctcaactagtaccgttccgccttccctacgccgaggatgcgctgaagaccttgagtttgccagaaggtacatcctattccgcatattacttttccccaatcgttatagcaggtgatattttgtgctgaacttatcttgatctgtattctcgctctccgattcagcgtttgcggagattgtgctgagcctaccccgtgctctgaagcggatactctcttctcaggaaagtgattgatgcgtgtactaggagtttttggtaatgagactcatggacgcagaagctttcggtgctatatgcagagtattcggtgaccttactgacgagatacaaaatgttcggcagtattgtttagaatattgtagtgtacagttgttactgtctagaaaatgcgattgctgcgaagccagttggataacaagaaacactgctttcaaccatccatgtaatattcgtgcacagcaagcacggaagcagatttcataccatgacaggagtattgtatgtgaagtaccaacatgcagggttcataaagccaacgaaaggcgatcggttttcacggtttttcgatgtttcgacaaggcttcgataggaatttcaaatgctttcggacaaattcaaatattatacagtaaatttggtcaaaattcggccggaaaagcaatagaaatttgttaaaaaccatgatactgacgaggctcgaaatttagtggtaaaacctttcaacgtttcatcccaaccgttgcgtggtaaaccatcaaatcacgagtagaaggattccccagatataagtcggaacaaattcatttgtcaggtatttcctggagtggtgtacctaccaaagctgtaactctaatgactaacggttataagtaaattcaccacatagaaatttggatagtggaatagaacatcctaacagacgaacctgaatacacacacacacacacacacactttttacaagttttttttctcgtgccaactggaatgaaaataagatagtgcaacaatttgacaatgattactatttaccgtgttacttattagactgtaaattacttttgaatgattgaattttgatgaatgaaagttgtgtggttatttgtgacgctacatatttttaagtgttcatatcttttttttaaaaaaaaaagtgaaatatgaaagcaaatagtgccggtgtcaattatttaagaagagaggtagtaatttagtatagctttaaaacaaaaataaaatactcacttcgttttaataattgtcactaccactattcaactttgatctttttcttttttcttaaagaatttataaatacttgaaaatatattatactattgaactgtgtagtgctgctaatataaccatgaaactttcactcgtcacaatataataaaatatactacctctgtttcataatacaaatcattttgacttttttctagtcaaactttgatcaaatttatagaaaaatacagcaatattttcaacacaaaacaaacatactatcagaatatattagatactagttattataaaactaatttggttttgtagatgttgctaaatttttctataatctcggtcacacttaaaaaagtttaactaggaagaaaaataaaaaagatttataatatgaaacggagagagtagttacttaaaagaaattttgtagttaaagtgagacggtcctagtgtcagttatttaagaaagatgaagtattgttaggctttctttaaaaaaaaggtattgcttaggctgcgttcgacatagcattttgggcttttggcagagcaactcaatggcatacgaaactaggggcatgtttagattcatgttattctgaaccataccattatttcttaaaattgacaaacatataacaatattagtttattaccaaatattggtcatagctagagattttgacaacatcatatttagccaatcttacctaaagttattaatgttaccaattccaaattttggaaatgttgaaaatggctacaaagtgaacaagacctatattagaaattagcacgtgattaattgagtatttcaaaaataaatttatttaactttaaaaatcttcctaaaaatacttactaagagaaaacgagaaagagaaaacgagaaagtttcagttttcagttggaactcagccttaggctgcattcgaaggatattttcattcgcacacgaaacaagaaaaaaaaattagtgtactaatcaattaaagtattaactattaaaaaactcgatggacttagaaactttttatatatttttttttcaaaaaaatgtgttgtttaacattttgaaaagcgtaaaaaagcctattcatttaggaggaaaaccaaaggatttagattcttaaggattaatttatatgagtgtcattcggtttatagaaatgtaggtataaaaaaaccaaaggaaattttctttcccacaagtcaaaggaagaaaacatatgaaattttctatccactcaaacctcttatgtgcaacatttatattactctactttttcggttctatatatttttttagagaagggtatttttactcggcctctatatccaaccggatatatgctactttttcggttctatattttttttagagaagggtattttttacctggcctctatatccaaccggatatatgcaacctttttttaattaggaacttagcctattaaatacataacttagctatcaaataacccaatatgaaattcgctcctatggagatttaaactcagaatcttagggttctactaagcttactgtaatcactaggctacatgccctttcacagaaaacattttcggttctatatgttagaattgttccaagctctaacagaaaacaagaaatttgtacatcctccgtcctaatatataagagatttctgttagatgagacatatcctactattataaatagttttattcagatttatagtattataatatgtccaattcaaccaaatcacttatattttaggatgtagggagtagtttagagtcaagaaaataaacaggctcttagccaaagtcaacaggcgttagagtgtgaacaagcagaattaagcccctcattcaggggcaaaacagtaaaagcgtactgccttttctaaagggatccgaggacaacgggaggccctttccctccctctctcgtgaaatccttctggcatgtacctacacctggttcactaccccttcccccactgacctgtgggcccacaagtcaaccccttcaccgggtgcacgaaaagctcggtgcagctataccttttcacaaacctttttctactgtattactccctcaacacttgattacctgttttattaatttttttataattaatatttttattgctatagatgataaaatataaataatactctatacgtgatttattttttaatttttttataaagtttttaaataaaatgaacgtcacataaacccttacaactacacttaaaatactactaggatggagcgagtactattttgagctagaaatacgccgctgaaaagttgaaaaagagatttgaaaaaggagaaaaaaaatcacgaaaaagcgcggaacaaaagcttctcccccttgtcgcccgcaatggcgtctcccactcgcagccttctcctcctcctcactcccccacacgagctccgccgcctccccatcccccccgggaaccctacctcctccccgcgcggccggtgatggcgtcgaccccgccgccgccgccggtgataggcaaggcgggcaacctcacggtcttcatcacgccgccgtcgccggcggaggcggaggcggaggggtcgccggactccccgcggtcggagttcaccacccccagcggatccccccgcgcggccgaggattcgacgccgcctccctctccgccgcgggccgagcagccgccggtcaaggaggaggcgccggcggcctccccgcagctggccaccccgccgccggtgaagacggtctcaccgccgctgcccgccgcgaagctctcctccgccgccgcccctcggcctccgccgccggtgcaggtgccactgccttccgcgaagctctcggcccctaggcccccgccgacgccgccgccggtgcaggtgccgccgccgcagttcgagaaggcggaggcgaggcccgatggatccatgctcgccttgttctgggacacggtcgcgcgcgtgcaagaaggtgggtgattgattgaatcccccccgggcgcgagagatttgattttctctccgatggccgcctcattgtgtggtttcgaaattcgaattcgattcgtgggttttgaaattgatttggtgagcatttatcgctgcagcgcacgccagcttggacgagtacatctcgaactggttcgggctggatcaatccaagtaccagtgggctctcaacgagtactatgagagcaacggaaaggttctcgcctccactctaccccttctgcaaaatttttttgttctttcagtcttgttactttcaatttgatggtgtaaactgcatcaatgctttgcacggatagcgaaattgtggtgatttgagcgtgagtttagcaaagatccatctgtcctgtggctcagcgttgggagttgggatgcagctgtctctgatcctgtactggagtggaatcttgtagcccattcgtgattccgtgtggtttataattgtcggtggtggtaggcctgtagctgtcaccgtttgtaatcctaagtgcggcgatttagtgctacttaagggttacaacattacaggatgctggtagtagtgggtgggtagtattatggttggtaatcaagcccaaagcttctgtggagaatgtagtttttggatggtggtggtgctagtcaattgtgatttttctttccctgtattgtttctgacccatgtactgcactaaaatatcatgcatctccctattccccgtattgttttctgacacatgtattgcattgcacatcatcttttccccttttgatctacctaatattcttttcttggtggtctaccatgcatgggctggattaagtaatgtatggtcacttggtcagtactggaagcacaacttgtttgccactggatgtgttacttactagtacctgattggctgattattattagttcttgctaaattggttcttaaatatgtttgtatggtgaaactgatttagatttaagttgaaatgttgctttagattcatctatgtcctcccccctgtagatattgttgactgcctttgttaataagaaaggtagtaatttgcattggttgtttgcacactttcattcctttgacaatctccacatgtatcttgggatttgtcacctacacataattacattttatcaccttgtttatggggattagactatatatcttaattacggatggtcaatttcttctatttaaagcatacatgttgggatatgtagaagagttaagtccctatttagaatgcagagggacaggtacctcgtgcttttaggaattgaactgtttgcaatattagattcttcaaaattcctgtactctgtcattgcctaagtattggtatttattgtgtatttatatagcagcaaaccatactaattctattttttcacaattagtcttcactgtgatatggtaacacactcttttgctagtgttggtcataatgtttctatgatgtaccaattagtgtgttccaataaaaagtctcagatgacattgatggattccatcattgaaagaaccaggcttccaaaatacctttctgaaatcaaaatttgaaaagctaacatgagcacgaattttacatttaaaaatctggatatgatgagctaaatgtagatcagagtctttttatccatccccgcaaagaaaaggtctttccataccaattatcaaattggacttctttgtgaagctggtataaaatttatttggcgtggcaatacatgccattgtacatatcaaattttcttgctaacatggacaaaagagatctgattattgtaaaaaatgcttaacataatatagaagtatttattgacaccagtcatatagcctgtaacttcgtacaaggttgtgtgaacatgcagttgcagacatatcgtctgttatttttatcaagccaaagcacgcaggtcctatcatttcttaccagacttcttattagaacatatatctacagatatgtgttttcttttgaacaaaagaaaaattcactattgtgtggtggggatccaaattaggaaaaaactttgtggaaagatctggtcttattttgggaattccctatgccaggtgctaggtgcgccagaagtcatccttgtcttttcgttcaatcaggattagctttggattaatttcaatgttaagctagataagatttagctcctaagattttctgtttgttagcaaggttattaatcgattttagaaggcagaactccatcaataagaaggataagtagaattatcgccaaactctctctctctctctctctctctctctcttgttcagctgttcactgtcatggttcggtggatgcaccatcctcgccctcccatggagcaccattactaccttaggagctttggatcaaccccagttcctaacatctggaaaatgaattttgctattataggatatgttagtatctctttaggcttaaagttaattgcctagtctatacttccctcaacctaagaaaatagacatgccacgctctttaattctttatcactttgaacttttatagttttgttattgtaggtgccaaactgccaacatttaggcatgtgcttcgtgttggatgcagacatggcttgttcttaattttcagtggcctatctaccttcagtgattgcctacaacactactgtatgaccagagccgctctgcattctgatctatgtgctgtgagcctgtgacagtcacaaagaaagtaattcgtgcattattgaactgtggacactgagcacaccagacagacttgacctgacaatctgacatcaatgccgaagtggaatgtcgctgagtttatttacccatgcagtttgtctggtctaggagacattcttgtcttgtaattaaatatttggctttgcaatcctttggttcactgttatttagcataatcaagtgttgctatatttttctttagacaactggtatatttgggctctccatttgacttatttttcccccttctaactgcattgcaggatatggagtcagggaaagctgcgaagccgaaggaactcggtagtaaaatgtaggtctaaaaagctggattacatctgtatatgtcaatggggacatctcttcgattctcgccaattcagttcgattttatgtcgtatctgtctaccatgcagcaattcctttgtttgcttcatttgtgtagctaagctagagaactgtgtgaagtttcactgggaagttgatacctcttctgctgcaactagcaggcccggacacaatctgtaatctgttcgtgccaaagcgttgaaaaaagtccagtgcggcaaaaagcattttgttggctcctcgcaccaatgtgtagccctacgtattctttacaacattttgcgttgtaattgcatggtgctaatattctgcgaatgttttctgtgctattttttcaaacgcatgtggtcacaacatgtgcaacaagctacctctgagcatttctgaaaaactggactggttcactggtatatcttgcattcatgaagccatcactattgacatacatatcattaaaaatataattagcatatttatcgattttaaagtctagaatttaaatttgggtgggctgaaactggtccaggatttgacccggatgaacccggtccatcacaacgaacttgagctacgctttacttcacgttttctgtgctatatattcatttatcactacaatacataagctttatttcgatgctaatggcgattaggttgcaatctgttctgtgaatgaaatataataccgttgaacagtgaacacacgatgagtacattggtaatgtggtttacaataataaccttgaatgaattgtacaaaatcaagtagacaagtacatagctcagattggcagtaggaaacaaggcgtttcactacgctacaaggagcacactacgataatctaccacgccaatcgcgtacacggggatcaccgggaacaccaccatcaccggcacaagcaccaccggaccgaactgcaccgccgccgccgctgccgtggaagatgtcatcgccggtgtgtcgctgtctcctgatgaaccggatgttgcaccaccggacgtcgaggcagtcgccgcgtccgagctcgatgacgtcgtcgccagcgccggcgacgaggcgctccgccgcatgcccacggtggcggtgacacggctagtgctcgtctgagttgcagccgccgtgtccgtgttgccgtcgttgtcgtcgtcgtcctcgtcttcctccaccaatgtcggcaagaacggcgacgacgcgctcctcctgagcggcgccgcggtgggcgacgtcgacgacgtcgccggggcgtcgtgggcggcgaagaggaacacgcggatgcggccttgcttgggcttgctggaggccatcaccgcctcgtggaagaagagcagcgacacgaggctccacaggtcgccgtcgctcgccacgtcgtggaggtggaggccctcctctcccgggagcgcgtactggatgcggacgtcgtcggagtcggagaagccggcgagcgccgccagcctcgcgcggaggccggcgaggcgctccgacaggccgaccctgacgatccggtgaactcccccggcgtagtagcacgacgccgccgctgatccgccgcgctgctgctggatgatctccccgccgtagctcaccttcatcctcacggcggtgcccgagcccgacgtcgccagcgacggtgaagacgcgctgcgtggcaaccccagtgtaacgggaggagcagcagaggcacttccagataccagcaccggtaacgacggcgccgacgcggttcggtgcggcggcgcgtcgtgatcggcggcgaacaggaagaccctgatgcggccgggcttggacgacacgggcacctccttgtagtagaagagcagcgacacgaggccccacaggtcgccgtcgtccgccacgtcgcggatgacgccgaggccctccccggggagcgcgtagcggatgaacacgtcggcgcagccggcgagcgccgcgagccgcgcgcggaggccgggcagccgctcggacatgccgaccttgacgatgcggtggactccgccggcgtagtacgccgccttggccttgccgtcggcctggacgatcgcgccgccgtagctgatcatcatgctcaccgaggcgccgtagtcgccggcgggagccatggtcgcgacgggaaagcagcaatcgaagaggacggaatggatgcgttggatggtctctagctggtgagcgccgccgtgcttttaaggagcggcgacgtactccgactccgaatccgagtcgaactcgaacgctgagtccgagtccgatttggagttggaggcggtatatgtccataattggaaaggattgagagggagggctccaatgttgccgtaggccgtactccattgcagaatgtcttcgaggaggtggtgttctgttcgacggtgcggcggcagaacggagatggcgccgggccgccggcgacgaagaagaagaggaggaaggaaaggaccgtatagccatggcgctcacgacggtgcgcacgcaggcaggggtacggacagcgtggcatgggggcctgggagcacagcgcgagttgggccggccacagagacagggaaatgggccatagctgtggccaggaaaaccagaggaaatatgataagaataagttcatctaaggtcccttaacttgtcaacgaatccgatttacgtccttcaaccgcaaaaccggatacaacgggtccctcaactatcaaaaccggtgcagattaagtccctcggcggtttcaatggcggttttagctgatgtagcatctacgtggctaatttgactcggtctcgatctgacactgatgtggacgcttacgtggcaatttgatccggaaaaataataaaccccgtaagactcgtatgtcagtttcacacaaattaataaaagaatggcgggccccacatgtcagtctaactcacccctcctcttctgcttcctctctccccatctcccctctttttctctctcttgcgacgacggcggggcgaaaatggagaagagtggccgccggccatctcgctcttgcacgcgctcgccggtaagactagggagctcgcctagctccttcccaccggtcgtcgcccttgtccccgatggctgccgtgtcagggactctccactgtcaactgttgagggtggtgccattggcgggaaggatctgaatgcagaagaggaggaggacgtccagacttctcaaagcgacatctccacaggcaatggtcatcggccggttcgggagcgtaggcccaacccaagagtgttaggccctgaatgggtggcgtaagacaccagctcgcctgtgagctgtcacgtgagggagagggatgtattaaatcaaacgatgaacacttgtatgaacgatgaattggcaactggaggcgtaggcggcggcggctcgatcctgtcggatctgagaggaaataccacatagttgccacaatttcgcatatatctgagttgttcttgagagtccctaacaatctggtatcagagccattcgcgctgcaaaatcctcttggtttagccgtaaaatttccgggagagaggtgggatcctgctaccttggtggcgtgtgatccacaaaagcttcggctccctcaatctggttggctgaattcggagcgctagcgcgggttaggatccagagtcacacaccaatggatttagacgccaagttcgatctcttgttcaaaactattgcagagaatgaaaggaagagagaggaagcggaggtccgaaccagggcggagtacctggatctgaagaagtcggtggaatctcgtattccggcggtggagaagagggtagaagatctgggcgcctcgctgcagtcgctgagtaccaaggtcgagcacctcgagggcagtctgatgcgtcacaccaagttggagccagatgctagtactgccaagactgggggatctggaattatcaaggaagagcagaaccaacccaacacagatctgacttccccttctttcggtatgaatgaaaatttttctctatcccgtgctccttttggatttgaacctagaacaccttctcttgacagtggaattgctagttacaatttgagtagcactattcctcccatgacatgcccccagttttgtggtgacaacccacagatgtggaaggttaattgcgaacaatattttgatgtgtttggtatccagcaaattcattgggttaaaattgctactctcaatttttgtggtaatgccgcattttggttgcaatctgtccgaaatcagcttggtggtattacttgggtgggtctctgtgatttagtgtgttccagattctctaaggatagacaacaagctcttattagacaatggttccatatcagacaagatggttcagttgctgaatacgttgagaaattcgatagtctaatgcatcagctccttgcttatgataattctctattgccagtctattttgtcactaaatttgtggaagggcttagaagtgatatcagagttgtagtcctagttcagagaccccaggatatggactcagcttgtgctgtggccttacttcaggaagaggccttggagggtgttcagtctactcagtataaaaaacctgacacctcaatacctattcgcaatagtcacaagggtgctggggttcttccatccaccttgccacctaaacaattgttatcaccacaatctgaagataggaggggc

SEQ ID NO: 50803 - DNA, 6245 bp, Oryza sativa
tgatggcgaaactctttcttgctcatatgaagttaccaattgtaggtggtggatgcagggacataactttattaacaatttcaggctcctgaaccttggtggttatgatatcattctgggcatggattggctggaacaattcagtccaatgcaggttaactgggtggacaaatggatggatatcactatttctggacagcctgtcaggttgcaaggtattgtatcccaggtttctcattgctctcctatttccacagaacaatgtctgggtatggtcagacaaggatctctcatgtatttggttcaactcacttcttctgaccctgtgactaaggaacccattcctgctgctgtacagcaacttattgattcatttcaggcagtttttgctgaacccaatggactacctcctaaaagatattgtgatcataccattcctcttgtccctggagcagcccctgttaacttgagaccttacagatttaatccagctctcaaggatgaaattgaacaacagatttcagatatgcttaagtctggggttatccaaccaagtcatagtgccttttcttccccagcccttctagtcaaaaagaaagatggtacttggagattggtgattgattacagaaagctgaatgctatcactgtcaaaggtacttatcctatgcctgttatagatgagttgcttgatgaacttgctcatgctaaatggtttactaagcttgaccttagagctggataccaccaaattcgcatggctcctggtgaagagtataaaacagcttttcagactcatactggccattatgagtataccgttatgtcctttgggcttactggggcacctgccacttttcaaggggcaatgaatgagacattgagtcccgtgcttaggaagtttgcacttgtgttttttgatgatattcttatctatagccctgatttctcatctcacttggaccatattgctcaagttctctcactcctctccaagcatcagtggtatgtcaagttatccaagtgttcttttgcacagaaacaactgacatacttgggtcacactataagtgcagctggagttcatactgaccaaggtaagattcaggaggtagtgaactggaaggtgcccactactgtgaaaaaacttaggggttttctgggtcttgctggttactaccgcaaatttgttaagggatttggagttatcagtaagcctctgactaatctcttgcgaaaaggagttcctttcatttggactcctgaaactgatgctgctttccataaccttaaacaggctttggtttctgctcctgttctggcattacctgactttcaaaaggtgtttacagttgagactgatgcttctgattccggcattggagctgttctctctcaagatggacacccagttgcttatatcagtaaggctttaggtcccagaactaaaggtctttccacttatgaaaaagagtgcatggcagttttactggcagttgatcaatggagatcttatttgcaacttggtgactttattattctcactgatcatcatagtttaatgcatctctcggatcaacgtttgcatacaccatggcagcataaagcttttaccaaactcctgggtctatcttataagatttgttacagaagggggtctcataatggggcagctgatgctttatctaggaaatttcagcatgatgaggaagaattatgccacatttcagcctgtactccaacctggctccaggaagttaccacagggtatgccagtgattcttattccagtcagttgctcactgaattaactgtacagcccaatgcaagaaaacatttctctcttcatgctgggttgcttaaatataaaggaaggatatggattgggaataacagacagctccaattgaaattactaactgaagttcattccaatccaattggggggcattctggtttccctgttacttataggaaactaaagcaactttttgcttggcccagtatgaaaaaaatgactaaactatttgtgcagcagtgccagatatgtttacaggctaaacctgatagagctaaatatcctggtctccttcagcctttacctgttcctgagggtgcttggcaggtggtctctttggattttattgaaggtctgcctgtttcagatcatgcttcttgtattttagttgtggtggacaagttttccaaatatgctcattttcttccttataaatcaccctttcactgctcttggagttgctaaattgtttatgaagcatatcttcaggctgcatgggctcccactggtactaatctctgacagggacagagtatttaccagtcagttatggcaacatttgtttgaaggatctggtacaaaattgcattttagctctgcttatcatcctcaatcagacggccaaacagaaagggttaatcaatgtctggagatctatctgaggtgctttgttcattcagctcctagcaagtgggcagcttggttacatcttgcagaatattggtataatacctcatatcactctgctgtccagtctactccctttgaagtgctctatggtcattccccttgtcattttggcatcagtttacaagattgtgccattcctgatttacatgtttggttaaaggaaaggcagttgatgcagaagcttgttcaacagcatcttcacagagcacagcagcagatgaagcattttgctgataagaaaaggagttttcgtacttttgctattggagactgggtgtacctcaaattacagccctatgttcaaacttctgtggctgtcagagctaatcacaaattggctttcaaatattttgggccatttcaaattacagcacagattggaactgttgcttataaattgcagttacctcccaccagttctatacacccagtttttcatgtgtctcaattgaaatctgctactggctttacaggacatgttcagtctcatctgccatcgtctatctctgccttgcaagttccttggcgcattctggacaggcggcttgctaagaagggtaattctactatctctcaagttttggtgcagtggtctgagtcccctccagaagatgccacttgggaagactatgaagaattgcatgctcgatttcctgctgcattggcttgggggcaagccaattctcaaggggtggggcttgtcagggactctccactgtcaactgttgagggtggtgccattggcgggaaggatctgaatgcagaagaggaggaggacgtccatacttctcaaagcgacatctccacatgcaatggtcatcggccggttcgggagcgtaggcccaacccaagagtgttaggccctgaatgggtggcgtaagacaccagctcgcctgtgagctgtcacgtgagggagagggatgtattaaatcaaacgatgaacacttgtatgaacgatgaattggcaactggaggcgtaggcggcggcggctcgatcctgtcggatctgagaggaaataccacatagttgccacaatttcgcatatatctgagttgttcttgagagtccctaacatgccggccgtccgccgcccttctccccgatgaccgccagcgggagaggagggagcggagcgcggcggcgtcggccggagaggagggagcggcgccactactttcaccagcgccccacagcgacgacttgccggcgccgctcgccgcggtgacgacgatgaccgtggatgcggcggcgccagcgctggcctcgacgtcctttgctggccggcgtcatcgtcgacgacaatgacgactcgtcagaggacgacgcaccgtcgacgtacattccgatggcggccttcctgatctcgagcacgaacagcagcagcgtgaaccagacgatggcctggaagacggagagctggacaattgttagcattatttttgtgtggcagttagcttcgtgcatgcggctagctagtggctgccgaattaattggatcgcgtgctgcgtgcgcgtacgatgcggccgaagtttttttcttagtggtgtgtctgctgggctacagaagtcatgtaatctcctgagttaagtgccaagtgaatgagaaaaactagataaggcgttcatcatcgagaaattcttctgtgtttgtacacaaagattttcgctcaagctagtggaagtgcgcgtgttgctgtaatccatgaccagagctgtacgactgacatagatgctgcgccctctcgccgtacatggcgcgcgccatgcgctctctgtcaacgagcgaagttggtcagcgtggacaccgagtagctggtgatgactcagtgcaggcgcatccgcctttgctcatgaaccgagcccagacgctcatgacggcgatgggttcgtctggactagattcagatcccttgggatccaccaagagaggcttgagctcggcagaggcggcgagggggtcgggtgaggcgcgggcagcacgaagtcgagcggcgaggtcgggctacgaggaggcagcggcgaggtgctcctgccgctcgtggagctcgtcgcgggcggcgaggaggcggtcggagaggcctggggacgaggagagcggcgcgagcgccaaagcgagagaggaaaggggagagagatgaagagatgggagatggggagagagaggaggaagaagaggggtgaaatgacatgtggggcccacgtgggccctgccattttttattaatttatgtgtgaaattgacatgtgggtctcacggggtttattatttttctgaattgaattgccacgtatgcgtcacgtcagtgccacgtcagatcgagaccgagtcaaattagccacgtaggcgccacgtcagtcaaaactgctatcgaaaccgccgagggacctaatttacaccggttttgatagttgagggacccgttgtatctggctttgtgattgaaggatgaaaatcagattcgttgacaagttaagggaccttagatgaacttattccaatataataataaaaagaaaaggaaagatagagggggaagaaggaaaggagagagacagacaagctagagggaggaaatcccaattcaagatctaaaactctaagaatcaaatcaaagaacttttaattaatatataaaactttcatctaaataaataataaactttcaatcaattaaaaagaaaatctaaaaccttcatctaaatactcaaaccatttgtctcaatcgtcaccatagccacagtgacactacaggtgctcttccgttgctcgtcttacttcagagaagctgggcatgtggcggcgggctatgataaagacagtggagttcacatggcaatagcaacggccgatagttgataccgtaacctcgaggagtcaccaccgaagtatctaatatggggttggcatgatgagctgagtgtgtgtcacgccctgaagtttccccctctccttgctttaaaaattggctaaataaatcgtccgaagaaattatcttaattaacctagagctaattccctaattaataaatgcaattaataattgaattcggcgtggtggaatttttcttgagttccccatgctccaatgcattaacaagatttttagtggaattttcagagcattggaaataattttaaccaattaaaaatgagcaagcgcaatattttaatcccaggaaaatccttcccctctttttcttttcttttccttcctttttctctagatgggccgtcggcccatctctctccccgcgctcggcgcccctttcctgggccggcccgttccttctcccctccccgaagtcctccctccctccctctctccttcgggcgccgacaggtagggcccacctgtcggtcgtcttcctcctctagccggttggagccgagccccaaccgccggcgccccacctccccacgccgctcgccttctccgtccctcttcacgccccactccgcgcccgagtcgccgcccaccttccccacatctcccggcccgtgcgcgcgctcgagagggcgggattcgatttcgaatcccacccccctctctctctctcctccccacgtcgccggccaaatcgggagggttcccggccacgtccgccctcctcgtcgccgtgtcaccgccgcctttcatcctccgctttggtcgccgtgctcgccggtgaggctcccctccgctccccttttttccctctctcccgtgtgcgccgccgtccttcgcgcgtgcgccgtcgccttcagggctgcaggaa

SEQ ID NO: 50804 - DNA, 9851 bp, Oryza sativa
ccctccctcgcccataaaagcactctcccgagccccctctttcgttttccctcattcgccgcgctctcccgtgcttcctatcgtcgccgcgccgctcgccccttacgccgccgcctaccgccgtctccggccgcgcgccaccgccgctaaagccgctaccgcgccgtgaagccgccgtcgtcgcgctcgcgggtgccgtccgctcctcggccgccgcttggttgccgccaatcacccccgaaaccccgtttccctcgctcgccggtgagctctcctttttcatccatctccggccggccactttggtcgttgcggtcgtcctctccacccctaatccctctcctcctttcctataggtgtcgcctccgcccgtccgcccctcctcgtcgccgtgtcaccgccgcctttcatcctccgctttggtcgccgtgctcgccggtgaggctcccctccgctccccttttttccctctctcccgtgtgcgccgccgtccttcgcgcgtgcgccgtcgccttcagccgctgccgccgcttttcgccccgtcatccgtcgcttcccacgccgccgattgccgtcgccggcgaccgtgcgcgtcgccgccggttgccatggccggccggccggttttgaagccgagccgagccgtgcctagccgccgccgtgccgtccgatcggcctcccggccgatccggaccgtcggtcccgtggaccggcggtggaccacccgcgtggtcccggtccacggtggaccggccaccttgtgccgctgacccatggggcccgcttgccggcgcctctctctcccctctcttgagccgctgacaagcggggcccgcctgtcggcgccgccccccccttggatgacgtcagccctgggctttattgcgcaataaagtgattaaggacttttctttattagtaaaaacacagtttatcttctaaaattcataagtaattcatccgagctccgtttaagtccattcaagtctcagtaaatcaagaaaaatgcaaagaatccattaaaaatggttttgttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatgtaacgtgggatgggtcctatttctcagccacatattggttaccctatgccattgataacttgggtatcaaaatgattagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcaattaaggatcggttcacgggaaaccctgggagacttaccgtgcttaccacaagcgggagtgggtaactgcttgatctgaagtatagctcgaccctttcctaggcaccggtggcgagggtgggcgtgacggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatgccgacatgtgtggaatcgtgtcttgtgggtacagttgtacacctctggccagagtaaaactattcgaatagccgtgcccacggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccaccccagagctgaagatcttcctagttggagctgttttgtcaaagttggtttcgtcgctgccgtcaaggattgcctgtggagtggagtcgcccgctgctgaagtcaagctttccggtttagctcgcttttatcttttccgctgcatttgcaatcttttccattttgtaagacgtggatctgtatgtcaacaattgtcgtttgtgtaccctggctggtcctggacagggatttaatgcacattcagcttagaaattctggttcgagaatttctgggcgtgacagtgtgccaattagaagttttaagagagaggatgaagaaaagatacatgaaaatgctttcggttgagcacccgaaccaggcccaaataccgggtgacctccccctgattccatcgctgtagcgtcgtctcatctgccgtgcctctgcatgcatgcatcataagattgtatcatgatctctcttccttctctctcctcctggatacatgtaaaacttttttaaactaaagtttaaataatttttatcttaagttactaatctgttttacgacctaagccaattgtttggtctgttgcaattaaatctttataacaaaatctcacatggctatattttattgtttttaactttttttttgtagtggatcttttataaatgttgcccatggtgttattgaatatttcaataagtatttgctcatgtttcacctggtcatttatagttgttgcatgtaaaatttcttttagatgtttcacgaagtatttttatgtttcaataattacaactcgatgtttcatacgtgatataaaaatattttaataaaaaagtgtttgaatatacattatatgtttcatatatggattttttttcatgttttactcgttgagacttaatgtttcgtaaggtaattgtcattgttgcatctatctcaaacattagttgaaaaatttgtaagtgatgaaattatgtttcataagagataaaacaatggtttttaggacatatatgtttttattaaaatattatcatgttatatcttcttataaagaataaattacaacgtacacaacggttttaagcggatcataaatcagatgctccctccatttcatattgtaagattttttttgacttttctctaagttaaatatggttttattaaatctaacattgaatatattttgattatatgtttaattggtgttggaaatgttgctatgttttgccataaacttgatcaaaattaaataaatttgatagcaaaaggtcaaaacatcttaggatatcaacaatgtttactaccaaccaaatgaaaaagagtatggtttagattagttgttactagttgttacgaaagctacaatggtaaaacaatagaagtgggtgtcaaacttgcccccccccccataatccactagcaatacgagggggaaagagataaatcatattgtttatcctttattgctcggtaatagcactataacctgttatttgctagtatttcctagttctacaatgcttatagtttgattaaacctagtaaggcttcatttacttattgctttccttttgtactttctccgtttcaagttataagatattttgactttggtcaaaatcaaactgcttcaaatttgactaagtttatagacaaatatagtaatatttacattaccaaattagtttttattaaattaataattaaatatatttttataataaatttttcttggattgaaaatattactatttttttttctataaacttggtcaaattttaagtagtttgactttgaccaaagtaaaaacatcttgtaacacatattgtggacgtacttatgatatcaaacagatgaagtagtattctaggagaaaaacttgcttaaaattttagtaaaaatgtggatatacatatatcagagaagggggagatagaaaacagaggtggggaggggatccgaaaggcctatattagggtgtgtttagttcttgggtgtaaagtttttgaagtatacggacacacatttgaagtattaaacgtagactaataacaaaacaaattatagattccgcctgtaaactgcgagataaatttattaagcctaattaatccgtcattagcaaatgtttactgtagcaccacattgacaaatcatggagtaattaggcttaaaagattcgtgtcgcaatttacatgcaaaatgtgcaattggtttttttcctacatttaatgtcctatacatgtgtccaaacatttgatgtgatgtttttggccaaattttattttgatctaaacaaggcattaggagggtaggtatcatttatttttttttgaagaatcggataactaatttgtagtctcctccattcaaaaaactgatcatcacgggaaaattttggagcaggttaaaattcaaaaattgaagctcgatctcgaaaacaaatagtaaactccaactgaatctagggctgtgcgtgacggctccaacagggttatgatcctgccctcctgcaacaccgacggcggtgatatcaaaaggagaaagacgacaccgcgccgcgcgcatgtatggccggttgcacagttcgatagttgcggaatcgcagcatctgttgcggttcacgggactcaagttaatttttctcttctcactaattaacacagctacagtaattaaatcagcattaataaccaagaaaagaaaaagggagtctaagcctctaattaattaacattaaactgaaatgaacatcacgagccccgccgccatcagcccaacgcctgcgccggccaccaccgcgcagcttcccgccgacgttgttgtcccgtccgccgccgcacttgtcccgtttgtcgacggcgatgtcgtcttcgtcggcggcgtatccacaattcccggaccatcaaccgccgccggagcgatgggatcgtcgtcgtagtccgtcatcgaggaggccgacgcgtcgtcggcgctcttggccgtcgccggagaagacggcggcgtgccgccgccggaagaggggccgcccaagctcggcgccacgatgggggcgctgacctgcatgacggagaggttgtacggccggcacgccacgaccttcaccagctgcgacccgatcggcgcgccgggctcgccggagccgaacgccatctggtcgtcggcgacctgggtgtacttcacgagccccacgcctccgccgccgccgccgcggcggtcggccggagcagcgtggggaggagcgccgtcttcgccttgaggctgtacagcttgacggggtcgtagtagtcgaggagcacctgcagcgccaccacctccccctgcgtggcctccgggagcgacgtgatggcgccggcggcggcgtcgtcgacgacgaggacggtgacggccggccgcaggttgaagtcctcggcgagcctcgtctgcgagaggaggccgttgaacacggagaactccgggaactcgtgcaggatctcggtgacgttgaacttgaccgccgcggcggcgggcggcgacgacgacgcgaaggcgagagctaggatgagtccggcggcggcggcgacggcggccatggttgctgtgctctccgcggcggaggaggccgtcgtgcacgtggagatagtgaaattgggaagggaaggaacgtgagggctaaactgggggtgtacgtacgtgcatgggagtggattgcatgcatgcatgggcgcgccaaaaaggttagacgttgttgacgtacggtccatgacactttgaccgagtctctggtgggtccatgtcatgaagccatgaagaacgttgtgcacatgggctgatgataaggctgataaactttctcatgctccaagtccaaggctttttgttgtcattaaatcagttttctctcccttgtctatttatatgtatcctgtttattatatgtccatggtttttttattatgaaaactattatatctcttaaaatatagagttttagctatactagtaattacctatgcattaactatgcacatgctcatcatttaaacattatctagtctgtctctttccaacccctgtaactatatgaattccttcactacatgtaagaccataccaaataaaatggacattattttgtgtagacattatttttttatgaaacgtttaaatttattgagcatgtgagtttcaccgacaaggagaccatacgctagtgctaaaggtagtggtagcagattcactactactacctttaaattagtatagaaatctaggcacttgctatatttcgagaccgaggtattaacttcaaaattaacttctatcatttgagcttttagatggtctgtttggtgtaccttcaactctcaaatccacttctgatcaagttagagcacaaccaaatgtttcatgagagattgccggattgctccacaaaaatgaactagcagcgtggagtggcattctcgccactgcactactccaaagacaacaagatttcaggagttaaagtggcaatcccgcttagtatatactagtataaaaattaagaaaataaattgctagtataaaatttgagagaaaaaaaataactagagtggcgaattcgaagcgaggggaaaaaaccgtttatccgctctaattgcatccctagccgacatcaggaagagaatcaaagaaacctgtttgtcttagaacttggaagtatatttaatttgtcgtcccattaaaggaggacttggaataataagagatattcaagctgttaacaaattaacctcatcctcaacactgcttggagagtatccacctcagatgattgagttgccaaaatcactaaagccaatgctatattaagaacgaatgtatggtgggaggggaagcagtacaagatgaaatccttgatgcccacgtctgaattcttcaaaattttaaattttgagccaaagattttaaattgcatcatgtcaattcttcactttctatttttaacttttttttatgatttcttgaatttagtgaaacataaattatttttgaactctaaaaagttaatttcagaacttccttctttttaatgtctctgatttgaatatttgaatcttaaacctttgtagaatcatgtgatgattaatctttgtgatgaacaattattaaatgtaagtgcttgttgaaaatatggtgatgtgtttttggacagtgaatagtgtagtggtcggcattgtgaggccggtcagatcgggggttgccaccagttagaccggaggtgttggtgcggactgacctagtagcccgacggtcaagttggtgtgaagttgtactcagatatgaagtttcttgttgtacatgtgtaggtgttgcttgagaccatgggagtataaatgttaatgaatcgggaataggcttggtagaagttgaggttcagacggtcaaggatatcacgcgggatacttaggttacagaataatgcacgtcgaggtgaaggtttccatatggtatacacgtggtgttgtgtgcatgtggaaagaggagtcaaatttcaattggactccaagtttggaaagattggagtgtagagttgtatggggatattgtttccctcgtttggtaggtttcctatgtgattaggagtcctagttctagttggatttgtggctaggggcagccacaatgtgggtataaatagatgatgggttgaggctagaagatatcgactttttgggagagaaaaattagggtttctttcgaggttttagcactaggtcaagagttgagagatgattgctttagatgcacttttaaacacatattgatacaataaagttaatttactttcttgagttttgtcggtacatgtttttctggatcccaacggtgaccagagtttattgggcggcctaactggcggcgtgatggcggtgtaagtgatagtcagaggtggtccaaccggcggcaaggtggcggtcagacaagcggcatgcatgcggttagaccgtggcaatctaatggtgccatcggttgaacttcatcaaatatgagggtaacttttatccccgctaaaagttttggtttttggtggtcctaccagtcatccctcccctcttgtaggcttgatttttgtctcgatcatacaacattttcttttctatgtgtgacatccttggatttaaattctttggatttcaaacttttcttattttcaccaatctctataaaatacctcaaaattgacaaaattagcttaggagactctagctttgtggcgtttgcttagttttatggtactttgccaaaagacattcaatatattattttaatatatcctattcaattgtagagataaaacttttcaaaaaatgattttacccttggttcacctagcatattcaaacccaaacaaattctagttggttctaaacatttgcaaaaatttaaaagctgtcccaatttctggaaatcaaaatgttttacaaaaaagtataaattcagaaaataatatttcaattttcattttttttaaaaaataatgtatttgatttcagtaattttggatcaagttttgaattttgcaaaaatatgtttaaattgtacaaaaaaagtgtttaaattttaattatgcttggcgaaccaaaggtaaaatcatcttttacaaagttttatctctctatttgaatgtgatatattaaaataatagatggagtgtcttttagcaaagaactataaaactacggtgtcgtatgggaaaaccacaacctagaatgccctatagaaaatgtcacaaattaaagctagagtgtcctagagcaaattttgtcctcaaaagtctataacatgctttattcttactaattcaagtgtaacctatcaaactaaacgaatttactgttaataatatttaacccttttcttcattttggagttctagattcaaattcttgatatatattgcaaacgattagttctgtctttcgctaaaaaaaaaaatccaagaatccatatcataatctccactaacaaatttcagatccggtcctccaaattgaatgaaactaattccgattttcatagtttaccttttctcaaaattaaagtttatttatccaaattttgtaatccaaaaccttttatattcccgtatacccatgttggtatttgatattgtcacagataaatcagcaagcacacggataccactgtagcactttagctcaaagtattccaagggtattgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttcttttttcctttttccttctttttcctcttcttgggccgtctgcccagtccaccccgtctccccgcgctcggcctttctcttgtgggccggcccgttctccttcccctctctccaggacgctgacaggtggggcccacctgtcacgtcgtctcctt

SEQ ID NO: 50805 - DNA, 9625 bp, Oryza sativa
  unsure (1)..(9625): unsure at all n locations
caacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccaccccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacttggattttgttttggaaaaatttggagttttgcctctttggtttgcgggaaaaatcttggtcgttctttcggatcggatttttttttaaaaaaaaaattagctcagtctagggctttagaaaaattttagttggagtttattcgacagtcagtcgggaatttattgggggttatgcattaggtcgtgtctatattcgatgggggcaatgttgcgcatcattttccatgcaactagtctatgcattaatttattgtttagttgcattagtgtctttatttgggttcatgaaaaatgttctatgcataaaaatcatcatgttcagttattcgtttgagtcatttgttgcttcgtttaatttggatttgagcatgaattggttcctatcccttgtctactttagatgtcagtcctatccctcgtttgcaagcgccgccccgagcttcagagtcgccgcccttagctttatcgccttcttagtctatttgcttgctagttttcgtgtttaggtttgttgcttgtgggttagtcggcggtcgatatcatgtgtcagtggtatgactgcctcaattaggagttgcgtgcccctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccacccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgctgagaggcaggagaagtttctgtcgggtcttgatgatgaattgaccaaccagttgatctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatgggacatcagggtggaccttccaccatgattatccggcagcaccgtccctaccacccgggtaatttcaacaagaacaacaacagtggcagtcacagcagcctcaacccgactccaagtccattaatgattccagctcagtcagatcagtcagatcagctagctcagccagctctgccagaacagcccaagaggttgggagaaaaacccgaactctgcttcaattgtaacaaacccggacacacggttggaaagtgcccgaagccaagacatgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcgcactcaatgaggtcactattaagaacaagtaccctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaacgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcctaatcctgcctgatcagacgaaagattttcaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggctaatgtggtagcagatgccttgagcaggaagagttactgcaacgtcgcatgggtagaggaactatgctgtgaggttcaacgtgatttggaacatttgaaccttggtatagttgagcacggattcgtggctgccctagaggcacagcccacactggtggagcaggttcgcatagctcaggcaagtgatcctgaaatagccgagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaaattctggtgggtcagcatgagaagggaaatagctgagttcgtagcactctgtgacgtctgtcaacgagtaaaggcagaacaccaaaggccagcaggtctgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcaccagctcttccgaatctcggggtcgagattccgtttaaggggggtaggtttgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttcttttttcctttttccttctttttcctcttcttgggccgtcggcccagtccaccccgtctccccgcgctcggcctttctcttgtgggccggcccgttctccttcccctctctccgggacgctgacaggtggggcccacctgtcaggtcgtctccttcctccagccacccgcctccgacggccgtccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaatagggtgggttcccggccacgtccgcctccccctccgcctataaatcgttccccgcgtcttcctctctcgtttttcgcactcgccgcgctctcccgtgccgtctaccgcccacgcgccgtcgcacccgagctccgccgcttgccgccgccttcggccgcgagccgccgccgctagagtcgccgccgcgccaaaccgccgccgccgttagcttcgccgctgcaagagctttcccggccgccgcctcgcgtcgccggaatcccaccggagcacctctcccctcgcgagccggtgagtttttccctcccctccatctccggccggcaatccaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctcccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgccgccgcccactccctcccccttgagccactgcccgtggggcccacatgccggcgcctccctctcctttccccttgtgccgctgccagtggggcccgcttgccagccgcccccttcctctctcttgaaccgctgaccagtggggcccacctgtcggcgcagccgccccctcccctcgctgacgtcagccctgggccatattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaaatatcccgcatttctattaaatgttgcattcttttacaatatcatgtggaatgggtcctattactcagccatatattgtttaccttatgccattgacaacttgggtatcaaaatgattagatgttggtttaggaaatgcttagccatgcttagttcaactagcacacaaaaagggatcacattattaaatagactctgactattagcatagctttggactggtgccaccgcaagggtgtcagttaattaaaatattctgagtggtgggctgtgggtgcatggtttagctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatatggagggtcttgtcacgatttccccctttgcagtatcatggtgatacttcggggcatggcgacatgtgtggaatcgtgtcttgtgggtacagttgtacacctctggccagagtaaaactattcgaatagccgtgcccacggttatgggcgatcaaccagattcaccgtgattagtctcacccctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctctttttccccacacaagagctgaagatcttcctagttggagctgttttgtcaaagttggtttcgttgctgccgtcaaggattgcctgtggagtggagtcgctcgctgctgaagtcaagctttccggtttagctcgcttttatcttttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacttggattttgttttggaaaaatttggagttttgcctctttggtttgcgggaaaaatcttggtcgttctttcggatcggatttttttttaaaaaaaaaattagctcagtctagggctttagaaaaattttagttggagtttattcgacagtcagtcgggaatttattgggggttatgcattaggtcgtgtctatattcgatgggggcaatgttgcgcatcattttccatgcaactagtctatgcattaatttattgtttagttgcattagtgtctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50806 - DNA, 15575 bp, Oryza sativa
  unsure (1)..(15575): unsure at all n locations
nnnnnnnnnnnnnnnnnnnnnnnnnnnnnnnnnnnnnnnnnnnnnnnnnnnnnnnnnnnnnnnnnnnnnnnnnaggttttttagcagtctatattctttcctttccccctttttctgtccatccccattcagatggtgaacacaaggaatggcgaccatgcaacaggtgatggtagcagcagtgaggaatagactggaggagccaataccagtggtgcaactagcaatggtccacctccaccgctagagaattcaacaatcgctcaggtgttggccaattagacgcatatcatacaatgatatgcagcagatgcaaaaacaacaccaatatatgcaatagcagatgatgcaccatcaggcactgcagcagctgaatcagcagtttggtccaccaccaccacattagtccaaactactttagtttctccatgtcaggccacccactttctccagcaccatcaacccaatggaagccaatgactggcttcatgccattgagaagaagatgaacctcctccggtggaacgactaggagaaggttgtctttgccacgtacaaacttcaaggtcccgcttctgcttggtgggacaactacatggtcacccgctcagctgtgacatatgtcacttgggcggaattttgccgtagcttcaggaaggcataggttcccgatgggactgtagcacaaaataagagggagttccatgcgcttcattagggaaacaagatagctatagagtacctacacgagttcaaccgcctattattatttattacgacgacagaataatccgcaagcgcacaaatacagtcgtagccttcaccccaagagtattccaggatatagtatccacaggcaacgtatgtgtataatctaagaacgagattcttccaagggaaataactatatggtaggccaagaatagagaggattcctatgggttaattatcttaatcaagttaagataaaactctatcaattgcttcaagcatcggcttacccctggtctgccaaggagactctggctatggctctatgatgtacccgaatactgtcaccacctgttaactacctctacaacccgtggagcacacatcaaacaaaggtaatctctagcctagacatcgtgtctgtgctattgattactatcctaatcccaacgtcacagagaagattaaggtagtctacctaagcagagtgataaaactaaataaaattaaataccaaaggagatcacaaatacttacttataaaagaagcatccatcgaggtacaagatcggagggagtaccggcatcttcaggactccggcactcctccagaactcccctagaagaatgccaacatatccggcacttctccggaaccccggagagatgtctgaaatttggtgcactcctttcggagcttccccattctattcctacccttaaagagcaatgcctatgtatataagtgaagttgtagtctgcttgttggtgcaaatttgaagtgaggagtagaggggctacttataatgtggatacgacttgagagagtggagatgctatggaaatattctcctccaactcctctcaaacctccacatgtcctccagccgtcattggatggcagtttcttgcgttgagccttgtgccaccgacttcgggatagtgataactgtcaccacatggaagctgagcacgagggcagccattgttgacagtcattatagaccaatttcgaccgttaatacttccggaaataatggagaactagcaatgcttggatgcatatttacttagaaataatccaagtccacttgtacttggcaaagtatttgaatacagtagattacttcataaatggagaaatgatggaaattcaccgttcaaccaatcagagcccaacatgtggcagacatggatggatggatccacaaactcattagaacatcttcaaatgggcccaaccaccatgccactgggccaaggagtaaaatgtcagggcccaagaggaagtccacagccaggggggctggccaggggtcggcggacctctaggttctgctgaccccggcatgtcccggcccagccacaaccggctattacggtactactgacttttctatagtggttgtgaccggtattgtcgctcctaaccgtcattgatcagctataaaaggtcctcacctcctccatttcaacacacaccatgaatgattcaggtgaagaagctctctagtttacttactttgctccagtgctagtagaaattagaattataatagtcttctctagttcttcaagtcttccggagatttcgggtatggatctagtatctgttccctctcttgtaagactttatccgataatgaaatacttttctttatctagttttggtcctttactatacttgcataattattcgagtacgaactttagctcatacttgtctcgtattaaatatgtagttagcttaccagagatatgcaatagtattgtctaagtgtctatttatatagttgctctatgtcatctgtagagatgtagagtaatatttagtattgtaagcgtggtgcttagattattagatatcattaagtggtgctatatgccacggatctgtagaggtaggccgctgatggtgacagctcagtatgggtattcctccacgtgcgtaggtagggctaagagaggttcttgctgtgggtactcctccgtatctttaaccggttggatagccatgacggattgtcgtaaggaacccgacaatatggggcggtttctcgatataccagggggggcatagttagggagttattagccacagagttgtacaatagtaagtgtatactaaatgactatatactagaagtgcataaatgatgttgttctaatttcttctctatttagcctagacttataatttagtgagagtattctaaactgaaccttttatgtttcaaatctatccttatcctcaattgattaatccctgcataagactttgatctacataagtatgataagaatttatagcatattactatcctaccatatcttcccttgggattaaataaatacgatatcttggacgtacttccgggtgaaatgctatagcggtatatccatgtgcttgcggaattatttctttaacccatacgattaccgtttaatatttctgacaacattgcttgggactaagttcctagtaatgttgttaagaaatatcaacagccatccctagttcggccaaacctagtcgagccgcctcgtgccaccttgcacctgggtcactgcctagtgggtcttcatgatggtgtacggtggatggccttaaatatgttggttttactctgatttttgggccatccaatctgtgtattcacgtctgattagtatatttcatcgcatgtcagacggttttcctccataattcacatgcatacaaatattcaccaagacttgtggaactagttagtaatatccactacctctaagtttagtattcaattttatattctttaattttctttcttgcaggaattggcagtcggatttgacacttaaggatctacaaacatcgcctcacacgctactctcctgttgatgtgcgcaccgatgccgtgaggcaagagaagtttatgtttggtcttaatgatgaactaaccaaccaggtcatctatggagattatactgattttgagaagctatttgacaagttgatttgtcaggaggatcagcgcaaccagatggatcgcaaaagaaagggagcttagttcagggcgcgtcaggggaacaaccaaaagcctcgcttcatgactgataaatttttaagtttagatcagccatgcaaagatgataattcttctaattttagtaaaattttaggcttgatagaaattgaatctgtgatgtgttaatttgtggatgaacaattgaaattccggcacgaagcagtgaactggctgttgacggctgttaaataccaaattctcgccgtcaatacctacataaaactgaaagtataaaatatctgaaagtataaaatatccaaaatagtggtaggatatatttctaataatttccacgagtgttggtgtatatttagatgtaggtgacaaactacctaagttgagaagaaatatacatgaaggaggagaatcaaactcatattcaaacttatggagtttcggaccaaaaacccaattaaacacctccaaatgggcccaaccaccgtaccaatagaatgaggtacccaatattagtgctcaggaggaaaaacggggccaacggagccggccagggttcagcccaaccctgacagaggccactagcccaggcccaagttgagttcggtagcaaccgctccccaatgtgggtttctaccgttttcggctctccaactgtcatccaaatagacgcttggcttgaggagagtgaagatgctcatatgattccatggagggtctccacactccgaaggcacctccaccaataaataccactcctcatccttcattccaactcacaccaagatgtagcttgagctgaattataagaggctctttgtatgatttattttacacatagaatagggagagtatggtagaagaaatcggacgagttctggagttgtcggtaatctcctcttactttttgtacattgttaattactctggtttaatagaattatcttcctgagtaattaagatttacttcatgtgaataattcttggttattttctaattagcatgcgggatcattgttcactaaagtccattaatttattgtgatcgctttagaatttagctagcactaaagtagttattaattgaatagacgcagtatctgggtaattaatttccggtgattccttcgtatcccacagtaggtttgagatcggtgtagaggtggtgatagccctcaagtacactaaagtcctccatgtacgggtatgtagtagagtgacatttgggagtagcgagctggccagtgcctgaagtatcgcattaggattaaactgagctttctgtagacaccgtttctcactaggaaatcatctctaccctttgcctacattttctttgtgtccttggatgaacctgaagaggaactgaacacacacgttccctatggaaatagataccttggaatactgccagttgaagtgctgcatcggtatcttccgtgcacttgcagattttatctgtgacattaagaaataccaacactggcttaatgtgttcttttaaaagtaaatctcacttaaccctaggtactgtgatctaagttgcacaaaaccaaactattgatcattttactttgatctatccttttgagttctacaattacatcttaaattgataaatttatgagtttttttaatccatcatagaaattttacatggatgtaactaaatcattttaaaattttgaggagtatgtaaaattggttaatgatgtggtttcgtgaaaattggttaatgatgtggatttgtgtcgtgcaccaaaatccctatgattttgtgtaactgttgacagtcgttacagacaaattttgaccgtcaatataactaaaataatggagaattagctatgcttacaatgcatatttgttttcaaataatatagttccacttatacttggagaacaatatgttgcaggaatttatcaaataaaataaagagaaagtggagaaaacctcactcctaagcaagcttatggatgagagggctcagaagccaggtgtaaccgtcctggaaaccgccttaactacaaaaccgtcaataggacccacctgtcaaagactgtaccgaagctggaggcctgttgggctagcccaggtttcggccgaactggcggtgcccaatcagcctggccctccacgtgtacgatccggatgcactcttaatgacggttgtgagggtaaaatgcacaattcgcattggtacaaccgtcataccggccctataaaaggaggagctcattcactctctcaacacactcaagttagctcaaattcctcttcatactttagtattagtattttagtgctaagtggagtagaatagaatagtattcggagtcctcggagtcttcgaaagagtttcggtatggctctagcagctcttgtattcttttctgtaatactttcaattttaatgaaatattcttctttatatatcttcggtactttgtttagtctgagtactgttcttaccttatatctgtgttgtaccgattttgtgggtagccatccagagaggtgcaatggtgcgggtttaatgtctgatttatcagtttctatgtcatgtgcacgggtgtagagtagtatttagtaatgtaagcacggtacttagattattaaatatcattaattagggatatatgctgcgggatagtagaggtgggcctctgatggtgacagctcaatgcaggtattcctccacgttagtacatattcctaagagaaattcctggggagggtactactccgtatttagccccggttggacggtcatgataggttgtcgtaaggaactcggcaacccggggtggtctctcgaaacaccaggagggcactgttagggggtattggctacatagttgtatactagcagatgtaaactaagattgagtgtatagaagtataggaattgattgcttttctatttcttcttccacatagtgtaggattgtttaatgagagatatgagttctttgcttcgtgtcactctaccgttatgaatatatcaacccctgcttagactctgatcatacaagtagcatatatacattattagcatagttctctcttacaatgttcccttggcattaaataaatacgataccttggaatactcccaggtgaaatgctacaatggtatatccgtgcgcttgccgattccttctataaccatatatatactaggaccatttctggcgtcattgctgggaattcatatttctagtaatgtcgttaagaaataccaacaaggaccaaaactatataaagaagaatattttattactggataaagtcttacaagggccatacccgaattctccggagactcgaagaactaaggaagactattctaattctaatcctactagcactagagcaaagtgagtaaactaagagaactttttcttcttgaatccttcttggtgtgtgttaaaatgaaggaggggaggtcctattatagcttgagaatgacggttgggggcaccaaaaccggtacaaccgtcattgggaggtcggtagtaaccgtcattggcttgggccaaacaagaccctgctgaagcgaacaagataggttcaatctactcaaatcgtgtttgctcagtacaggtattcctccacgttagtacatattcctaagacaaatttctggggagggtactcctccgtatttagccccggttggacggtcatgataggttgtcgtaaggaactcagcaacccggggtggtctctcgaagtaccaggagggcactgttagggggtattggccacacgattgtatactagcagatgtaaactaggatttgagtgtatactagaagtataggaattgaatgctttctaattcttcttccacttagttagaattactttattatgaggatttgattagctttgcttcgtgtcattctacccctatatgaaaattaacccctgcttaggctttgacaattacaagtaacatatgtataaagtgtattagcatagtccactcttattatcttcccttgggattaaaaatacaataccgtggaatacttccgggtaaaatgctacaatggtatatccgtgcgcttgcggattacttctgtaaccataaatataccaggacaatttctggcgccattgctgagaatgaatatttctagtaatgtcgttaagaaataccaacagtaacttagatataattctataaaatttaccttttctcacagaaatcacatatgtgccgatttactcactactaccgaatcaatttttcagatgagaccgcttttaggttgtaggcagactataattatcaccgtatgcaaaaatcgctccccctcggatcgttcaaggacagcttacgaaaatcaattttcgcatccgggtgtcttaacaggtccaccctcatcaaaaaaatacccctctctcttggcactcttttttctcccctcccctctctctctctctcccccacttcaagtctcccctccactcaagtccggcatctctccctctcctctccccacactactacatataccctttttccaaatagtcaaaacacatttttgcaggcaagcaaagcgctcacccactcgtagatgtctatgaagattagtaattttcgaggcgcctagctgaaccgcatgcgaaaatgaattttgcaaaaaacaaaatttggcaaaaaaattccgaaaatatcaaaatctagaaaccctagccaacccaaccatactgctgtcgtcggtgtcactatcaacgtcaccacagactaaagcacgcttctctgcttccctcgctggagtggatggactggtctttgctgctcagcgacgtcctacttgccatcgtcattgtcgccatcgcaaccgaactcgttgcctctgctcccaccgtccccagcttgactggatgcatatgaagctcccaagggcgccggtggtggatctggccctcttgaggccgccgccgccggatggacgatggagaaggagaggcgagggaggccagcccctcccgagttcaacggcagtggatccgcacctcttgaggccgcatccgctagatcgatgatggaaatggagaagctagggaggcctgctgctcatctgaggctagtggaggcatatctgaccctcctatcaccagtaacggtagatccatcgaggccgatggtcacccctgtcaccaacattaacatgtgcctcactgctgaactcacctctacatcgcactgtcgtcgacgccgagcttctgccgagagagagatagaggaggctgaggtgagggagataaggtgaagaagaaaggaagtggaggagaggatagtagaggacgaggatgaggaaaggacttatgcattttaaggaggagctcgacctggagggctagtggtaggtgggcctcttaacaggcctgcccgcaaaaatatgtctatttcgcagttaggcatgttaagatgcccgcccgcgaaaattgatttctgcatgcggtccttgaagcgtcctcaggggagcgatctttgcatgtgagggcaattatggtctgcctacaacttagaggggttctcgttaggtaaaatcgattttgtagtagtgccacccccggcaacggcggtctcggatgagagcggcgatggtgggtccagcgggcaagggcggcagtctcaagcgagagctcgggtggtggcggtggcttgcaaccatgcgaatcccgtcgacggcggcaacagtagtgccggatccagcacctcctccccctcccgtgctgacctcgccgcctctccaatgacgatgacggtggcagcagcagcgacgatagtggatccaggcacgatgacgacgatagtcgatccaggcgtcgcatcggtgatacattctagggttttgattttttttttttttttttttttttttttttttgcagttggatggcttaagtgcccatatgtgaatgccctacccgtatacaaaattctgatactttcacagacacctgggtgtaggtgaaccacccacccgctgcaaaattgattttgactatacgaataaatcgttgacgtagtagtagtgagttaatactgttgtgccgcttattgagtaccggttgggaagactggtagagagttttccaaccggcattgcttacctcttttttgggtagtgctagcttggtcgaggaggttttgagaaatggtttcttcaccgtggtaaataacaaatgaaacagaaaatacaacaggacacagacatatcattgctactatctgacctcgttatgataaccgtagcccatctagcacgtcgcaacaagactccaacgtattatgaccatgcacatcttggtttgcaccatcctagctatagcacggctcatacaccaactgtctagaaacttccatgccttatgggcgcgcatcactgcataaatatcttgtctgctgtcatctatgaatatctactaatgtgtcatcaaaatatagtaatttttttctacgaatttgaatatagacatgaccaagtcgtagaaaaaataattagattgcataatcttttatgcagtatcatacaaacatgttaatttgattaatcgctaaatttgccgagtcacaccgtatgtctctaatatatggaatccttgtataacaaaaactaagccattgcataactatgagaaatgaattaaccaaattatacaataaattgaaacccatctaagctttggatgtacgcatcaaactaaaatactatatgtatattagtagcataattgatatgttatgacttccatttataaattaactttcgatctcttccgataatgtaagaagtgaaaatttctagaatttgatacactggaaaagagactaattcaacatacatctcaactagtcatagcaaaaccacaagtgccacagagaataaaggcattttataaaatacctatctgtttgtaaaggcgatttatataagccacatgtgattttataatacccctacaatgttaaagaggcattagaaaaaaaatgcctctacagtattagttaaacacctctaggttttttccttgtagtgattgggaaagataaaattatttaactgtgagagatgacatctatttatttgagtaagagcaaggatagtagtacactataagccaactatgaacagttggaaatattggttataattcgacatattttaatccataaaaacaagataataaatatgacatgtgaataacgaaatggtctagtgatagtgctaatcatgaacatgctaaaaacagtaatagtatcatctaagaacatgtttaacactaagaagaaaataatgatatacccagagaatgttctagaggatgatgagttattggtattgccaccgttgattttgaccttctcaatttagcctcgtccagtagcgttgtttccttctcatttagtagcatcggtgccggtgctagacattgtgatgtagaggaagaagaccttgacgaagagaatgcagtgccaagagcagtcgcgcgtagacgcgctcccgaaaaccttgatcgccctactcaggcgagcggagtcccggaggattgctcgtcccaagcactagtgcgcacaagtgctcgaaaccggggaagtagaggcttagcacaagtggggttcagtaacaagcaatctggcgatctaaccgatcacaggattaactcggcaaagtagcgatctaatctggcgacgctgtactttgatctaaacaaaacccaattgttcttggcggcggctaaaggtataagaagagggggagaacaaccacaggggtgctggggtcgtgctctaaccctagaacgcgcccctaatgggcccaacttgatacacagcccattgggcccaatgaggtgacgcagcaccgtggacagaaaaggactcagtagtaaaacgatgattatggccgctccaaatcagatatggacatgggttgttccatttgaaactagacttgataagctttccatgaagcaattgcacgcccaaattagagttcgcacgaagtcgtggcggccatcagaagttggcactgtgctgcagtccgagtccaccccacgcaaatcctctccccgttggatcctctccatcattcctgagtaaaacaagagtgcacacgtctccgtggtataaagaagaggatgagttgagcttgtggaggcggggatgtatcgatggtgttgatgtcctcatcactctctctctctctatcctcttttcttctacgccgccgcctatgcacggtggccgatccggccctcgcctcctccgccgccaccactctgaccccaagaggctcatcgcctcgctctccggctcgggcctcgaaccgacctcaccgcgcctcctcgacgccgtcctccgccgctgcggcgccgcctccgcgctcgcactccacttcttccactagtgctccctgtcgctgccgccgccagagccgctcccttcctccctcgcactcctcgccaagtcctttctcccgcaccttcgccgcaccatccccttccctcctcgcctcactcccgcccagctcctctccccgtccctcctctcccccgtcctccgccgcctcccgcccccgcgcctcctccccttcgcgacctctctcgctcttcctctccctcctcgagtccctcaccaagaccggccatgtcgctgccgccgagcaactcgtcgaggagctctagcccaggctcccgctctcgctccgccactacaccgcgctactctacgggtggtgccgcatgggcaagcttgatgaggccaagcacgtgctcgcccgcatgaaggcagcggaggttgcctcagacgtcgtcttcttcaacaccctcctcgctggcttcgttgccgacgggaggttcgaggacgcgttcgagctggcatggaagatggagcagcgtggctgcccgcccaccaccgccacctcgcctagccttcacgctgcctctggatctccgcgttgtgctcctcctcgctgtccatggccacctggagagagggggccggcgagcctcttccacaccaccaccgttgccaccaccgccacctcgccccgccttcgcattgccttcggatctccgtgcctagcccccgcgccgccaccaggagagagagtggggtgggcgcaggagaagaaggggagaagggtagaaggattggagaggggggatgacatatgggccccacatatcagtgggtcccacaatatattttttgtgtgaatgacaaatgggtcccacgtatatattttttaaattctaatgccacgtaagtgtcacgtgggacgaataccaagtcaacaccgccacgtcagcgccacatcaacaaaaccgctctccaaaaccactagatagaggagtcaaattgtactagttttagtagttcggggagtcgtcctatccggtttttcggttgaggggtatgaatcagattcgatgtatatttaagggagtcaaagtggactttttccaatttttttgacatatactcgtactacgcacatttcctgtgaggccttattcgagtgggtctcaatgttggcctacgtacgtacgggtgtgtgagcagggatagaggcccatcaaaataggcctaattaaactggatatataatatgattctggtaatcatgccactactagaaaactcattttcggcgtcgtaggggatcgattttcgcaggcgggcatgtaattcggagccaaaaccccgccggcaaaaaaagtacccagggtggagggggcggtccgcctgcgaagatcgatcttcgcaggcgccgcttatatggcccgcctgaaaagaagcccctatatagtcttcttcctccccgagccctgttcattctctctgaagtttctctctcctaaagtgacttaaatataggggggaggttttgaacttcaaatcttcgggggatttttctacggtacttcaaatcttcaaatctactcatttccacactaggtatgcaattttttaagcttttagaccttaatttgtgatggatttattcatgtaaaattgtgaaggaagagctccatgttttttaattttatttcttttgatatgttgatgttaaatgtatgtgtaatacttgatgcctcttgttgtagtggtttaatgtggtaacataaattctcaattttttttatttttgctatcacatccacctcctagttctagatctagatctagatctagatcttgtcatatatagagagaataaaatttttaatgtatatttattcggtgcaatcaaaaaatagttatagtattttgaaatatgccgatgatatgattttgttagattttcctaatgtactaatttggcatgtctgtgtaaaaaaaattgaaataaactttgattttttattaatttacacttaacctttagttaattagttttgaatagcgataagttttttcaataaaccctacaaatttggtattaattgtgcaaatattttacgtgtatttttttagagatatggaaagtcaggaatggatgtatcattggccgaggtttttgtctccatatagaaacgaagtgtctaaatttattggtattgccaatgcacacgctgagaagaacaatatgaggaagataatttatccatatgctgactgtaagaatgaaatagcctgggactttgacgatgcttttaaagtgaaggagtacttagtaactcgtggatttatgggcaagtacgaaatatagacacgtcatggcgaagaacaagtggacaggcctgaaaatgtagtttttttttttgactgaaagtactgccaggtctttgcccaacagtgtgattttcatttattgaaagaataattatagtaaaatttacacgaagaaacaaaagaaaatgaaaaaggtcctataaagtttgcaaccaattagaaacagattgcttcagtggatctttcattctgcaaagctgcagaagaatctcatttgtgaagagagatttccaagaatggaagaaaggctgaaaaatttctaaagatgagtccattatgctgtttccagatatgccatgcagccacgaagaaaatttccagaaaaccaggctggttggactgccatcttgcaaaagctattctttggtaaaattctagattaccattacatgaaattcccaaaaactgccaacaagctttgctaaatggacaattaaagaagagatgatccctggtttccctttggttgctgctgcacagtacacatgatagatcatcatcttgtttggcacagtgtcttctatccaacatatctcttgtattcaatctgtcccagaagaatagccaagcaaagacttttattttcattacacactcggtcttccaaatccagatgagaggtctgggtgcttgaatagaagcaaagttgaccttatagaatcttttgggggtaaaacagttgttattccagatgaagcaccataaatctccccttccttgttccagctgaaggtgtgtcagttcatcttgaagattgatgtattcacaataggcttgataagagagtggcagcatgaagaatcctccaaaggtctggcacacatagcttggactgaatcatctttgtacagagaggaggcaaaaagatgttgatattgctgacatttgaattgatcattccacagatctgtccagaaaagagctgtagtacctgtctttatgttgcatttggcaattcctctaaaaatctccaccagagcaataacatcttttaaccaaaaagatcctttgtttagaagatgagggactttagctgttaggtatgaattagtcacaagattgacctaggggatgtcag

SEQ ID NO: 50807 - DNA, 2633 bp, Oryza sativa
gagcacatgtagtaagtgggtattgatgataggacagagtttattaaagtcagtctacctccttgaggtaagaacattgaactaactgtcagccttctttcgactctatccaccagggggggcaaaatcaatcacccttggccttgtagttcctagaggaagccccagataggtgaaaggcaattttccaacagaacatcgcagaagtcctgcaattaaatcagtcttttcttcagatagattgagtgggtaaaggcttgattttgcataattaacctttaagccagtcgacagagcaaacatgttgagtagtgccttgaagcagaagatttccttttgtgaagtttttaacaaaatcaaagtgtcatcagcatattggatgattgggaacccacttccatcattcgcattgattggctttgaaattaatccaaggttgaaagccctgtttactattctttgtaggagttcagctcctagaacgtaaataagtggagacaaagggtctccctgtctaactcctctcttgcaggtaaaagaattacccggaaccccattcaacagaactgcagtgcttgctgaggaaaaaaccatttgcacccaattgagccatttttgtgggaatcccatgctttgcattacagataggatggctgtgtgttcaattgtatcaaacgctttttcaaagtctagcttgaggatgattatttctctttttgactgctgacattgatgaatatactcaaaagcccatgctaaacaatcctggatggttcttcctttgatgaatccatattgatttttactaaccactttgagaatcacaccttgcaatctatctgccatcaactttgtaagaaacttgagacttcatctcattagagaaattggtctgaaatcattaactgtttctggagagagttttttcggcataagagtgataaaagaactattcaagacctgtaaatctgtagactcacatgaaaatgagctacaagtctgtagaaatcttgtgcaatgatatgccagcacttcttcatgaaaaaaccattgaaaccatctggaccacgggccttgtcagcagggattatagagatgaggttgtcaatttcttgcgtgtaaaacatgtcgatcaggcactccaaatctgttctaggtacaaaaagctcagtcaaattgaaatccattgttggggagcaagagatacccatcctgttcttgaagctgtgatagaacaagtttgccttctggtcatgtaagtaaactatctggccactttgattcgaaacttgtgaaactatgttcattctgtatctttctgtggcaatagattgaaagaatttggtgtgctcttctcccagcagcatccatctgttagtgcaacgttttttccagtaaattttcttgtattctagaagtttgaggatctgatgtttaactacctccctgaaattccattcaaataaggagaggcttctatcttcttccaacagagcaagaaaatcaatcactttattgcaattgttcaagagaagcatgattcttgatagatttttactccagagtttgagttttttcctcataattttcaacttgaaggatatacatttagccggatcatcaaaaccaggatccagcagccaaacttgctgcaccacatcaaagaaaccctcagcttccacccaaaaattttcaaatctaaaaattggagatttggggatttttgtatcaatctttactacacaaggaacatgatcagagatattcctggtcaaagggatcactgttgtattagggaaggttaaagtccaggaagcagaggtgaatacccaatcaagcctttccagcaaaggattttgttgcatgttgctccaagtgaaccttctcccttttaatgggatttccaacagtcccagggagctaataatctcattgaaaatgaaaatatcattcatatcggctcccactttatttctgtcataagtagatctgtagaaattaaagtcccctagaaagagccagttctgttgagcatcgatctggatgttttttaaccagcccacaaagtctggtctttcaggcccattgcatgggccatacatgctagtcaaggaccaaacttgtgaagtaaatgtagaagttaattctactgtcacagagaaagggttaacttctttgagaatcccactaaaggtccttgaagcccagacaattaaaattccccctgaagcacccatggagggggaaaaagcaaaagagtcaaagcgcttgggagcaaattttttgatctcagaaaggtcaaagttctcttttttcgtttcttgaagacacaaaacccggcaatcactcttatcaattttctatcttaaagacaggagcttattctcagcattcattcctctaatgttccagcataaaacattccaggatttaaaattactagtcatttacacaccattgagaatggggcaaaaataccaaggctagcatagctaaccaggaccaatccaaaagacaaacataccagtgttgacatgctgacaggataaaattctggtaaagcaactttgacagcatacagattacagacccttgtaacatgataactgtaaaacataggcctgccaacagaa

SEQ ID NO: 50808 - DNA, 10065 bp, Oryza sativa
accaaacctgtagcgagaacggcacttgtagcagcatcaccaaagataatcgattcagtcttggatgccttctttagggaggagaaccaatttttatcaccggtcatatgccgcgaacaaccggaatccacgatccacacgttctccttctttgccaccaaagcctacacacaagcagaagtcgaaccctcagtactggggttagatgataataaaaatttagaaatccagtactgagacacacgaccagaagatccaataggcatatatccacgtgcaaaatcaattttagaattttcagaaaaattcctctgaggccggtctgatcgaggtacagtggctggtctgaccgagggtattcagccggtctgaccgcgggacccactgggtttgaccggtttcctcgagggaaaacccgatttttgccactttgattttgcaaaagcaatttctctctcctttttctgtttacgagctaatctgaaacaaaaaccaacaatatgtccatctttgccacaaaaagaacaagtatatttttcacgatgattagacacattgatagcattagaagatttagcaacacaagcaacaacaggagattttccatgcacaacattggattttgaagaagatgcactcatagtagacatgataccagcagatttaaacacagttttgttagtatcaggtttaaccaaaatctcaccacttctagcaccagcacctaacacaacaggaggatgtctagaattatgagcataaggattaaaacctaaaccacggttatgtgtgctaacctttgattgatccaaaatcatgttgaggttctttttaccatcagaaaatcttagcaaagaatttttcaagtaagaaatctctttttccaaattagcacaattttcacaatctaccatgacacctttgcttttacgacatttagggcaagaaagcacttcattgtttttcacaatatcttccatgtactcaacacgacctaaagcatcttttagtttcatcttattcaaattacatgttgagcaatccaaaacatcatgaggttgtttaactttttagccgaaatcatgttaaacatcaaactagcatgaaaagcaatttgatatttttgcaacaattttttggttaaaaacaactcatccaaagtgcgtgtatgcaaaacaaaactacaagcaagagaagatctatttttcaaatcatgtgcagcattaacatctctaatttttgaaatctcattcattaaaacctcacaattttcacaatcatcatcattaggaataagagattttaacctatcaatttcaaatttaagagatttaatgataaattcctgttttctatacatcttctcacacttcttattttttgcactcaaaatattaatagcttcctcaaaagcactcacctcattatcttcatactctatatcagatttaccacgcgccatgaagcaaacatcggagacgttatttcccttatcatcatctccactttcaccatctatatcacttagtggctcgaagacggcgcaaacttgttgaaaagccttcctaagattctccatcttcctcccttggtaagaacccttcgacttgttgttgttgggcttgttgttgttggtcttctcactatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaaccaaagccaaatcctcctcctcgatttgttcgagttgatcatcggatgtggcattaaaaacagcaagaaaagaggacttagatgaagaagcatcaacatccaaagaggaagaagaagaaaccaacgcactagacttagaattagcttttcgagaaagaacattcatctcatgtgttttcaattttgtataaagtgaatccaaagtcaaagtagacatgttaacagactcctgaatagatgtaactttcatctcccaaatagacatgtcgagaccattaaaaaagtgacgagaaatctcagattgtggataattagcatcataaaaagaatcaacagatctaagatcactcaaaattttattaaaccgagaaagatagtcatccaaagcttcttcaggtttcatctcaaatttaatatactcctttttgaaaagatctcgacgaagctctttaatgttatttgttccttgatgaaaattactcaaagcaacccaaatctcatgagcagtttgaagatgagcaatacgatcataatccgaacgagaaataccactcaaaagaatgttacgagctttgcaattttgttcaaaagcagttttttcagcagtagtattaatagcttcaggaatcacataagcattagaaacttttctccaaatatcataatcttcagccataatgtaagattgcatcctactacaccaatgagaaaaatctgttccatcgaaaacatgaggcttagttgaaaacctagcgggagtagccatggcaaaaactctatatcgataaaaatctaaagaagaaaacaaggctctgataccacttgtaggatcgaatcacaagaactaagccaaccagaggggggtgaatggttggtatacccaaaaaccgaaaacttttagcggaaataaaagttatcctcgaaatcgatggatcgcggtctgactgaagtagttgcaccggtctgaccacctgatgaacgtcggtctgaccgatgtagatcgattggtcgaacagcctgccgcgcctgtcgccgctgccggtctgaccaccgtgtacccgccggtctgaccatcggtagatcgccggttaaaccgccgaaatccggtaaacacaaatcgaagaactcttaaagtggatgacgactttattgattctctctgtgtttacaaagtgcaccaacaacactccttacaaaaatttctgactaaactcgaaaccctaactcaaaactcaactcaattgctctctaaagcgataccgggaagcctcacgctccccctctatttatacatgaggtaggcagcctaaagccacgaaccaaactcatactaggagtcctaaacaccttaggaaaccctctagtataagaaagaaactttacataaccaatcgtaccaaatttggactccttccaaattcgactccgcatcccatacgcacacaataactccatcgtatgccatatggaatctccatcaaccacgtgcatcaactctagccttagtatcccgtatgatctctgactgccacggacgtcgtcttatccccaagccgactcctggtccatcaccgcaaatactctcccgagacatcgagtcacctacacatggaacaaacaaagaaaccatattccgagaccaagctatctccaacttgactcattagcaacaaataatagtattacatacgtatagtatccatctaaaagtcataatcatgaaataaactcggatatccaaataaacaacccgaaaccgaaaccgacacagtgtcggtcggtcagaccgtgggctggccggtccgaccactcaatcaccgccggtccgaccggctaccagagcccagtctgaccggtcacatgaaataataaacctgcgatcacctgtgaaatccaatcatctccaaaaccacttcgtgaataaattccaaataacaaaaccaataatctccaatgcccaattgttcatcacagaatagtaataaaaaactcctttgattttacactattgaccgacgtacatgtcccttcttcttttatgtgttcatcatcgtcaaccattcgtgacatggccacatgtcagccagtaccctccatattttaatgtatgacgtcgttgacttttcgaccaacgtttgaccattcgttttatttaaaatttttgtgtaaatatgaaaatatttatgtcatgcttaaagaacatttgattatgaatcaaattacaataaaataaatgataattacataaattttttgaataagacgaataatcaaacattggacaaaaagtcaccggcgttatacattaaaatatggaggaagtacaaaacaaaacacctccgagggatttttagcacaaatgagcagttttaactggatcaaattgacatgtggttccaaaatgacatcatggtgaaagttcttcaaaaatggcatgtggttatttgaaacgatcgtcatctttgtgggtagaatgcatgcttggcttcgaggctaataagtagagacgattggttaaatatactactttttgtgtatatttgtctattcgccctccttttcttatcgaactctattagtctccatttggttgtttcattagaatgtaaaactgtttggattagagaaacttccttgccaatgcagactgaactaatagtggtgagatgccacactctcgcatctagagttttgaagaaaaaaaaatgtgatccatttggaaaaccggtaaccagataaaagtttcaatccaaattatttaataataaaaaacggttgcaagaggaagttcatatcttcagtggcggagctagaaaatttatatcttggatcaattatcattactgaatatttcagtgggatcatttatgcaaatttgaatggatttatatggaaaataaaacaaaagattctcaaaggtgattgtgaaaacgctatgggatcaaccggcccgacatcataatatggattcaccactgcatatattcttgtggaatatatacattattatatctaatcttactgtttcaccaaacatcgattgggctagcctcgaactaaaggtgacaagcgcacaactccattttttttcaatcatttttcctttttcgccactgactgtgtgtgccacctttttcttttgttttcttaattactccttttctccattataaatgtactactacctatgtagtgcgattttatatttaaatttgacttattgcagatggtacgccgacggatctcgaccaataatcggcaggatttccatcccacagctcgcatctgtataatctgcatatcttataggtgtagtatgtaggaatttaaaatgtgctgcatttaatttctacgtttttcactttcctgcattttgtacaaccagtgtgctctaaaaaaaaaactactgttcctgctttgcggaatcacataatgtaatgcaagatgggttcgtcgttcggcgaacatagtagcacacaggaaggtgtttcaaacaattgtatcacgaccaggatttctgtccaccgggttttcttttgtcttgctagtagacgattgtaaagagtttgagtgactcctagctttggtgtgtaaccctaaacataatacatatggctcaatgttgttgcatactctctccgtcccataaaaaactaacctagtattagatgtgacacattatagtactacaaatctggagataccactgtccagatttactgtactaaaatatgtcatatccagtcttagacattttttcgggatggagggagtatgttgccatgctacacgcacgaccaatataaatgtgtgtatttgactctcctggtcggttagtaactatgctactgtaacaatattttagtattcttatgcatgcacctgaatagtactagcaatcagattgattcatgtacatatgggccccatacaaaggacgtacacgtgatggagtatttccaccgcgcatcacacaatggcttctgcatgtctgcgcccgtgtggaggagggtgcatgcgtactgcggtgccttgcaggggagcgcacggcgacgggatcttcgtaggtatcgcgccgatcccgtcgcgatggcggatggtgtaccgatgtatagcattcctaattcaaaatagcgcaatgaccacgatgaataactcattatggatagtttgattcttggaaccaaacaatgcttccacacgccactagcccactagctctaggtgtctccctccttactcttaactattacttccctgcgcgtcgctccaaggcaaggggcgacacgggaggcgattcttcccccccccccccaccaccccaccacacctcctcctcccccgcctcaccaccgctagagcagccgccggaaaccgtgcggctgcaaggacggcggctgcggggcctcaccccttctccatggaggccacggaggtcggcacccacgaccagtctggggacgacggcggccgcgaggggggtgagctggagctggcgcgcctcgtcgaggtcgggacgcctgcggcgaggagggatgcagtttggcgaggaggggagaccgcgacggtcgtggtggctggctggtgccggcgtcaagctagagggctgccggcatacctccttggcgtggcagtggctaggcgccgtggccggcgatgggtgacgccagggtggtgtgggaagcagcggatccggagtcccctaggccggatccggccatcctcgcatagatctggcgtagcagcggtgcgacgcggcttgtggcggctcggcggcgtttgcgcggcagcaaggcgtgcggccggcctggaggtgagtggcggcggcgtgcgccgagccgggcggcggcggaggcggctcggaggttggaagcggcggtgacggcgacggctcgggggcgtggcctgccccggcggtgtggcccaccccatggtgctggcggtggtgctgcccgggggcggtgcgctgctgtgctgcctggccgctcggcggtcggtgcagccctttggcgcggctaggcctcggcagccgggaagccgtcacggtgaccttaaagcgggcgccggagccagggcggccgcgtttccggtgtcggcgcaggcccagatggtagtgcaaagggagctggcagcggtgggtcgtctttctcgttgccggtcggcaccctcacccttcctagagctcctccccttctttgcggggagtttctaggctggattgaggggccagcttgtcagcgggggaagctcaggctgccgaagcaatgccacctagtccagtgttctccttcggccagatctagcgaagaggccggcgggtggtggaacggaagggtcctgggccagctctcagcgatggtggtttgatgaagtcgaccgacggcggggcgtcggtgcggtgtggtggcagtcttgttgttggcaggattggatgctggctggcggatgggcgtcggtcgggtgtggcggaagccatgtgtcctcggtcggattgggcgacggaccacggcggtaggggttccgagcgagagcttagcccaatttctttgggacaaaagtgactacaccttcgggtgtggtaactctcctgagggcattgttgaggtacccctcctcccgcggcaaggagctctgggtgaaaacctagtccagttttttggacggatgatgacggcgtctttcggcgttacgaccctcgtgaaggcgtcgtttttgagtcttcgtgtcatggtggtgttgttggcccggtggcgatcggtctagcatagtgatggtcggttcgatgcttagcttctctctctgtagcgtgtgtttggtcggttggcacatggtttggagcgtgctctggtgcacatccttcctcgacagccagccgtcgatgtaaaactttccttgtaacatttttctccctatcttaattatattgaatgacctcctttggtcattccggcaaaaaaaaaaaaaactattacttccccatcctaaaatatagcaacctaatattggatttaatataacctattactataaatctaaatgggatatacttaggttcgtagtttgagattatatctaatccggtactaggttattattatattttagaatagatgaagtattagatagtctttgcctctccttaccgtcaatcctccctacttacccattggcattcagctgtcagcacagcttagcatccttgaagtgaaagtaggtggctccaaatcagccggacagcgacttcaactgataaggtacatttgtgaaaattacaccaagactaccaactgattgacctttagcctcacatactctacatgcagtaatcaagtattaactgtattatgtgtctaattatggatttatgttaatgtaaaaaactgcgtggtcaagttatgcctgattgacttaaaaaaaagtctgaattgataatagcacttatatttatgacaacgaatacatacgctgaagctagctcaaactgaattctacactagataaattattttcatgaaatgtgcattaagcttagcagatgaacaaaaaccacctctactgaaggttggatggatcatggctggagtgattaatcaagactgttgcaggagtcaaacggaggatgatatcagactgattacaagtttctttgtgtggtccagttcctggattattagttacccttcaagcaaatggcattcaaatcaaacgggaaccattttcagatagctcaatctttttgcatcgtatattgacgtcgcattcacctttttattccatgatttgacagaatgagtgtttctgtttctattgttacaagattcaggcattccgcacacatcgtggataattatttatcaacacactataagtttacaactcgatgacaattggtgagcttgtcagatcaacaatcctagccatttcgccgcctccttttctcccaagacgacgagcaattggggtaaccaagtttatcacatctttctcaaggaagagaggagcagggccactctcatctgacgatgaactcctcccaacatatggaaatggagacgaaatctgtcctgacacaccgtctagtattcttccaccctcatcatcactggacaaacccgacgaacatcgaggcgatgttgccgatccgtccgattcccttgtcgtctcatgaattccactccatgacatgtaaccaagctcatcagtggaacattcagcatcactaactgcagaggctgcagttctggtttcatgttccaatggttgtgcttcaaacaatgggttgtcttcttgtcccatccactcatcatgttccgatgattcgtccaatcctcttgcttctgctgctccaaacacactccaatcgatcggagcgaaatcgtcgtaatccgattcattgcctgcatttctaatttcttcttcaggcaattgaaccaaaccatgctctgaaactgaaagttcgtctcttgcaggcgcatgcgcatcatcaggttcttgatgattcttcttcggaggcggctcgtcgacgttgttatcctcctcagaggaaacaccatcggtgcagtactggagatcctccagcgagcagacggccgtcttcatgtggcccggcagcggcgggcagccggcggcgaacttggtgttcttggtggagaagaagttcaccgtcaggttcagactgaacaaacacaatattcagcaacaacaacaacaaaaaaacattcagctacagtttggttgcattcagttcagagacagccatgatcgcgaagaacaaagtaaggaaaacttacttctcccaggaggggaggttgagcatggtgtaggcgagcttgaccttgctgccgacgccgccgagcgacttgaagctcgcggcggccttgcgcacggccagcgattccgtcgggtgctgccacgcccactcgaactgaaatcacaccataagattttaatttgagcaagaaaacattggcaaagacaagaacaagaacaagaacagctacacctatctccatgattgatctcccccaaaagacaaatgattggattggatcggattttggctggattacctggagggcggcgacgttggtggggaagccgtagatgcagaggaccatctcccatgggcggccgcgcttggtctgccacgcgccgcaccggatctcgccgttgtgctgccggatccgccgccgcgggttcaccgtgaacctgccatgccagccatccaatcccacgtcaatcgcaagaagaagaagaaggaagaaaaccgcggcggcg

SEQ ID NO: 50809 - DNA, 1362 bp, Oryza sativa
tgcgtggcctcctctttccattggccgccgccgccgccgccattccgccggtgtgatgtgatgtggtgtgatttgctccgctctcgttgattttgaccgttggaatctgtctgggggaaaggggaaagagccgttggcggatgcggggggcaggacacttgtccatatatgggccgggccgtgttaagttgggcttacgaggtttcggccctgatcgaaatgttttcttgtgggacaaaaagttttattcgtattgcaccctcctttttttctgataaaaaacaccgttaacttccaaacacatgtttaactatttgtctaatttagaaagtttatgcaaatgtataagtgtcgacgagtgatactcgcggaccggatgagttgagtattagagtacgttggaacgagagtttacgtagtatgacatcaagtagacaaaagataaagattatactggctcagaccccttgtcaggtaatagccttaatccagtttatatgggattgatgatgatgagaacagattacaaaggaagtagacgaaacagatggtaccgatgggatcgtagtcgatgagcttgacgagatctcctggcgacttggctccgcgtactccggcatcgtaaactatgatgggtgtgttggcggtgaaattcgatgccttacactcctccctgggggtctctttaataccgtggatcatgttgaccccctaagaaagatctaagaatatttgatctgataatctgatacagtataacagaaatcatatcccctccaagtaagactttggaaatcgcttatcgcttaattcgtagagatattttccataacttaggacggattcctaacggcgtacatatataaagacgatccgtgtacgtgaaagtataccttatcggtatattccataagtcgtaggatagaaggtataccttatccataaccctgacaataaggtataagtagaaaaactcacaacaaaattaataattaattataattacatatttttttaataaaataaatagtcaaatatgtgataacaaagtaaatggtgtcatctattaaaaaagaagatataattactttagcagctgtgatatcgggcgtacctcaacatactcatccaagccccttctcacaaaaaaaaagaaaaaaaaagaaaaatactactcctcgaaacttgtaaaacaaaacaacttattcgtacctgattaattaaatattagttcaagaagatttgaaaaatatattaatataatattttaaaacaactttcttatataattttttttaaaaaaacatatcgtttagcaattcagaaaagctagcgcgtgaaaaatgagagtagaagttgaaa

SEQ ID NO: 50810 - DNA, 1441 bp, Oryza sativa
  unsure (1)..(1441): unsure at all n locations
cctcttaatagtacggtttttcctaaaaactcgatttcaaaaaataaactatcctatgcacttctcgagttccggtccgctttgattttgtacttttggggggtctccaagcatccatcttccacaccttggactaatgcacctgaaagtcattcaatgaactcattagtcccttaaccacatttgtcattaatcaccaaaacccactagggggattaatgcactttcacacgtaaactgcggcgttactacacaatgaccgtcacattactgcaccgtatctgtgagacgagagctgagaaagggtgggtgatggaagaagccacaggtgggtttgacccgagatttaaccgacgtggaagcgctttgactaatgtgggagataggtttggccgctattcgtgtagaatagtcttaccatatatatatatatgtatatatatatatgtatgtatgtatatatatgtatatatgtatatatgtatgtatgtatgtatgtatatatatatatatatatgtatatacgtatatatatatatatatgtatatatatatatatgtatatatatatgtatatatatatatatatatgtatgtatatgtatgtagtaaatttgttaggggctccatggtgcccatactccaatgccatccaccgttcgcttgctttaagatccgtgcatactcaaaacacggtattataatctattagcgggtttaacccaataagactcatgattcacatgcatatactcatgattttgtttgcaatattaattcatgcccgctaattgctattattatccttccattttctatgcagatacatatgcccagtgatagtattccatttttcatgttcacggttttcttggccacactggtacaccattgtccgcgagctctttcgtcgttgctgctggtccttccgcgcgagctctcnngccgacgacattctcgtcaccacgccgtaacgaagccggacggccacaagcttcttcgtcgctgccgctggttgtccatgagtttcgttacacggacgcgttcgtccatgaggttcttgttggcagacagacctccgcaaccttcgttacagcgcaggacgtccgcgtgcggcgtgcctcctcgccatcgctgcccgtcatccgtgaggtttggcactaaccgtaggtatgtgaaaagtctagatcccagaatttatcgttcgtatagtttaagttgacatgcagtactcccgtgcgtatgtatatgattttcccttttttttccacagtattttactaaccaaacccatgttaatcgccagctggtacccaagagcaaaattgtttaattttgacaagtgaacaattgcaaaaatgttcctccgatgtatattctaaataaattcaattcaagtgtgtattaatttatacccgggtataaattaatacacacttga

SEQ ID NO: 50811 - DNA, 20671 bp, Oryza sativa
  unsure (1)..(20671): unsure at all n locations
tataataattgttagtgggtaccactatatagaaagtatagattacatcatgtagtgtaagaatgtgcagtggggtgtttttagtaagtgtaacaacatgtaaaacacttcggtgtaacaattatttagttcatgcaaaccagccctaaaatctatcgtgaaacaaaatcaacatgacccaatcatcttattaactagttggcaccccgcgtcttgccacgggttatgtagttttatcgtcaaacaaaatcgtagttttaaatggttagatgcaactctatctctacaaaatatatgataatgtggctttatatataccttatgttactacaatacaattcatattttatttttccaagcgtcattctgtattcgttgtatattgttataagagtaaaatgcactagcggtccttaaacttgttatgaggtttcatttaggtccacgaacttgcaaagcgcacatcgaggtctctaaacttggtttattgtatcattccggtccaaagtgtcgtttgaccgtggtcttgtgtacgtggcatgccacgtggcatttttttcctttccccttttctttttcctcctattcttttatcttcttcctccactagagtcacctcgagctcccccgcgtcgaagaggccgaagaagacataaatgaaagaggaagaagagagaaaaaaagaaataataataataataataataataataataataataataataataataataataataataataataataataataataataataataataataataataataataataataataatgtgccatgtcattgtctacatgtcatgccacgtaggcaagaccatgggcaaatgagactttggaccggaatgatacaataaatcaagtttagggacctcgatacacaatttataagttcgtggacctagatgaaacctgcttacaaattcaaggaccgcctatgcaatttactcttgttataatatatgaatattattttcatgcgcaatatgggtatcgttgtggttagacaatttgcatctctctgcttcattcaagctttttctgaaaattgatttaggtaacaatacgtaataattatatgctatctaatcatgcataataaaacaaaacacacatcttaaacaataatttgagttgtacttggaaaacatggtactagatcataccccgccgcgttgatgcggagcatctatgtgtcaaataactatgaagcatatagagatgtgcatattgcatacaaagaacatgacagtgaaacaaacaccttaatgtggttctgcggctccatcgttgcccatttcaaaggttttttgctcaagatcaaaaagatggaaactcaaaagtgaatcgtgattctagtgctacctgtctacttgaaatatatgatgtgtgtaaataagcatttcatcaaacaggggaaaaccttgctcggagaaatttacctcagaattgattcactcggttcagctgtttggggagtaaacagcctgagcgcttatcagtcttgatcatactcaagcgaggaagcaagaacacaaatgctcatggtatccatctccatccaagcaaccgtagtcgaccaatatatagccggctgaattaaagatcttgattttcttcttggaagactgggaggggggggagggggaacagtttggggcaaaggaggcgaaccggatgattggcttccatgcagctgcaggagtccatgcggtggtcgacagttaaaagctgggaggtggtttgaaagctgcgggagttttgatagccatgaagtctgctcttcatgggcgtcgacggttccgttcctccttagtcctaacacgccaaggaggcaaacaggctgcaaagcagctggtggtaggcgcgctcggcttgacgcgggagggggagagatgggcgttgcaggctccggtgcagcgctggggacaggggaggcgatgcagctgagggggggggcgacctcgcgcgttgcgcagcgtgggagagggaaagatgcagcgccgtgggaggaggtgatgcaaatgctgcggtgtgcggattaacagtgaagaactcattgctgtgttgggcttgggctatctgttctttttggcccagtaagcaaatcgactggaaatatcgttggacgtttgattttgatccaatggttggaagaaaaaaaggtgacgtggaagcaccaaaactcagagaattcctattagtggggatgatttgtataggtatatatgataacaatgctatctgtgactatgaggtggagcaaagggaggtgattggataactaataaatgattgaattgaatgaataagtagcttcttgatccaatggttgttaactttgtactaatgtgatctgatgacttaaaattgttgatgatgtggcttcttgcatttcttactttataggagtaaatacgccttagtggataccaactatataggaagatatgatgtgatttatattccagagttgcgtattcacacataggttgtgttattttatgatgggatgttcgaagaaatgcgcatgctttcttactctaaacggtacggctggttttttgcaaaaaaaagtctatatatgaatttataagaaaattattttaaatcaatttttaactttataatatttaattaattccttttgtatcctcaaacgatgcaactattcaaacattttttttaaaaaaactcatatggccacgtcaacatccagccagttaaccaagaccattagaatcaagtcatcaaccggcaacggcttgttcggttggcggcatgttgccactccgagtttggctcaactcatgcaaaatgcacctctcattcattggcatatcacctatatttttctttaagcgaacacataagacagtgctagcttgtatattaaaatagtagaaaaaaattacaagattataactattggaagctataataagaaaaaacacatgattataactaactttctccatttcatattataagactttctagcattgcccatatttatatagatgttaatgaatctatgctagaaaatcttataatatgaaacggagggagtattagaagctataataaggaaaaaaacacataagcacgtcccagtgggaaataaagcaaatggttacggcaaatggtgatgtcaacggtgatgagtacatagatggagttgggacaacaagatgtcaacggtgttcacaaacgatgacccaattgcgacagcaatattgaacaatcgccaaccgtcctacagacctgtcacacgtgggtacatggaggaacagaatgaacaaatccatatgcttgcttctgaaacgaaacacagatattattaccacataagctgtacttaccattctacggcagataagtagagatcgaaaactgtaatatataatatagaacctttcagtcagacaaatttcggtcggacatttttcacagcagttgaaaacctgcacacaaaaatgatttcggaaacaagttgagagtgcattgaaccatgctcaaatacataattaatccctatatcacgagagacaaacatccttacaacagattgatctcagaggcgggcttgaaaattgcccaattacagtgctcctttgactgaatatactaggctccaggtcgccatttcattgtcagttaatcatctctaggtctcttcaggttcactgctctatacataaccttggctctgttgccgtgcaagtaaatttccatgcaaatccctggactacacctcctagagaagctaagcagctcctggcacacctcctcgctgacagttactgaaggaccaaacattactgtaatcatcttgagcactggcgcccatgtcaacagtcgcttcacaaaacatatttcatactctgctccactcaaattgttgatttcaactttctggagaaaattcaagcagatatccatactctcccagtccgacggcttgtaacagatgcagccagatgagcaagaaacttctccctgaaaacattggtttcataatattgagtggcatatgatttaaatctatcccctccagagaagtgactgtgacatgtagagaaagggagaaatacaaaaaagaagtaaaaaacattacacagatacaccgaccacaattacaatatttactgttaagatttcaatttatcgtatggcgtggtttgcttctaagtcaccaacctgaatatatggctaacaaatccatatcaatcaccagtaagtaagtaacatcggcagctatatttcaatcatatatcacagaaatccaaagcagcactactctctttggtgggtacaaggatgagagagagatgcactcatcaccattgcaatttttcacatcccatgtgccatatgtaacaatcggatgcaaggagttgatctgacaggaaaatcaaaggcactatagtctgaaactctgaatatggaaagaccattagttgtaatagatacaccatggaggggcatatcagtatcgagaccgacacatcaagtaccactgtgtacagttagaggaacaagctgagtgcgtaaaagaagaaatacttctatcacttttgacagcaaccaaagtatttaatcacattgaataagtatgcattaccttaaggtgatgatccaagtccaggtgcaactctcttacaccagtagacgtcctaagcaattggaatacacaaggtccaaaggcatggcctgctgttattgacctcagagataagatctcaatggcagggagagtattcatgtcctccatcaagaactcacagtcaaccatgctctgcaaattaacagagattcatacaatgtcttacataacaatgtgtaaaacaggaccaaatggaaactgaagatcttgatcaatggtcagaagttgtagattcattaatatagttattgtagtaagtacaccattccatcccttaattaatatgtgtattttgacattgcacaggactaaggaggtgaggagattgagaaatgtacgaggtatatacagcttcagataaagaacatccagaaagttccatatgtatggcttgagaaatccaatgggaacacttttaaagggaaattgatccaggaatgccctcaatttctccattatctaaccaatcatgtgcaaatacacataccagagtgcatacatgtcctcccaacttatatattcacgtttgattaggacacttatttagatgctaatgtgaaacatatactaaaacacggactcggacaaatgatatctggaccatgggttatatcaacaatttcaaaatcctcttttaaaatgttgtgtgcctatgccggcatactagcagtggctgctggggaactacaaagagagtattacgacatttcgttcaacgtttcgataatgtagttcagcaacaagagagaaggtgtactcacagatggataaatgagatagaggtcgacatttgagactgctttgaaatgctggaggagtgacatagagcccgggtatcaagaatcgacaagattcggcggtccatacaccgaaaggttcaaggtgtcgagtctcttgaggtgttgtatcacattgaagtggaccgagttccaatcgcacagaccaatccacccaagtttctccaacgccgcagcagagatgtcagcggctcttaccgccctcttgtctaagcaatggaccagatgcagtgttctaagcatgggagcagaaatcgtgagctgctgcagttcttccagctcaaagaggccaacggtgaggagagtcttggagcggatggctgatttgacaagccttgagaattgcagagagtgagcgcttgcagcgacgggcaccgctcggaggagacgatgtcgccgagatgatcacactggctgtcgtcaagccggaagcgggtcaagcgcagcacggacagcttcgcgaagacaccgaagggaggcagccggatggtaaggtaggcgaagcggatgctgatctccgtggccttccggaagcaggggatgtgaaacgcggccccaatcccggccgccgccgccgccaccggatttctcttcttcctcatcacgatgtcgaggaggagcttgcctgctaagctgcgcgcggccaagtggaggacggcggcgacctcgtgcggggcggggtcgtggctgcagagctcgagacggtggaggagcggggcgtcgtgggagaggagcgcggcggtgacgcgggcgaggtcggtgacggcggggaaccgtagctccgggagggtggtccagaggctgcgccagcggcgggcgaggacgctggtgcgcgccgcggcggcggcggagcggaggcggaggaggatgaggtggaggacgtcgtcggggagcgcgctcaggaggtcgccggccccgccgccgccgtccgccattgcaatttcgtcgggtagggttttaggaatgcggttttccaatttggtgtgactccctaattgtcttttttccccatcctctctctgtttaattcggaaaaaaaaatgttcattggatcatgccattataaatttacatgtttagaaaaatgtcattattatttataaaattggaagcatgttgtcgacggtggatacccgtagaccggatatagagggtattaggatccgttggtacgaggatctacgtaatacgacattaagcaagcaaaagacaagcattgtactagttcaggctccttggtatgtaatagctctaatccagttggtataggattatatgatgaaaaccacagattacaaagtgtatagcaaaactcgatgataccgacgagaccgtagtcgagttggtccgactagatctcccggcgacttgactcctgcaggctccgactccgtaggctatggtggatgtgttagcggtgatattcgatgtcttaggtcctgcccaggggtcccttatataccgcgggtcagttaatctccgagtcaacgtacatccaaggatagagggtataccttatccgtaaccctgacacatgtcattacaatttagaggctgctaaggatcggacatccgatctgatgcaaatcatcggacggtgttgcaccgtactattgagaaatgtttcacatgtttcatccctcagtaaaaattgtttcaatgaaaatgttccagatgtttcgctgctagagaaaaatgtttcagcacttgagcaaaattgtttcaaccaaatgaaatattcaacaatacggattgccacaccatgaaatcaatttaagcaacatcaaattaaaatggaatgaaacaccttaatataataaagtgcaacaaaaaataaaaaaaaagctcaaacattactaaaaaaatttcacgcatttttagatgtttcatcaaatgagaagaaaaatgtttcatcgctttgacgaaagtgtttcaaccaaatgcaatcgaaacatatcgattgcaacatgaagaatcaacatatgtaacattgaattcgaatcaaaataaaatgaaacaccttaatacaacaaagtgcaacataagctaaacccacatctgtcttcttcttcaactccaaccacccctagacgagcaacggcacgagatggacaaacttggctaagaccagttgcattcgcatcaggtcctcgacggtggccatgtctagcgccgtcgccattgccatcgctatcgcgtcgcctccgcatgcttggaacggcgaccacctcggcgaggtggtcaaggctcgccagggcaggaacctcttcttcagcatctatgtgactatgtcgagggccatgtcctcgaggaaccaagatagagctcgtcgcgtattcgggatggagcacttcgcgccgtcgaggatgagatggagctcgtcgccgccgtcaaggacgagctggaactcgtcgcgccgtcgagatggagctcgtcgctgttgacgacgagatggagctcatcgcgccatctccgctgtagtgaaagagaggggagagagagagcatatagagatagaggggagagatgagggaatgtctgtgagaggataagattgacgtgggtgacgaagaatgggttgagtcaatggcgggtcccaccaaacgtttttcgtccaatattttattcgctcccggacactcgatacgaagcgttttccttacaatttaacatgtcttcgagatgtaccactgcttaccctttcactgatatttctaaatttttctgaccaaattgccctcatcttcttcctttattcccttctttgttcccttttctctcttcatctttcggccagggacgatgagcagcaccggtgggaggcgcgcagctgcacgtacagcttcggtgcacgcagcggcaggggacgacgagcgattgcacggcttcggctgctagggaggaccagtggctccggcaggagccgggtagctgcacggcttcggcgcacgcggcggccggggaagacgagcagctacacggcttcggcagccagggacgacgagccatggatcaaccttctttcttccaacttttcagtttctccaagaaattagttcacttagttatctaaaaaaaactaaagagctgaattaggcagattcaaaaatgcgcactaccaaacatgattgcaaaccactactagtaattcgtgttctttcacagagcctataatcatgtgccaccttttaagcgtgtagggcaggctgcacgaaaaaaggaacgagaagagaactacacgcaaggaccatagtaggcgcacgcggcggccggggacgacgagcggctctggcaggaggcgcgtagctgcatagattccgcgcacgcggtggccggggatgacgagcagcttcggcgcacgcacagctgcttgcttcggttgcatcgtgcgcggcggcgggatggaggaagagagaaaagagagaaacgggaaggaggaagaagataaggccctttgattccaaagaaattcataggaattttaaaggattttatttctataggaattttttttatatagccctttgaatcaaaggaatgaatcctatggaatcttatgaaattcctatgaaatgcgttttcccatgtaaattttagaggaaatttaacatgaggttctacctcatgataagaattctttgagtctttccctctcctcaaattcttgtgtttttcctgcggctcaatcaaacggtcattcccatgtttttcctgtgttttgcaatcctctgtttttacaatcctatattttttctattcctccgttttttcattcctgtgattcaaaggggccttaaaggataatttggtcagaaaaatttagaaagtatggtgaatgggtaagcaatggcacatctcgaagagatgttaaattgtaatggtatgattccaattttgtaaatagtaatagtatttttccaaacatacaaatttataatggcatgaatccaattaaaaaaaatattactaaatagtgtactggtaccgtgaggcagttctaaccggagtccggagatcactctattccgtgtataagatttgtgtataagatttccttggtatatgatacatgtctttttcttaacggaaaatctaagttgagagcgattttgattttgtcttatggcgcgacacctgcggaagccgtccgatgaaagcctcacgtgcgcgtatgcatgtttacgatgaaaatttatatccacgcttttgatcgagtcaaatgtgagtcttcaaacgtgctatgtagtactagtctactgatttttctattaggaggtaagatcaaatagctcttatcatattttgcttgcatatgtatgttttctttatgtataaatatgtctgtgatttaaaaatgagctttttgtaagaggagctaggcaagttggctcctggttctcatgcattccactcatttgttatgagtttagatatacttcctccgtttcacaatgtaagtcattctaacattttccatattcatattgatgttaatgaatgtagatagtcatcaatatgaatatgaaaaatactaaaatgacttacattatgaaacggagggagtacttgttattgttgtaatgcttctgaattagtgaaattaaaagctacttgttgtattttagtcgctattttgtttggcacacacctcatttctaaacttacatataacattactttttttcctcatgcatgattctattcaaaactatttttttttcgaaaacgcaaagagacatgtgcttcatttcattaagtggaagatgacatttcgaagattgcttctaggggagttttgtcatcagagggctgcatatgtagtcgctttccctggatgtttagctactcctagggaagttttgtaacgcgttgctatagtgatttttttttctccagttttccgaagagacgatgtcaccaagatcacattggctgtcgtcaagcacagcacagatagcttcgcgaagacaccgaagggaggcagccagatagtaaggcaggcgaagcggattgtgatcgccgtggcctgtgaaaataatttggagatacaaaatcgcatcacagtaaaaacaaatactaataattaaacagaaacattccactacacatatatctgaaattctgacgtgacacagctgatcgacgtgagctgtcactacccaaccccaaaaatcaaatttggaactactaatataaggattattgtgtctaatctatttcttgaatgatcgatcgctcaggtcgatttctggaggtggcgttgaagctgataaatccaatggtttcaccaacttaagttatctatatatttacaaacataatagtagtgacccaaagtaatgtacttattaaatatctattttctaattaaaactatttattattgcatattgttctcttaaaatatatgtgttgttaaatagatcgttaaaatatatatatatatatatatatatatatgattttccctataaatgtgttttatttcttttacttactaaatatatttagtttgggtcttgaattataaattttgtggtaaataatctaatgatgtgttatgtattttctactccctccgtttcaggttataagacgttttgactttggtcaaagtcaaactgctttaattttgataaactttatggaaaaagtagtaacattttcaacccgagacaaaatatattcaattattgatttgatgaaactaatttagtattataaatattactccctccataccaaaatataagcattttttcaataatggcaagtcaaacatttttaactttgactattaatagcaaaaaataaaaaaaatatcaatcatataaaattgatgttattagatttttcactaaacaaactatcataatatgcaacattttttatttaaaatattttacttttatagatattgttggtcaaagtagtatctcggggaccatatcggagtaaaaaaatatgtatattttgggatagagagagtactatatttatctttaaactgagtcatacctgaaatagtttgactttgacgaaagtgaaaacgtcttaaaatttgaaacttgaaacggagggagtatataatatagtatgataggaggagggaaggatatatggcgtacatacatgcacgggtgcacgtacatgatacgggttaaaagtggatccaccgtatttaaagttttcctttttaggaattattagatattccaaaaatttattaaaacgccacgtgataacttaggagcgtttgtaaagatacacgtggtggcttgagagcgtttataggacgtttaatggacttttagtatatcattgatagatagatagataggtaaatttacgatagcatgatccaattaaccctttaaaatatcagagaaatatattttgaagtttgtaataattaaaattcaactagaaagttagcccacgcacatgcgcgagcaccttcttatataatgcgagtgaaattttattataaatatttttgtgcgggtggttttttattaaaatatcttgtattatgttctaaactaaaattaaacttattttttgtgctttgaacgccggttattttatagttatccttgcaacaaataaattctaaaataaaattacttgagatcatagttgaattgatgataaaatattttgtcgaaacaatagatgtggttcctatgagaaaatttagggtatcttaactcgccagaagaatatcttacaaccccaaaagcaatccaataatatcatttttattttattttaaaattttatgtatattttcattctaacagtgcttgtaaaatgtttgaatttttttaataagtatgggttttaaatccaacaacatttgttcaattttcaatttatttcatgtccatttttattttttttattttggatattttcattctatgaatcatccttgaaatgatttgatatttacaatttgggacaaaaatataagtgcatataacctggcagggggtaaaggcatacgttctaaattttctcttgaaatcttgaagtaatggtcatagtgtatttagcaaatcatcactaaagtggactgtcacataacaaataaatgtttctagattgttctatgtcaagactttacaatgtactatgtactgtagcaagtttaacaaaaaaaaaataaaaaaaatggacatggtctttaattcctatatggaacttacttgttttattgctaaggccactgcaaggttgttccactgttaagattcctaggtgcaacccacatgcttatcggtatgatgttcaaccaaccaaacctttatttttaacatgttgtctatatattgctagatgaatacatgctatgattagtgacttcatagatcatatgtgtaattcagacgctatgatcatctttcttaaaaatatttatttatctcctaaaaagatcattttaaaagtatcaaggtcaatttgtataggtatgtagccctcatatgcatgttaagaaattaattaagttggtagaaagtcgttagatgcttaacgggatataagtaatagatggaggtccatttgtgtttttttcccatatagataatttcaattttaattgttaaggagataaaaaacagagataaaagaatagggcacgctatacacgagcagggagggagggaggtttggaatgtttttctaaatgattaatctaaaaacctaaaataatgcgtccgatgtttatgtcgaaactgataatcggatgtttttttgttttattgtatcaggattttctctaatttaagagaacgatgtaacatcttaagagtatttataagatgtgtaatagactttttaataccatatgccgcaaagacggagggaggaaaggaggtttagggtgttctttaaaaaaggatctaatgacctaaaataatgtgtccatcgatttatgtcaaatccgatggttggattttttttttccaaaatttctaagatttttctctaatttaagaacatcatatagcagcttataagatgtttaatggattttaacatcacacggcggtggggaaggaggttgagaggtttgggttttttcttattgaaaaactaacaaatcaataacctaatcctttgttttttttaagattttctctttaatttaatagcaccacgttacagcttagaaacattcatagaatgtttagagtgacagagcgagagttgctagacctaataggtggaggtattttttaatgatggttttttaatgtaaaaataattttgattttaattcctcatgaatatagctcgttgatacgtacgtgatggggaggtttcggatgtgtgcttttttttaaaaaaaaatctaaccttctaaaataaaataatggatccaccgatttaaataaaattcgatggtcggattagagtgccacttagaaacctaggagcgtttgtatggtgccacttagcggcttagtagtatgtgtaggatgtttaatgaacttttaatatataatagtcttttttaaaaaaaatcaaggagggagagaggtttgggatttttctattaaaaaatctaatccattaatttaagtacaaaccaatgatcaatttctttatattttttaagatttttagtactttcactaatttaatagcatcatgtagtgatttagaagccttcgtagaatctttaaagcgacggagggagaactgctagacctaggagggagaactgctagatctaatagtatgtcttttgtgattttttttcctgtaaaagtaattttaattttagtttctcatcaaatagaaaatagcaaagtaacaacataaaggaagtacgtacagacacagtacatacgtacgctcgtatgtttgttccgaaaaagctaatgggcgaccagtcacgcgcgccctcccccgcgcgactggacacgtgtcgcgcgcggagggggcagcggacggcacccacgcgggatttttttttttccgtttctcttcccttttttcgttctcttttggtttttttcggttttgttcggtttcttttctttttttttccggttatctttctgtttggtttttttttctttttttttctcttctttttttcggttcttttaaagatgtacgcatgcaaagtttatattcgtacgtatactaagttttgtattttcatttttatttgtgttttttctctcggtttttaatatgtacatatacaaagtttgtataagcgtatgcaaactttgtatacacgtatacaaactttgcatacatgtatacaaagtttatatatgtgtacgtacgggatgcaaggtttgtatacgcgtatacaaagtttgtatttgtacctacgtataaaaatataaaaaaatacatgtatataaattttgtaaatgtgtatataaactttatatacgcgtatacaaaattggtatacgtaggtataaaaacctaaaataatacacatatacaaactttatatgtgtgtatacaaactttatatacatgtatacaaaattggtatacgtacatataaaaacctaaaaatacatgtatataaaatttatattttgtacgtatataaagtttgcatacataagtattaaaaacagaaaaagatatggaaagaaaaaaacagaacggaaggtacggaagaaaaacacagaaaaaaccataaaaaaaagaaactgaaaaagacaaaaaagaaacggaaaacgcggacgcttcaagacaaaccgaaaaaaaaggaaaacgcgggcgctccaagcgacacgctgtcccgccgcactagtagtagagagaagagactagaggggtcagaactgatcgcgcggggcgcatggagcgcgactgatcgcccattagggctcccccgtttgttccgcctgttggttccttttttttttttatttacaaaatagatctaaccatccagaataataggtccaccaatttaagtaaaaatagatggtcagatttctctcatttattaaggtgccacttggtgacttgagagtgtttatagggtgccacttggtggtttaggagcgtttataggaagtttaatgaacttttagtatataactagaaaggaagcccgcgcatatgcgcggacaccttatttattgttgatagaaataatgttaatagaattaagtcgtatatcactatatgcatataagaaattatagatttcgcattataactaaaatattatatgtcgtgaaatagaccgtagactttaataaacgataagaatgtttcttatattcaaataaaaatcactttttttagattacacgtaaaattacctattgtcaaaattactaattatcattgttgctagatgtctttttaataatggaattacaactgtatcaccaaaataagcctaatacataattaatgcattgttagtacgtaaaacgttaatctccactacatacatacctaaatatttatgtcaaaactcttatttctaaatatataaatgaatattctaaaaatactacgttaaaaagataatactgttaaaaattagacatgaatatccccgctagagctaccaaggatttatttttctgttgccttcaaacatggatttcatagcggcgtactcatgcctctcaaagccagcgtggatcatataactcctatttcactatcagcaccctcaaagatgatttcattagtaagtaggaagttgagtactattatcaacggtggcctctagttggtctgcctcaactcaaccatgtgtatatctctcctatacttatgttaactgcacgatgcctttcaggaaagaaagagaatatggatgcgataaaaaataattcttttcataaaaatagaatttttgacgtttttgtgtagacacaatttatttatagtgttaatcagtactacttaaatttttaaatttttatacagtataaatacaatactttgatcattgaaaaatatatatatatgaccgtgagaattttcagagtattgtatcattgtttatgttttgataaagatctatactttagcgtctagtttgttttcatcacctatggttcataatgggtctatcaatttaaatgaaaatcgatggtaagattacatagtaccatatgacggtataaaagtataaaagtgttcgtagaagtgccatgtgaccatatttgtggactaataaatttaattttgttagtatagaaaatcctttaaaatgatcgtctatttttccacgacagttctagcatgtacatatatttttcattttttaccgtacgtacgtcctgtttttcaaatgaacagttgggtaaacgtcttttccatggtatgttattccggtaaatgatacgtacgtgttgttctttttcccaaaaatgaacagtacgtaaaggtatacttttttccatgtacgcttttcgatatgcgtattcttttttaagtaaacggattctgtttatagacgggaagcataaatatttaaattttaaatagatctgatcgaacggtctaaaataacgggtccactaatttaaatgaaaatcgacggtgagattataaaatgccacgtggcaacttaggagtgcttgtaggagcgccacatgacggcttaggagcgtttatagatagattaatggacttttagtatataatagatagatagaagatagatagataatagatagatagattaatcatactctaatgcctttttcacttttcgcgcctaacttcgtctacatcttaatcgatctcgaacaacactgtatatatcaccatgttggtgctctgatgggtgaacatcgtcgagaaggaaagcagcagacagaacactggaggagatccatctgtggcgatgaagacggcgatgactctcccacagtctactgcacaaaaatgcataatcaaactcacatactctatccattccataatatcacctgaacctgaaccagatgcatgcgacactacattacaacaaatccggacagaacctatcccatcctaggttgctatattttggaacaaaggttgtataaaaagcatgggacaaccaagaaggaactctgtaacaagttaacaataaattcagcgtataggagaattgaaggcgggtcaccaggctgaaaccacaagccgacaacggcatgatgtgaaaacaaagatgatggcccttgtcatcacatcattcacgtctatcttcaaactgaaacacataatagtgtcatatagatgatgagtacatggaagttatctgataacaaacacaaacacatcgatatgacagtatgctatattgatggtgtatgcatatatggagttggaacaatcagacatcgactgtgttcaaaacccaggtggacgagctcttcacactatgataactgatataatcctccgacagcagtattgaacagtgaactagctagtgcctggagcagaatgaacaagtcatatgcttctgcaaagaaaacacagatacagcacaagcaatacttaccttgctatgagagaaaattagagattggaaactagatatttgaacctttcggtcaggcagcattcacatttaaatggaacaaactttcgatcagacaattttcaccagcaggatgaaaactttcctcagagcatgtaaacacacattaaggcgcaagttgtgagtcgtgcaatcaaccataaccaagtatacgacaatcctgtatcatgacagacggacatccttaaccctagttgatctgaaaggaaggcccgaatttgcctggtttcagtgattactgtgctccatttcatcgtcagttaatcactctaggtctagttcgctgcactatactttaccctagttccattgcggtgcaagtaaatttccatgcaaatccctggggtagagaagctaagtagcttcctagacaccttctcgctgacagtaaccaaaggatcaaaacttnagtatcgtcttgagctctggcatcgtccatctcaacagtcgtttgacaaaatatatttgacgctctgctccactcaaattgttgatttcaactttctggagaaaattcaagctgatattattctttttccaggcctggggctcgtaacaaacgcagccagatgagcaaggaacttctccatcctgaaatgaaaagcatgtaagaaattgattttaagaatattacgaaaggacacagataaaaggaagtcaggaaaatatagggaaatgaaaatgatcattctcattaaaagcttttattcatataagagcaatatcttttagatctaatcacctccagatgtgatgtgtggagaaagggggaaagaaaagaaaattggaaaatgtagcagacactttgactacaattacaatattttttgtcggaatttcaattgatcatttggcatggttcgttggaagtctcattgacatgaatctactacgaccacaacatacccatatcaatcaccagcaactgaacatttgcagcgacattccaatcatttctattttatcattgaaaaccaaagcagcatggcaacacttggatcaaacttttagatcgtagtatgaagaggggaaagacttgtagttttaatagataaaccatggagggacagatcggtactgggactgacacatcaagtgctaccacagtaccactcatagtaaaaagatcaagctgaggtgcattaaattgcaaatacttctaccactttcacagagaccatggtatttgattacattgaagaggtatacattaccgcaatgtgatcttctaacttcagcttcagctcccttataccagtagacatcttaagcaaatggtaaacacaaggtccaaaggtatgtcctattgttaataaccgcagagataggatttcaacggcagggagctttttcactgcttgcaccaggagctcacaggacatatccatgatctgaaaattaacagaaattcacaaaatataattacttaatatgtgcattttgactttacacaaggattaaggaagtgatgacattgagaaatgtatcagagaaaaatataatgctacagaggaaaaacttccagaagcctccaactttatggcttggacaaaacaatgtaaacacttcaaggccttgttcggttaatccctcttccaaagggattgaaggggaattgggggggattaattccaactattgagatgtggaattaatccgctccaatgctttcctcatggggattaacctaagtacctaacaacccctaaggaaaattgctttaataatgtgcctctgcattacataatcacttacgtccaaatctacatgccatagggactctttggatctcccctagttacatatttcgcatctgattaggagtcccataaatattatcttacttttatcttttaaatgggcatgagcctatgctaagatactagtaaatggttatgagctacaaaaacattgtaagtacattagcttcatcataataataatgtaatgcaacaagagggagaaggtgcactcacagagggatagacaagagatagatgaacatcgcgggcttctgtaaaatgctgcacgagttgcagagagcctggagtatttcgacgtccatacaccatgccatagacggagagtctatggacgttgggcttctcaacaaatcggactgaactcgaactgaaaaaatcaacccaatgaagtgtctccagtgctggagcaaagatgtcaaccattggcatcccccacaataagcaagcgtacaaatctagttctgtaagcgcaggagcagaaatggtgagctgacgaatcccttccagtcgagacagctgaacaaggcggagagactccgagcggatggctagattggacaccacatcggcatcgcggatacggagctctcgtagcgacgggcacccctccgacgagacggcgtccccgagatcgcgctggccctggtcgtcgaacctgcagtggctcaagctcagcgcggtgagcctcgcgaagacgccggatggtggcagctggatgccgaggcggccgcgcaagcggatggtgatctccgtggccttctcgaagcacgggatctgaatcgcgcccccggtcccggccgcccccgctgccgctgccgccggcgtgatgacgtcgaagcagagcttgccctcgaggaggggcgcggccaagt

SEQ ID NO: 50812 - DNA, 2351 bp, Oryza sativa
gacggcgaagagcttccggcgctgctcgaacgcctcgcgcgctgcgtccatggccgccgtgttctctccgcccggctgccgccgcgcctccaggatggcctgcgctgccgcgacgagctcctggtacgccttgctcatctcgtccaccttcgcatccatcttcgccggagttggggcggtggctcttggcgcggccgcggcgacggcgtcggcgttggcgctccccgaggcgacgtcgacgagggttttggaaatgggatttctggtttggttggatattttttttccaccgaatatgattttgaggttgaagagttgccagtcgactgaataccccaaatctcactcaattaataaacacaattggattaaatgtcctgagggaaaagaattacaaggactcgtaatcactggcaatgctagattcttcgtaacaatgactcataatcactctttccgtgtttccttatggcctgtttagttggtgaaatgaaaattttttgatgtcacattggacgtttaaccggatgttggaaggggttttcggacacgaatggaaaaataatttcataactcgattggaaaccacgagacgaattatttgagcctaattaagccgtcattagcacatgtgggttactgtagcacttatggctaatcatagactaattaggctcaaaagattcgtctcgtgatttcccctcctaactgtacaattagtttttctttttatctatatttaatgctctatacatgtgtaaagattcaatgtgatgtttttacgaaaagtttttggaactaaacagggtcttattgagaccacctccaaaccggaggaaaaatattagagtggaactcatctctttctttctccttctgtccccttctcttcctctccctcttttcccttctctttctccttttatcaatagcgatccaacgggatagggggacttgagtcgagtccctccaacacccacactagatcagtccatgcttcgaacgaaaagagattgcatggcttaccatatagtgacacaactataaaccatataatgccgggagatttatttttcatttgaacactaacatgtttttgcgagatcagattgatttttttttttgcgtgggataggatttagtaggatgaccaaggaggtgggtaggatgtgcatccttcgctgtaatacagataggctcattgtgtcaatagtatatattagtttgctgctacattaaatgcctctctgtgtcacctgtgagctgagtttgctgttacaatgaaatgtggtaggacagtaacaaaatactccctccatctatttttgatagtcatatttccaaatctgaaaaatttatttttaataggcatatttcaatccaacaatttattattttaatggctttcttggatttatgcatgactctccattcttccacacaagattggctacatgggcatcgagaaatttaatattaatgatataatgaatcgcttgtttacgaggaataactagtagcatgtttaaatggatgataagtagaatcacttatcgttggtctgtgtgccaagacgaaatatgactatcaaaagtagatggagggagtactatttacacattgccaaattttactgttttgcaaagtattgttaatctattactccctccatctacttttgatagtcatatttcatcttggtacatagaccaaggataactaatcctacttatcatccatttaaatatgctactagtcattcctcgtaaacaagcgattcattaatatttacatttctcaatgcccatgcagccaatcatgtgtggaagaatggagagtcatgcattaaatccgagaaagtcattaagatgataggttgttggattgaaatatgcctatcaaaaataattttttcagatttggaaatatgactatcaaaagtaaatggaggaagtactattcaaggtcactctagcatatcgttttgtcttttgatgaagatccaatggcaaaaacttgtttaatgcacatgtactctaagattctttgaattttctttctccatgcagaggagcctgattgggtaggcaaggatcggtggcaagggcaagggaggccatgtggttaggaggtgagggtgaggatggcgctggttgatttggtggctcacaccgctggagatatagaggaggttagacgggtggggtaatcacgccaaatatcgacaagacaacaatgacatttttggtggagctgttgcgagttggtagataggggaggtgaagaaaagggagggaatacgtgagaagggtgtcgttggtggccctcaccaaggctagtgagaagacagg

SEQ ID NO: 50813 - DNA, 14025 bp, Oryza sativa
  unsure (1)..(14025): unsure at all n locations
cgcccgccctctcccctatactactacatacactcctcccctactacagtactacacacaattttttttaaaaaaaacataaagttagaaaaatttatgtataaaaatactatatataaaaaatttgaattcaaattcaaatttgaataggctatgtaaacctttggcttataaactttgggtctataaactttaggtgtataaactttagatgtatagaaatactatatatagaaaatttttgaattcaaattcaaatttgaatcgggtatgtaaacttttgccttataaactttaggtctataaactttaggtgtataaactttagatgcataaaaatacctatatagaaaatatttgaattcaaattcaaatttgaatcagatataattcaaattcaaatttgaaacgggtatgtaaacttttgacttataaactttgggtgtataaactttaggtgtataaactttagatgtatagaaatactatatatataaaaaaatttgaattcaaatttaaatttgaatcggatatataaactttttacttataaactttgagtctctaaactttatatgtgtaaacttgagatgtataaactttagatgcataaatttactaaaatagaaaagtaatgcggtgccaaaaaaggaaaccaagtgagggagggaggggggaggatcgatcgcccattaggatccccctgcatgtagtggcacgcaagcatagggatcatagttgtgtactccccctgtcctaaaaaaaacttaatctcgtactacgacgtgacacatcctaatacaatgaatctggacatactttatgtctagattcgttgtgtcacatcctagtactaggttgccttttttttggacgaagggagtagtggtttgcaaggtgtgaatttgagaggtgagaaaagagacgtaattaagatggaggtgactagggatcggtcgcccgacccaaatctccaaaaatcgggtgctgacatcagcatgacgtcagcgccacctatatgtgtaaaaccactttaaattaatttttctcttaaattatttatctaaatcatgatccgattgcaccattaaatttgttgcaattaaatcttcaaaacaagaccacacaaggatatattccaacgaaattttttagcttattattgatttttttaaaaatgttgcacgatattccaccaggtatatcggaattgtttcactaagtagatcgagaatgtttcaatcgttaaaatcgggtgttgtttcaccttatataaaaacaatgtttcaacaaatagtaaaagaatgtttcagttcactgcaacattagatccatacatagtgaaacattataaatacaaagggtgaaacattttttggtggaacaaaaaatgaaacaaattcctttaatagagggtttccaaaatatttgggtgatttattgcaatagaatatttcagttcactgcaatattaaatctatacatagttgcaatattagatctatacatagtgaaacattgtgagtgcactagatgaaacattttttatggaacaaaaaataaaccaaattccctttaatagaaggtttccaaaatatgtgggtaatttgttgtaatagagttgtgtgagtggacacgtggtgggctagggagagagcgcgcgcgtgcatagaggcaggggagcgcccgatttctgcccccccctccccgcccgatcgtccgatggcaatcattctccaattaagattatagaagttgcacgaatcttcaataaatcctaaatatatcctagttgtgagaatggccgattattggtaaatttttaggtaacatatagctcatctaatttatgcatcacttaacttcgataacattgaggcataaggacacaatagattgcgacaccatctatttctttttcccggtaacttaccgctggaaagagacatttctacaaacagccatctcaaacatccacctataaaatttgtattttcataggtggtagattcctcataagtggaaatatatacataattccacagtagtttgcttagatgtgggtggctcacccgtacagatttcgtactaatgcacacgcccttacaacaagcgtgcacatctcaaactcatctactcctatttcggttgcacatctcacatcagcatgatgatacgcagacgatgatgatatctagattcattaacatcaatatgaatgtgggaaatgctagaatgacttacattgtaaaacggatggagtatctgataacaaatgcaaacgcatctataacgaatttatgacatcatgctatattgagggtgtgcttatatggaattgacatcaactgtgctaaaaaaaacgaggtggacgtgctcttacactgtgaacttctcttctttttttttttttgagatatcttacactgaactgtgataaccctcccacggcagaattgaacactgacctgggtgcctggagcaaattgaacaaatcatatactcctgcaaggaaaacacagcattcccatttaaatggaacaaaattccaatctgacaattttcaccagcagcaagaaaacttccaaatgcatgttggaaacgttcctcagagaatgtaaacacacgttggggcccaagttgttagtgcgtgcagtcaacaatacccaagtatacgacaatcctctatcatgacagacgaacatctttgactctagttgatctgaaaggaaggcctgaaattgcctggtttcggtgattactgtgctccatttcatcgtgagttaatcatctctaggtctagtttgctgcactatacttcaccctagctccatcgcggtgcaagtaaatttccatgcaaatctctggggtagagaagctaagtagctccttagacagctcctcgctaactgttactgaaggatcaaaacttagagtaatcgtcttgagcactggcgtccatctcaacagtcgtttgacaaaatatatttgacactctgctccactcaagttgttgatttcaactttctggagaaacaccaagctcaaattcatggtttcccagtcacggggcttgtaacaaatgcagccagatgagcaaggaacttttctaccctgaaatgaagagcatgtaagaaatcgatattaagaatactacggaaggatacagataaaagggaagtcaggaacaacataggaaaatggatatgatcattctcatgcaaaccttttattcgtataagagcaatatgtctttcagatctaatcacttccagatgtaatttgtatagaaagggagaaagaaaaagaaaaattggaaaatgtagttcagatactttgactacgattacgacattttttgtcggaatttcatttgatcatttggtgtggtttgttggaagtctcatcgacatgaatcttactacatccacaatatacccataacaatcaccagcaactgaacaacatttgcagctacattccaatcatttctattttatcatagaaaaccaaagcagcattggtaacagttgaatcaaacttgtagattgtaggctgtagcctgaagaagggaaacacttgtagtgttaatagataaaccatggagggaaatatcggtactgggactgacacatcaagtactacaactcatagtaaaaggatcaagctgaggtgtattagattgcaaatacttataccacttccccagaaaccaaggtatttaattacattgaaaagctatatattacctcagtgtgatcttctaactgcagcttcagctcccttgtactgggagacatcctaagcaaatggaatactcaaggtccaaaagtatgtccttctgttaataaccgcagaaataggatttcaatggcagggagctcatctttcactgcttccaccaagagcttatcgttactgctgatctgaaaattaacagaaattcacataatataattacttaatatgtgtattttgactttgcacaaggattaaggaagtgatgatattgaaaatgtatcagagaaaaatataatgctacagaggaagaacctccataggcctccaactttatggcttgagcaaaacaatgtaaacacttcaaggccttgttcagttaatccctcctccaaagggattgaaggggaattggaagggattaattccacacctattgagatgtgaaattaatcccctacaatgccttccacatggggattaacctaacaagccctaaggaattaaaattgggctaatactgtcatttatctccaaatctacatgccatatggactcattagatctctccaagttgcatactcctatttcgcatctgattaggagtcccacaaatgatatcttactcttatcttttaaatcggcatgtgcctatgctaagatactagtaaatggttatgaactagaaaaatattatcagtacattagcttcatcacaatgtaatgcaacaacagggagaaggtgcactcacagagctgtagacgagagagagacgaacatcgcgggcttccgtaaaatactgcaggagtggcagagagtgtgaaacgtatccatacaccatgacaaagacagcaagtgtatggacgtttggcattgctctgaatcggactgaactcgaacggaaaaaatcaacccaacgaagtgtccccagcgctggagnnnnnnnnnnnnnnnnnnnnncccccacaataagcaagcgtacaaatctagttctgtaagcgcaggagcagaaatggtgagctgacgaatcccttccagtcgagacagctgaacaaggcggagagactccgagcggatggctagattggacaccacatcggcatcgcggatacggagctctcgtagcgacgggcacccctccgacagacggcgcctccgagatcgcgctggctctggtcgtccaacctgcagtggctcaagctcagcgcggtgagcctcgcgaagacgccggatggtggtggcagccggatgccgatgccgcgtagtaagcggatggtgacctccgtggccttctcgaagcacgggatccgaatcgcggccccgatccccgccgcccccgccgccgaattttggttccccggcgtgatgatgtcgaagtggagcttgccttggaggcggggcgcgaccaggtcgaggacggcggcgatcttctccggggcggggtcgctgctctcgatgcgcaggaggaggaccggggcggagtggtggcggaggacggcggcgacgcgggcgaggtcggtgacgtccgcgaaccgcagctgcgggaggttggtccagaggctgcgccagcggcgggagaggacgctggtccgcgcggcctcggcggtggaggggaggcgggcgaggaggaggcggaggacgtcgtcggggagcgcggtgaggaggtcgtagccgccgccgtccgccattgccgcttcgagctcgtcgccgaggagggttttggtttgaaatggggtttctggtttggtttggaggggagcggcgatttttaccggatttgcttctgaggcaggacacgaaccgactttacaatttctttatttacagtaatatacttgtagtaatattactttttttttttgttagaacttttttttttttttgagaatttgcttagaactagaagtcgggcgcttctaattaggaaaatcctcagcgccgggtgcccgatgcgcgccaaaaaaatatcggggcgcccccacaccacgcctcccgtgcgcgcgccgcccccaccacatgtccctatcacgcgccgacgcgtgccccgttgcaacagccgttcggatataacggaaacgccatattagaaatatcagttttattatttgttctaccaacaatgtttcagctagtgtattcacgatgtttgactatgtatgaatcaaatgttactgtgaattttgatattgtttaataatttcatcttagtggacacgtgggttgtagtgttgcaatagtttcaaatcgttttttcatacgttaaaccagattatttcatctagttatctgaccgtgtttcactttttttaataattgaaacattcttttgctatttgctgaaatatttttttaggtaaattttgcgacaggacatcgtaattatatggttttagctcagggacacgatgaaagtgtagttttgggggaagacatcccataatcgtggatatttgtcgatggacaccatgccgtctaaaggatacttgtcgtgctaatggcggatgggaggccttttttgacacagtcagacgtaaatacccctacgccttgccgtgttgatgaaggagggagtagtgggtcccacgttaaagcggttgtgttggttaagaggaggattaaatagaaatttaccacagtggggcccagttgccgttgaggcattggaagggatgaggagagataataaggttatgtggggcccacttgacagtgtcccactcctcttatttttcttctctcttgatttcttctcctctcgatctctcctcatctctctccctctcgtttccctttctccccacgcgcatgcgtgccgccgtgccctgagcgggatgcggcaggtgcgcgacgacgcgggccgaggcgacggcggcggcctgaaggcggcccgggaacatcgagtggatggggagaaaaggctggcacagcgaggaggtgtcggggcagcgccgagcataggaggcggaggtggaggcgctgtgcggggtggcttggccgcgcgcgggggtggcgctcgcagcgtggtggtggccccgagcaagacgaagacggcgggtggtggcgtagcggcagtggtgcgcaggtggtgctcgcgcgcggcagcagcggccgagcggggtaacggcttggtgcggcggcggagaggggaaagaggtagctggctgtggtggggagtggcctgacgggaggcctatttttgctgacgtggtgcaggggtatttgcatccgaccgtgtcaaaaaatggtctcctgtccgccacgtcagcacgacaagtatcctttaaacggcgcgttgtccatcggcaaatatccatgattatgtgatatattctctctaaaacttcactttcgcagtgtctctgagctaaaaccacacaattgcgattttctgtaacaaaatttgtcgtgtttttatatagggtgaaacaacatctggttatttagaaaccgttgtttcatacgttgttgtaaaatgttttatgaggtgatttggttgtgtttcagctttttaaaatactgaaacattttcgatctatttggtgaaacatgtttgaaatacttggtgaaacagcacccgattttttttaaaaaaatcgggcgcccgatttgttggcacctcgttttaattggcacatagaaatggcgggcgccaactggcgctagctctccccacattttctttttttattgctatttgtttcatctttttcattattttctctttttgtggtttttccccaattttttttaatctattgttttcaaaaatatttgagtagaaagttttcaaatcattacttgaaagtttttcaatttcagaaagtttcaaacctgagttgaaagttttcaaatcattacttgaaagtttttcaatttgaagaaagttttaaatctgagttgaaagttttcaaaatttgtcttataaatttaaatttagagttgaaagtttttgtttcctttcgtccttcactcgagacgagcaaaggttcaatcttagggggttttgttgatggtcgttagcggtcagtttcgaccgtcaatattaccaaaagagaggagaactggttatgctttcaatgcatatacatattagaataataatattccactagtatttggttcactaaccttttgcagagaataagtataaagtgaaggagaatcgacatcaaatcaaacgataaatcaacatgtgtgaatgggccaagaactcagaattgacacgacgaattgggccaaagttcacaagtcaccctcctcagcgccatccgatccagggcttcacctggacggtgtggattagcccccaatgacggttggagggtatttccgaccattccaaccatcacaaccgtcattgggaggctataaaagaagttggcattctcacttcactcatacacctcaagcaagagctctctcatattctctcaagttagtttagtattcttaagctattggaatagaaatagagtagaaatcagagtccggaagccttcggaagagttcggatatggctctagtagctcttctcttctcttttgtaagctttgtactttatttagaatactcttctttatacatttatggtattgaaatactttctgagtatacgaaagctaactctatattatgttcatgttatactgattatactgctagcttatctgggagatgctttggtacgggtatagtgtttgtttatgcaattactctatgtcatgacgatgatattagagtagtatctggtagtttaggcgtggtgtctagactacgggatatcattatttggggttatatgttgtggatgagaggtgggccgttgatgatgatagctcagtatgggtattcctccgcgcgtgtatatagtcctaagttaatttcctgggagcgtattccttcgtatttagccccggttgtatggccatgacggactgtcgtaaggaactcggcagtcaggggtggcttctcgaagtatcaggagggcatcggatagagggtattagctagtatatcatataactaggatgtatgtatactatatatactagaagtataggaatagattctctttctcttttctttccacttagcttagatattttaatgtgagaatgagtagcttcctgcttgtttgtcactctacccttgaattatcttaacccctgtttagactatgattattacaagtaatatataaattattagtcaagttctctcaaccatgatcttcccacgggattaaataaatacgataccgttggaatattctcgggtgaaatgctacaatggtatatccgtgcggttgcggatgaactctgtaaccataatataccaggagtatttctgcgccatagctgggaattatatttctagtaatgtcgttaagaaataccagcacttaccaccacacactaggtcccactaaaaattcacaatgttctcaatacataatatctataaatgggggtaacaataaatattctctcattccttttattttctctaacttctcactattggtcatatttgtttcgaaaatgtgttgaggacatttttctcctccaatgcaatattaccttcttagtttttgtgtttaaaccacttctcacgcaagacactacctcactttttttcttctttaactcttcacaacatataatataaaatcctacggctcaagaatattaattgccatagatacccattcggagggcccttaggtccatacaatatgaatccaagtgtaaggagaattgaggtagaatttacacatgaaaaaaatttagatttactatagcagacactattatagttatctatctaagcaccatgcatgttcaatagatagatggatgagatcgtacagtcactagggatctcaatccactttccatacactctgtgtagcccattgaattgtgtctaagtattgcattgcgtagccgcatcactggaatgattctaaagttagcttatgacacggctttaaagatggactgatagaacttctacaactttagctactatttaatacattaaaaaacctgttcaattgaatttgtgtagatttgatcattaaatttttcatgacgagtacttccttaacataatattgtactaggttacaagtaatattttcttaaaaggttttgctaagcagcatatttccctataaacaccaaatggtatcgcggataactttaggtaccttgcaagaaaaagtcccaaacgttggatattatttgtaacaaaagggtgtaatgcaaaataggatttgctaaaattttgattaatcccaaagtagccacatcgttataattcaaaagttagcaaacggcgtgattttaaagatgattgaccaaaccaacttctaaaactttagcgaatatttaatgtattaaaaaattatttggattcaatctttgtagattcgatcattgagttttcatatgagtactcccttaacatatatatcaatgtactagattttcaataatattttcatgaaaagttttgattaaataagatattctcttgagaccaaatggtgtagcggaagacttcaggtgcaatgccaaaatgtcctggacgtttgttgtttatgaaacacaaggggtgtaatgcaaaactggatttgcaatatgtgtgattaatgtgtgtatatatttcatttaaaactattaatgcatatttcatttggaactattaatgcatgtatatttcattagaaactattaatgcatctatagttattgcccttgctccaaaccgaacctgtttagacattaacaacttgctacatatacggcctctccctcgttgtattcttccacaattcacatcatactaccatggatgtgaacgtcgtggtattgccgacggtagtcagccgtagttgccgcctgaccgtcgtggtcgagccctttgacaaggttgttgagatcaagcagaaggtggagagttgctatggcatcccggtgaccatgcaacgccttttattctagaatagggagctcgctgatgaccacgacattgagtattatcccatctttgatggctcgcatgtcctgcttctcccccattggcaggtggcggcgaggttctgctggatccacgggctggccaagtggagcggcggtgataggatgcatgacacggtccatgtcaccgcctacctccctccggctagttggggacggaaggtcacagtgttcgcccgtcgcgaggagagcgtggctgccctaaaactccgcatccacggtgcgcaaaaagtggacatgcccctgccagagtgcatgtggaacgacttcgtgtgtggcagcctcatggtgatgatggatcactggcctctaggtgcctacgtcgagttcgactccggcgtggtggaggtgacaattgttgattgcaagaagatggtggagacaggaagcagcagtggcagcaaccgcaataccaacgtggatgccaacaacaataagattgtgatcgggctactgatggagggctcacactcccagcacatggatttcttgttggaggcgtcgccagcggacatggtcgccaccctgtaggagcagctgaatgacaacttcgagggcgacccagagacgccgctgctggccgaaggggactaccactttgagctcaacggggtggccatgaacgaggagctgtcgctggaggtgcacggtgtcgttgagtctggtgaaaccatcatgataatttccgggaggctgcctatgcctgggtgtgaataaagttcagactaaggtttgtgagggttttacaagtgtatggtcttgtggtttgtgtattggcgtatgccatccacctatatggtttttagaaacaaacacggtggaatgctgaaaaacttgagtttttttaaggagataaaagttttgttttagcttggtggatgtccagaccatctcctccattgaatgtgtactccgtatcattaaaattagtatgcgcaaataaatataaatggagagatagtagtgcatatgaggcatgcaacccaacattaacaccgtagcggactcatagaaaactaagtgtgatgcagtcaactaagaaatctgcatatgcttatgggtttaaagttggaaaccgccgcttttaatgtgttatggttggtgacagttgtgagcttgcaatttggtaatatttgcgtgtaacttaggtgaatctttgaaaacaattaaaaatttcaaaaccacatttatacattgtagtatatagtgctatttagcttcaagaattatggtggtacatcactataaagaggcgactattgttttgtattttacaaaattaatctgttttcacccacatctacaagtgagaacaattttctaaacaaattcactgaactgatgaagtgatgtacctgcctagtatagatgttattttggtcacccgaaatctctatcattttcttttgtgaaataacggtgaaggaggtatgtatctttctctatttgaagttcttttcacggttgatgaggtaatattttggcccacctaaacattgtatttcttgaaaattggacgagtaaacatatggcttaattgtgaagagctgatcttatatatttacacggcgccccattgttatagcttccaaccttctacttgtgcaaaaatgagttggagggagaagttggtgcaagatagcttacacaaacaagtcaaagtgtaatgtaggtgtgttgtagaacttgtatcaagcttaaatgcaaatgtagctcgaacattgttaatagcataagcacaaacttggtagaatctaaatgaaatggtatatttccatagacccagttgctgtgcagtcctagcaaatacgagtgtataattgaaacttcaatgccacatagacaaaactagagaaataactttctcaatacatagtatatataagtgggccaacaataaatattctcttattctttttattttctcttacttctcactattggacatatttttttggaaaatgtgttgaagacattttttctcctccaatgcatggaagacactttctgttctctttccatatcatctaaaatcctgtgtgtcaagggtattaatatccatagtaacaattatagctatcaattgggagtgcccttagatatgtacaatatgaatccaagtgtcaagagaagtgggatgtaatttacataggatagaaatatcgatttgagcaccatgtttaatagatggatggatgacatcacatatggtcaccaacttgccgtccttaatgactgcaggtgatatcaatatgctgtccatagtcattgtagcgtgttaaattttgtgtctcgtctccacttatgatcagccctcggttcgccatgtcgtaacgagggatcgtattaaaatggatttgcaaaaataactctactactatgaaaatggagtcgtcctccacccctcccacaatcgtactcccaccacgttaaaaacacctcacccaacaaaaaataatgaaaaacaaatatataaaacaaaacctgataaaaccattcattcgtattcctcccaatcatgttgcaaagcacacgcatagcattattattgattaatgcctaattattccttagccacaccattataataattctaaggttaacatacgacagggttttaaagacgattaacccaaccaacttcaacattatttcatttttgatatattaaaaacaatgtttggattgattctttgtagatttgatcattaaattttcatgacaaatacttgcttaagattataatgtactctttttagtaacattttcttaaagggttttcactaattagggcattcactatagaccccaaatggtgtcacggatgactttggataccttctcaatatgaccgaatatcggattttttttaaacacaagggtgtaatgcaaaattggatttggaatatctattattactgcctgcataaggaccacgattcacaccattctgtcatggaagtgaacattgtagcactgccattgctgcacctcccccccccccaccccaacacacaggggcggagccaggattatatcaagagtagggcttaatcactagagtataaacttcttgaacgaattttaatagaaaaattagtaaattccttgatattttttctgccaggtgtggggcccgggcccaagctgccccacacctggctccgcccctgccaacacacacacaggcacgggcggctacttcgacaacaacctgaggctcgggatggaaggtctatggtg

SEQ ID NO: 50814 - DNA, 7004 bp, Oryza sativa
tgagtactacccgatcctccatgtctcgcacatcttgctcctcgtgcgttggctggtgatagaagcatggcactgatggtccatgtcactgccttcctcgtgctagccagccagggacagaaggtcaggttttccccaacaaaattttgatgacttcattaatagcacattgatgtttatttcgataccaactaaatatcaattctactctattaaatttgatagtgccaaaaaggttgtaccgttacaaaacagtgtaaaaattggatctagatgtgattaaaaattgaaggagtaggaagaaaatgtgtcttctccaaatattaggggtacacacatatgctactagacatcaccaaacttgacacacaatcaaagcgcgttgaggccaattaatcacggcatggcgtgcaggccgtgagaggagagcccaggttcatgatttcacggtcggttcaacgttacgggtttaatcgggccgaaagtggagtggccgtggtggaaaccatgcacgttacttggtggaataagttcgcttcaggattcaggtaccgtaatatcagatataacatgtctcttaacttgtaaaaccggtacaaatatagtcctaaagcattatggtaagcggttttagctgacatggtgcggacgtggcatcaaataaaaataaaaaacatgtgggccccacatgaaaaccacacaactgcttattctcctttccccatctcccctcccttcccccatctctttctaggataaatttttgttgatatgattgattactaataatttactacctttgtcctaaaatatagttatttctagcacaataccttgtcccaaagtgaagttatttctccacctacctcttctcaaccaatcacaacgttttctccttcacttactttctcttttcaatcaatcacacactttcttcaatcattctcacatattttcttaataccgtgctaacctaaaaaatgtatacattttgggacggaggaagttctactgttgtggtgaaaacaacaagaaaactactccctccgtttcaagttataagacgttttgattttggtcaaagtcaaactgctttaagtttgaccaagtttgtagaaaaaagtagtaacattttcaacccaatacaaatttattatgaaaatatattcaattattgatttgatgaaactaatttagtattataaatattagcaaatctattctacaccccccttagaataactattctacccccctctccctcccatgggcaaacccacctcccccacccttcctagggcccaaaacccccctcccaccccagcaaaggtcggtcaaagcgtcctcccaccagtcagacctcgatcaaacccgcccactcactccccccccccatgtccacctctttgttgtcctcgtctcgcatgaattgtgcactaacaagacaaccatcatgcagtaacagggttactttctcgcattaacaatattataacattatcaaaatatagtgataacggatctagttttgtaaagctctttttttaaaagcattatggtggaaactgttcaacaatataatatgtgatgcgagagatacgattgtttaaagattagaatttcaaataatccacttgtgtttagtttgctactttgtatcttttgtgttgctcacttccctccacgcccacctctttggtgtcctcgtctcgcatgaattgcacaataataagatgactatattgtagtaatatgattacttactcgtagtaacaacattcggtagtttgtagaagtaccgttactactacatgcatgttctgcgttactacaatttccataggatgttactgtcaaaactgcagtaacaacctatatatttttgcagtagcaacctacatatttttgcagtaacgtggcgtgttactgcactttttcaataatgttactactggaacataataacagattataagtttcacaacaatataagtgatttgctctcacaaagtttgaatagagatatattaaattgaagcagtaaactctaatcacaagatgtcatagggtgaattggttaatagagaatttctttgaaccatgaggtcatggataagtcttggttttgtcactttaattttaaaatttctctccaatgtgagataaaaaaaattagagggagagaggccgtcgggcgagagaaaaaaaatcagagaagagagagggcgtgccagtgagagaaaaaagagagagggagagggcgccgggagagaaaaaaaagagagggagagagatcgatcagagggagagggtgccgagaggtccgaggggagactcgatcgagagaaaaaaaagggggcgcagggagagagagaggggagggcgcgcggaagaaaggacgagggaggggcgggacgagagagggaggatgagggcgggatcgggtgggccgggtggagttgttgggtaggataggaggggttgtagaatagctattttaagggggaggtgtagaatagagttgtcctataaatcttaactaatataaatattcgtatttttccatttgttacaagacggacgaaggcgctttcgtccgtcggcgggacgccttcgcagcccccgaatcccaatagctctcagaatcggatataggaaacatatcccaaaatcggcacaaccaaaactcaaccactctttgccccaaaagatcattcacaatcatcaccaaatcacaaaatacatcacaaaacttcacaaaaatatacatcaaaaagaagaagccgcaggatccgccctcggccatcgccaccacggccctcggccgttgccaccgccaccctcaaccttcgccaccgccgccggattcatccgcggccgttgccgacgctacaaccaccgccgaagggagaagagaggccgcggagggagccgccgttgccggatccgccagcggccgccgccactgccggcggatctgctgcgggaggaaggcgaacgggggcggagggagccgccgccgatctgccgcgggaaggaggctagagggagccgccgccgatctgccgcgggaaggaggctagagggagccgccgccaccaccctcggatccgtccgcggccgccgccaacccgccacaaccgtcgtcatatccaacgagggagaggaggaggggacgagggaggcgagacagggcggggggagcggccgccggcaaggaaggggagatggtgttaacaatgaaatttggtaagcccggagtagtcgtcggctcagagtcagcatcggcttcgaagtcctgagattagccgatgagacttgtcaagtcgttagttgtcggattcttgctatattcggttaaggaaattgatctactaaaggaagcttatccagaagagaccgagttcaaagagaatgcggcatggcaagttatctattaattaggaatagtttgttaatttccttttatctttaggaaagtgtgtttagtgtcctataaggactttatcttttccttttatctttaggaaagtttctttcttgtccgacaaggacttgtatcaacccatgggtataaatatgtacacccggggtctatgtaatctatcgctatgatcaatacaattcggcgcatcgccaccctttttacttctacttttgtttttacgttccggcggaacttggcacctgacgcggggctgcatcgtcttcgatctccggcgaagggataagtccaatgtcccgtcggtccaggcaattgtaccatctacgtcggcgtcgttcaaggctgcatcagtacattcgacctcttggattactctggtttggatgatatatttgcctggctatttatcatatgtctatgttaatctagtcctagcatctcaatttagctctatcggctgtctctcgctttagggtttatgccggtatcggctaaatcgccttgctagattagattagcctagacatctaccaccctgaaaaattagtcaatggcttgattgtctagatattgtgtttcttttcatacttagtgctgcatcagttaattttgatctaataagtcatgcttagaaccataatctctagcctgctttttgactgccaataagggtttcatcggggtttcagccgatgagttatctaggcattgcatcggctcataaggattgaatacatattggatttagccgatcgcaacatagatttcactgtttatctaatcttgtggatttcatgacatcggacctccagccgatgtgtgctttaactttcggatcgatgcttatttatcatatcattatttgccgattggtttatactggattatattgttattttattacatcatcatcagccgattgcctttatatcattatctacattggacatatagccgattgcttaaaccctatcgctatcggctggtatcggcatcggctattatcggctatcggctggaactactccatcggcttgtcagccgatcggctgttttgatctactatttgcatatcttgttagttgcaggatcaaactgactggtacgcccgcatctcatcaagatttggacctgcacaagagctaagcagatctcccaggccggtgtgttcgattttttcgtcaacagatggcgcggagggagtcgccgccgccgtcgcttttcgattcgaaagagaaaggtgatcggggcgagttgggggagggaaatgaaatctagggttagggttagggtttggctgcagatatttatgtaggttaggatcaatctggaccatccattcgattggacggctccggcttctcccgctcgggccgccggactattgggcctccaaataggcatgcaagtttgcgcaatcagaggaggagttggagctggtaaattagactttatttacgggctgagacaatataaggactgaaaatggcccatagagaaattgggggttttatttacatttttatttaaataaatgctgaaatgatgtttgtattatcaaaattagcaattaagctccgaaaattccaaaaaaaattcaaggagcattattaatcatggttaatttaataaaaattaaatgcaaccatatcatattatttcacagcatgcgatggggaaatgcacagctgatgtcgcttacggtgaagagaaggggaattatttatgtccagaactatctcttataactcccatggaactataaaataactataatcattatcataacattagtttttttcctgttgcaacgcactattgaataataatttattatgagctactatatttctctctatcatttgagacttcggttaaaaacaaatatttttagttttaatacactgtagcgaagcacggtcattttgatagtattactgtatttgtctataaacttagttaaacttgaaatagattgactttgaccaaaatcaaaagggagtagtacctaattaatactccagttgcagttattagttcacagtggaaagcacattgtacagaattagtatttcattagatcttaagaagaaacaacaggggaaatacgagtctataaaagagcaccatcttttcttaaggcaaacagatcccctggcaaaaaaaaattataccctgtcacatcgaatgtttagacacatgcagggagtattaaatatagatgaaaaaataactaattacacagattgcgtgtaaattacgagacgaatcttttaagcctaactgcgccatgatttgacaatgtggtgctacagtaaacatttgctaatgacggattaattaggcttaataaattcgtctcgcggtttacagacggaatctgtaatttgtttttgttattagactacgtttaatacttcaaatatgtatccgtatatccagtgtgacatgccaaaactttacacccgtgaatctaaacacaacctaaatacttcaaaagaggagagagataagaagaaaatatcatcaccttgtagatgtaaaaactcaaaaaataaaagaggtgaagaaaataccaccaccttgcagatataaaaaaaaacacaagaaaaaaaaaaagaaaagaggaccaccttgtagataaagtactgcagctcctggaatagtggagtgcaactttctcaaattggaagattcttcttcaaccgtaaccacttgccattcaactctggagacgaggcgaaatagacagttgagaaaagccagattggattgcattttcacttctatgacagtatagttgcgtgagcttatttgggaagaggcatcacggtatgacagtacgtgcaaaaataaatcaccttgagagaacagtacgaaggaagaacaacaccacacgacgaattaagatcaactgcagttacacgacaggtgaaaacttcagctcatgagcatgaccattatggcattattgcatccaatggtacaataaacaagactgataagtacaacagcagtagcctgacaatgcaagcccaacggccggccattatgcagtcaaatggcactagaacaaatcgaattcggaacaagctaacttaaggggaaaaaagatgaaacgggcccagataagcagggcccgaaactaacctgcctgtcaaactccagggtcaactacactaacacttctcagtaggatgtgcctagcttagcagaacttccagtgattgttgcagttcacgcaggtcacgaacgtcgtcatcggctcgtcggcgctccgagtctggagctggtagtaggtagtcttgcgctggccgcacctgccacacttgaactgatcagtggtggccttcggtgctcctccacgctcgcactcgaacagagccttctcctcgatcttcttgttctcaagcttcctggtgtcgctagccatttctgtcggggttaggtcagcaattctctcaggctgcacttgtcctagaagaacccttctccggaagtctgtgttgtgatcatccttcagattgaacatcaatgatctgtacctttgcttattagg

SEQ ID NO: 50815 - DNA, 13442 bp, Oryza sativa
acagatcagcaaacaagagtattgtgtaagtattagtaacttagtatatgacataaagagagttgtattacccaaacaccacatgcatatgtacaagttttttagctttccacattaataactagatatcaaacgcaaggtccctctgggaagatatgatgctgtcatgaagaaaaacaccgtaccattatgaaggaaaacatttgcatgctagccatgctgagcaaaacaggaaggaaaataggtggaattacatatcttacataactggacatggtaataaatagagcaatataagctaaacactgggtgcttgctaaaaatggtaagcaagattatgtgtgagcaagcaataatgcagcgtagtcaaccggtaacactaagcaactgctgcctgcaaggacgtcatctaccgctagagcaccagtgcttcagaatcaacttttgtttactggttatgaagacatggaaataatcctaaagattatgtgtcagcaagcaggaacgcaggatagtcaacaagtaaatgctcagcaactgctgtcatctactgttagagtaacatagcttcaaatttgttgaacttttgtttgctggtgatgaagcgatggaaagaatccaaaatttcatctcatcttttagtggacaataagaaagttattttatgacaaaatcaggagacaacccacatctttctacgaactatccaatggtatcctttcgccatcgatactttttatattttacttttcaatagaaaagaatgacttggacatgagatacccccagggccaaaccccccaaaaaagaggcatttgtgttacgaggtacgtctgcacgtgtaagggcatacccagaaatgggccaaggcccaggccgccctattgtaatttgagcaatgttctagaaaaaggtatactaggccgcatacaaggagcgggttccccaatcttgtacctcttaagtcgtataagcaccgattatactgcataagcgtcccattatgccatatacgtactacaaggtggggccacctcttagaacaaaccttggatatgggccaagtttatgccaagacggagaaaattctgtcccggggcccaagccaagggcctgggtccaaccttgttcgcgtgtcgcacactaccacacaattctcacgttcaacaatagttcccgcgcaaacaactcctagaacattgagcaatatcaccatacttcaattttctcctaagcagaacaataggtccacaagcaacccataccacatgggacaccaccacctcaggcaaaatcagtacctacgaatagtttgcgcctgcgcagcataccagtatagtagacccatgcttgatgtttagacatcacggaaatcccaattatcattatagtataccagtatagcattgctgcaaccccttatccaaatctaacccaaccaacacccctcaatgaagcgtccgtacaatagctaccaaatcaaccaatctgaatattctaaatattccttagatttgcaagcagggtaaaacaagcatcctaatgttcataatccccaacctttccacatctaacaacccccaccccgcacgcatatacagcaataaaactatcacgcgaaaatcctatccatgcgaatacgaacaatttgaatctgaagccacaaaaacaaccctaaaatcgcttcccaggaacccacattccccttcctcggcaagacacctcgccgagagatctcccaaaccgtcggaacaacaaccagagcagattccctacaatccccagtctacttacggcccccgcgctcggtgttttaacaacaaacaggggggcggcgcggcgtggctcacctgagtggagacgagggcggcggtggtgacgcgagccccgcgcagcctccgcagcgcgtcgacgcagcgcgcggcctccggcgactccccttccccggccccggccgccgccgccgcctccccgaccgcgtccgccgccttcctcgccgcctcgaacgcctccaggagctccctctccatcgcccccgccgcgcccatcaacccacaccaagccgcctgcctccggattttctctctctctcctctgcggcggtggcgcgtgtcgtggcgtggcgctccaatggcggtggcagctcgagcctcgaggaggaggaagaggtggggtggaggaggggggggcgggatatttataggagggggttgggtgaatccgatacgcacacgtgggcggataaggcgggatccgacggctgggatcgtcccgagggcgtttcggtatccaggtggtgtgggcccgggccgccagccctctgcttccaggttttttttttcttcttctctttcgtaaaaagagaaagatttctctccttttcttttctttttggtattttgttagtcacacttcgtttctttttggctgctttgccatgtgtcactgcatctttttttttccttctctgtgttagcaatgcttgtgtttcattgttcagttgggttgcttgttgtctctatttgagcaaagttgcagggtatcttaagatttggtgacaaaaggggaaattcgaggtatgtcttttgttactgtagcagtgttttgtaagtaaggaacatgaatgaaatttcaagaggaagtttctttgtagttttggattacaattaaaaaaaaaaggcaatgctcttggctcatttcctggtaaggctcatacggggaagggcaagagtgcaagactatggtcggcactgttccatgcaaatttattggagctcatgatagaaaataggaaagatgtttagaaaaatgaggtgtgacttttgtaagtataactcttataagcaacatttggtatgtaaagaacataaatgaaatgttgttgtaattttgtatgcaacacataacacacaatgcataagaaatactcctatatcagataatgataacgtgatttcctcattcattaatttcaatgttttctagttctccatgagcaagttttcgttgaatgaataaaatgttttcgctaagatattgcacctgtaaaattgaagaaaattcactgcatgttttcgatacagaagaaaaataagaaagaatcatatttatagatcaaatgattctaaaaagatcagaaacaaaactgtggtcttctttcggacaacgaccttgtcctatttctttctggtgctataaactatatcctctctctatctgtgcatacgagcgtacacacgccttcgttttctcgtgtaaaaataacattttcatatctgaaagctcaagtggattaagagagagaagagaacatcttctgaatatgtagataatcaaacacggagaagcccattttggagcatattattagtttaatttgagtgcagcaggcggccggcagagtcagttaaatcattccattagattgctgttatacttcctcaacctgtaaaccaaagttacagaaattgtcattccatactaacaggtttatgactcaagaggaaataatggagcacggttgctaaaagcaagtagcagtccagaatctggctgctagtgtaattgttgattttttttaataaaaaacatgcaagatcaatttccatccagattaattgtaggctgctggatcaaccattagtatgatggagataaataattgaaaatgtgtttttacacttacttacaaagtgtaatcacaaatgcaaatacctattctacaaaagccaaaaggtgttaatttcttttgtattatgaaaatgttatcgatgggatataactattaaaggaccttgagcaaaacttgaagacattgcaagagatacgcttcacatggtttatacaacatgcatgcttgacatttactttgtaactgatgaccaaatgttaattaccagccagcgaaatcaaagagggatctgaaagagatcttaactatattaaacgtgaagtcatttctatgttatattaaaatgcaagtattttgatggctatgtttgcaggataaagtagtttatcatgaagaacagaatcaaacatgaagttaaatgtatgacctgtggaagattcattaactccataacagccttctttggggttagttcattgtcaattatccgtgcaactgctgtcaagactggcatttttacatggtacttctgagccaatgcgatgacagccccagcagttgatacaccttcagcaacctatacagtgagatgaatatattaaaactatgtatggtggcaacattcatccaaaagttgattcaatagcaggaatgctccagacctgattcatagaattcatgatttcgtcaagtttttcaccagaaccaagacgcagtcccacatttctatttcgtgaaagattgacaaaacatgtaagcatgatgtcacctgagccagataaaccagaaagggttgttggctttgctcccatcttcggattgtttggaaaaaaaaagaaggaatcagtgaacttcataagttgatccttcaaagattacattctgatgataaaagtatctcacacctttgttgctaaccagcgtatttctgaacagccttgagcaacaagggccgccatacagttatttccaagatgcatgccttctactatacctgctgctattgcaagaacattcttaagtgcgccagcaatttctacacctgtaacatcactgaagcatcacaagtcacattcaagtattctttctcatgaatgcatagttaaattcaatgtacattatttttactaaactaagtgatagcccatgttgcttgtctgaattcctaaatccttacagaagagaagaaacagttcttggtctatacataaaagaattctcggttacatagtgatcagcatttatatatggccaatggttagtaatatttactttgatgtgcttatcctcaaattcggtgaggccaacagctgctgaacagcagctgccaactttttgtccttggatgccaccaccatagctgccatgtaaagtttaataactatgaggttccttccttcattgcaaataaaaacattccatgttctttatagaaagtaccagagctgggcatcctcacaattattaaacacaagcaaaacagaaaaaaaaaacatgaagtggtgccaattgacattgcatcctaaacaagctagagggagtatgacatagagaagattaaacttgtcaagaaatgatcttactaaacctgttggcaatttgttcatcagttcgattgcaaaagaaggtcctgacagaacaataaacggttggcggggattccccagcgcttgagggatgatttgagacattgtccgaagggtgttaagttcaagccctttgctaagcgatatgaacggcaacttcggatcaacatgtgttgaaataccctcgagaaatgatgaactgaactgccacaaaaagaaacctcaagagtcacaagagggaagggaacccccattgcactgaacaatgatttgtaatgaactgttctgaatacctgaactgggacagcatggaagcagaaatctgctcctgctaaagcatcactagcactagttgttgcagtgatattttctggtaacctgtggtctcgtaaatatttactgagacaaattgaagaagctgaaagttagattcagcaagaaatctaatcaccagaattagaatgatatgatattatttctcaaatgaatcaagaaatggggggcaatgagagattggagctgtacccaccagttgatgtggctgtggttgatggatcggcagacgaggtcgtcccggagcagcatggagacctcgaggtcggccttcttggccgccacctgcgccgccatggccgtcccgaacgagccccctccgagcaccaccaccttgcgcgtcgtctcgaccacgtcgctccggttgcgccgccgccaggaccgggaccaccggacgagcttctcccacgctttccgcaccacgcggcgccgctccttccctcctcctcctccgccgccccgcggggccgacaccgccgccgccgcctcctcaccggcgtcggccttctcctccgccgccgccaccgacagggcgccgtcgggagggccggagaacacgagggagagacggcggcgggtcggtgagtggacagcgacggcgaggcggcggcgcggggtgggcgtgtgggggaggaaggtggcggcggcggcggcggccatggatcggcgtcggagaagaagttttcgcggctcgggagatttgctatcttatccgttcccgcctttccctctcgctagatttcatcgagattcgtgctaaggggaagatactccctccgtactcgcgaagggagtagttttggacagcagagacattattcaaaacacaacttttacttcttatttctataaaaatatttattaaaaaataatatgtgtatacttttatgaaagtacttttcaagataaatctagtcatatagtttttacatttttaaacacaacaacttgaaagtaatttataatttatatttgtaaggtttgacttaaatattgtcctaaacaactttctttacaagtacgaagggagtatttcacatattcagattcgctcgattttttttgccgaaaattcggatgtccacaaaccgttcgatttgtgacaattttcaaataaatttcaaaattgatgtcattgcggttcgcatttaagccagaaacaattcagatctccacgcaaaccgtttggtttgtgtcaaaattcaaatgaatttcgagattacttcaatggggctggcagctcgcatttgagctcaaaaaggaaaaactgtaagccctagacgatcgaaatccaaagacaatttgataaattagtcgcatggtgtatcaaattgtcttcggagaaataaaatcgtctttgcaaacgtacttgtttccatgaaaatcgtaagattctctcatctcagcgtgatcacgcagtcctgcttagttgtccaaacatggtacacctatgcacagttggtgaaaatttccttgctgtaatatcaaataccatgcagacctcaccgaacaataaaaccaaactgaaaataaggggcaaacagatcctcagctcatgatgatttcagataaataaacagctgatccagcacagtaaacataaagttcagaggtccaaattgctcatatccccttggctcacaccacaaaaattttcttatctcctagcaagccacagaaccaagcaaaatataaaggaaagtacacaatgtcaagcacaagttctggatatcgggaacgctatatctagtgggacttgacatagtcctggactatgttgaggccctctgactcttcaccgaagtcctggtaaatgagaaagaacaagccaacattaccaaatgccgaagatggcaaaaagatatttgaagtagtatggtgggtaatcaattatctaccttgacaacgacgcaggagcagcctacgaccttcctcgccttgccctcagaatcaatcttgcaaagctgcaaacaacgtttgttgtgatattgttaaatcagaagatatgcagaaaggagagatgcagaacgatatcaacaacaaaatgaaattaaaatttagataaaggattacaaaattaaatagcacattttacactgagctggtaaaactgtagtcattagcagaaggctaaatcaaaaaatcttatccggcagcctagacatcagattaacacagtataacaattgacaaggtatagctaatagaagagtaatgtatctcacccctgcccactcgccaagagttttagcactaggcacggtaacgaggtgaacattgtgctcagcgcagagtgccttgaccaacttgacataatcaggctggtcacagtcctcagcaagcacgcaaagctgagcggcatgcttctcaatggccttggccgcctcacggagccccttcacgagcccatcatgagcgcttgacttcttcatcacaagctgcagagcagtcatcaggtccatcggctctccaagaaccggggcaggtggggcctcaactggagtctcttccctgcatggatgcttaatcttagtaaacaaggtagcaacacgttttccttttagttttgttctactggaaatgctctttagataattgagttccaagtaatttgacaatatatggtgctgcattctcaaaatagttagtaaacataagcaaaagtcaatttcccactgtattagcaatgacgtgcacaaagctaggtttttccgaattcaagcaaaacaaaacaattcgaggacaaatgtagaaaggagaactaataatatgcccccactcagccagaacaactcgcttaacgaacaaaaactaattcagcaagcattaagccttctttctatctggccgtatgttctatctgcttaatattaccatgtacaccctccgtcccaaaaatacaacttctggaaatgaatacggagaagcacatgtctagattcgtccccagaagtttggtctttttctgagtatgaaccagaaatctgcttgcaaaactatattacaggcataactaaagaattcctaaagcataaatttcaatcccatccatggcagctcacgctttcgctaaaatacgagccacatgagcatgacagctttccaatcgcacaacattacagacaagctgaagactcgccgggttcttgaatcaattcgtcaaaacaagccgcgaccctcacaattccaaaacaaaaaaacagaacacgaacagcaagggcatgatcccgcaaaaccgctaggagcacaacccatttctcaggcgccatccatcagcagccagaccaacagaaaaaaatatatcaactatgaagcgagtgggggcgccgagatttcggtgcggggggaaacttacgccatgtctcctgcgctagaaagacccgaggggccgacagcgacgacgacgggagggatctgcggaaacgaaagagaaatacaattagaagcaaaacgggagggaagcagatgcaaggaagaagaacaagggggaagggcagcgccgccaccttgggagagcggcggcggcggaggaggaggagggttagggttttcgcgaggagggcaggtggggaagaggcgggtgggagaatggtggggtttatatggctctctcgtgtcgggcctagatgggccttgatctcccgcttctgggcttcactacgaataagtttacttttactcccttaactagtgaccggatctgatttgtttccctgaaccacgataccgatatcttaacccccaactattaaaacaggtgtaatttaactccctcgaggtcttggagggtgtttttgctgacgtgacccctatgtggcagtgttgacatggtcttcgtttcacgtggtgttaatgtgacgcttatgtggcattggaattaaaaaaaatatatgtgaacccatttatcatgaacacaaaaatattaagcgccatagtatggacgtgtctcgaccccgcgtcgcccatgcgcgggccgctggggggaaagcctagcgccgccgcctcccctctctcctcctctccctcccctcgccaccgctggagaaccgagcggccagccgggatgacggcgcgtgaggccaaatctcggtggcacccccgtctctgcacgtggaaggcgggctggcgcacagagcagaggttgacgacgcagcgtggaggcgtcgtatccgacgccaccgcggccagatccggtccccccgtgggtggatctggtacctctgcgcgcggatctgaccggtgcaagccgctcaagcagcgacgacgggaggcggaggcagcgacttttggcggtggacgacggccggtaaaggaggccgacgagcgtagaagccgcggtggctcgtgcgcaaggctcagccgatgacggcagatgactgcacgacacaaggtggagcggccgggggcggtggtggtgcctgatagcggtggtgacgctcccgatggtcggcggcggtcggcgaggtgatggctgcggtgaggaggacggaggctgccgtggtgagaggacgaggcgacgggcagcttggtcgaggcggcggcgatggttgcgctatgagggggtgttgaaacctgtggcgagcttccttccaggcgtatgtcctcttgcggcggcggcttgccgccataagatggctacgctggacaggctagtgcagggagaagggatccattcttctctatcatcctcttcctctccaacccaaccacgtggatggatttgaagcgcgacgagggttgagattcttctttgatggtcggcctgcgacgcggtggttgcacgtcgaaggagattagctggtggttttgctgaatctagcatgcactctttagcgtgggtgagtagaacaatgggcaaaggcctagcctttgggtcagcaatggcgacacctgcgggtgccgttttccgttttccccttggggcttgctgcgttttctatcatttcccaataggttcctcgagctacctctcttcgcggccggtggggttgaggggactctcgctggccacctcacactgccaactaccaagcataagatgagaaagagagaagaaagagagggagagaagagtaattaacacatgggtcccatatactgactcagtaagttaaaactaagtcaacgagccatgtcaggaaaaaagaacaattgaaggatagtcaagcctataatttttttcatttttaaatttttattttttaatatttatagaaatattgtaccggcgaaaatatttacagaagtagaccctgccgccctcggcagggtaacgtgagggacggataaaatgaaaaaaaaactagaaaaatgcatttttggcggggtgaaaattgcatttgcccccttgtagcccttgcagagagtggcaagggacctcagtgcaaaatgcgcacaccttgccctcctccaattgggcggaaggggccatttctataaatattttggatagtccgtaaatattaaaaaataaaaatttaaaaatgaaaaaaaattcgtcaggcctatatttctggcccgagtgactggactctccccgcctcggcccatcaatgttctcccgtacgccgtgcccagcccaaccgcggctcaggacgacgctagctcctcgccggcggcgactcagttcgctcgaccgggacgggacgacggctcccctctcccgcgaagctcgccgacggcgacggcgaccgccacatctcgtccatgcgcagctccggtcggaggtacccttctccccgacctctaacaacgagcctcctcctgccactggaatccgtctgtcttggatacgccggtgtttttttacgtcttcttcttctgcagattcctgcctttcagcttcagtcactccatgaagcacacaggtttgctgtttcgtccttttcaaatccccttttccatgctaaatcatcctatgtccttgttcatttatcttaatcctgtttttttcctactatgtaaaattcaatcagattggagatccaccagccctgctgtgtgatgtttgtctcccccactcatcagtttttgatgcgtgtgctcatccgtcaacgactcaacggtatgcacctaaatactttcaattttttttagagcaaagcatgatttctgttttgttctacaatgcttatcagaatagtactagtttttatgatagtgaaatcaagtagcacattagcactgtgtattttctatgttgcaaaactgctctgttcctgatgggaaatcaatttctagttattcaatttcaatatattttcaatacttttagcacagttagtttgtcatttttaactgccattcttaactagatatcccccagcaacatgcggggttgcatccagtataagttaaaaagccaaagccctaacaaatagaatatgctcattggagatattaaaaatacacaagccactcttgtattaatatgcttcttggagatattgcaaatatttttggcatttctaagatgtacaaatatctctcgaatatcataaaaactctatgtattggtagtcacttggcccttttcttttggatcaaggatatcccactttcactggaagcaaatattgcatcattcaaacaaaaagaaggaaacaagaacaggatgtggtcccaccagctgtatatcaaaagcacaaatcacaccccaaaacaatataagtttgtgcagttttgcgagcaaacgaaaattgtgacttgtattttctccatctcctccttaccagatcctattctccagctgcattgcagggtctgtcccagtaggcttgccacatgtacatcttgattttcattgttatcttagctcctccagaatctctccttctccctgcttctcatgcgcataaaaacatgtgccaccctcttttgaaatggatgatttttttataggatttgaactaaatcctccaaaaatcatgtaaaattcttgcgttcgaaaagagcccttagcccttttccgaagagcccattttgcatctgtcctcaacaggatttggccaacaattttcaatcagatcaaatagctgatagttctctccagcttaacagatcaaggaggttgaaaacgctaatccttgatccaagaaatgagaccttctgaagccaaatctcccaaacaccaaagctgcaacagttcttttctctattaagaatttattgcatatgtcaaaaatgtaacggtgcctatgtttgagaggcacgcccctaaccatgtgtcatgccagaacagaacataatcatttcgtcttacactaatttgtttgatttgaggaacagaataggctggtctatcaccaatgacatttgcttaccctctgcacacaaacgagagagacatatgtatattccagaacaaggcgtcaggagtgcatcaagtttttataatcatgaaaggcaatgtcaatcaatggaagtatagcaaatctgaagcgggtaagaaaaatggttagtaaaacaatcaaatcaaaacccaatacatgctgaaagcatgtatgggaaggaatgacgtagatttgatgcagatcaatcttgtcttaatattcctttaactactgtatacacgtgacgagataagtcagcatacacagaaacaaaatcaagggatggatgattgtgatgatcattagctgccttcctgatagcggcttcagcttcctgaatctcctctcctgaggtttcaaatctatccaagtccacaaaaatattccggagagaagggaggttcaccagtccaaaatcaatttcaccgtagacatcaatagtctcccacaccgaaaactgaaggcaaatcctttgaagctcttgcatagcccttggttcaaaagagaggcacattctatgacagtaaaagtgaaattcttgtagacaacggaatgcacatg

SEQ ID NO: 50816 - DNA, 1532 bp, Oryza sativa
aagcataagattcagaatcctaaggcctgttagatcacacacctcttgcagtaagttttcagtgagaccggcgcatgtcagctcttgtagagatgtcatattccctagggtcaaaccatctgccagactaactttgtgagcaatcagccggactaactgtcgtaatctgacaaaagaaggtggtaactgaatcactgagcgagtatctcttatgtccaaagtctgtagaacctgcagattcccaatacactcggggagtttactgatattccctagccgcaggaaccttaggtgatgcaactttgcgagatcattgagatgattgtcctctagattcgaacaatcatccagtcgtaacacacgaagaacacgaaagatcattagaggtggtatggatttgacactgttgaagacagtaaaagacctcactctggacaagctctctctagcttctgctgtggcatatgtattggtggtatagtatgttccatgaagaaaggaatcgttgtctctgtaattgtaagatagtcggcgaactttcttttgaacagacggtaccagtataccttctttttcactatctaatggcattgctgcaacaaatccttcttcagcagataactgatttgtgaactcaagcaccatgtcatgtacttgacaagcatgcacctgaccatcgttttcacaaatgcggccaatatctactggttggataaggcttttattcaggagctcattgaagtaattttctccaatctcctgtaagcttctcccatgttctccctcgttggtaataaaaccatctgctatccaactcaaatcaaaatatccttcgcgataatcgcatcctcgggatatttgcttagatacaataagcaagtcttcagatgtggaggtaggtcatagtaactaagactcagtattttcctcatgttgtccacatcaaggtatttccaagtccaagcctatagaattatttaccttctcccattcctgaatttgcatcggtttactggctaataaacttgctatagtaattatagctaatggtaaaccaccacatttatttaaaatacttctggtgacttcactcaattccggagcgaacctgtcttcagtgtcaaatactctcttgctgagcaacttgtaggagtcgtcataagaaagaggttttagttcataaacagcaccaccgacacgttctgcaacagccatttttcgggtggttgtgattattttgcttccatgatcaccatctagcaaagcaagcttgataacatcccagctgactcttcccatatatcatcaattacacacaagaatctagtcgtaagaagtataaaacacatgtcagtaaagctagatagtaattgtgtcaaatgactccatggaaagagctcccatggaaaggtatctgttagattcagaaatatatgatactatagaaagcttaatctatattttacaaccttgaaattccatgaaagtcgaagaaataacccgaagcgtcagaaccaacaaaaaccattgaa

SEQ ID NO: 50817 - DNA, 2459 bp, Oryza sativa
ggttcaattcttgtcagatggtgctaggccgccaacaatctttagtccaaccgggactaaagatcagcactttagtcccgattgttcataccaaccgggactaaagattaaaaaaaagcgcacaggaccacaggggagggagagccgcgcgcatcgtgttccttagggcctgtttagatccgttggcaagttttttcaccctgtcacatcgaatgtttggacacatgtatgaagtattaaatatagacaaaaacaaaaactaattacacatattgcgtgtaaaattggagacgaatcttttaagcctaattgttccatgatttgacaatatggtgctacagtaaatatttactaatgacgaattaatggctatagttacatttgaaagtttttcacccaaaaaaacttgtggtaatttgttcaatagtccctcaaacttaattactctccgctcccaacttatgtagtttttttagtactccaatgtgcgtcttaattttttgtgaaatttgcttgaagacatttactaatttggagtttttatgctttgaatagagcatgtcctttattcttttgtgtaaaaacaatttagagttttccgatcctaaatcaatttagtaggtaaaaaaattaagtcaaattggaccctaaaaatgggtttagttagtttaaacactacctgtctttgccttctaaaaggagagttgtttctagccacagcccatttatagcctgacaattaatgtctttgaaaccactttataattttcgcttaagacattgcttaggatcagcaggtcacttcatctttgaaatcactctaaattcttgccatctgccatggttgaaaatcgaatggtttttgcaaaagtagggttgaattgtatcttattgtaaagttgatggatgtttccaacatcccccaatagttctggcctccgggagtcaaacttcaccatttgaccactctatccgtttcaggttataagacgttttgactttgatcaaagtcaaaccgcttcaagtttgactaagtttatagacagtaatatttacattaccaaattagtttttattaaattaataataaaatatatttttataataaatttatcttgagtcaaatatattactattttttttctataaacttagtcaaacttgaagcagtaaagtcaaaatatcttataacctgaaacagagagtacaatatatcaaatggtactaagatttgtaacttgtaaatgaaaccattaaatctctttcacaaaaaaaaaaattcaaatctgcctacaatattcatgtattaggtcatagtagaagtttgagactaggcgatatctaaatttatcttaacatggtgggtgctaaattttataaagagtgaagtccatttaagtatttaacccaccttaactatttgccaagtctagaagttaagaaatcaatgtcaactacgatactggacaacttatacccttaactattaaaattggttagaataccccttcaacctggtaatggtggttttcatgttggcatcctaataatatgttttttatgtgggaactaatttttatttttctaagtgggtgcatgcttagttaaaaagtaaatgttttggattctaatcacttaactttgcaaaaacaactgttcaaactgggttgaattgttctttggggggggaggggggtgggggagagtgtattttgagcggttttgggtgttgcggatacaccttgtgaacaaattacttaattcaataaagaacaagtttaagcatccagaagtgtcttgttgctttttcttagtgtcttcattttctttttcttttttcgcttagcaccatttttttcaagataataaacctaaaaaactttctagtacgctaagaaagaattttgtaaagttccattggttaattcctcatcgtttaggagtaattgtattattaggtttggtctaatataatctatttttttacctcttacatgatttgatatgtttggttcgtcgagatgatattacactaacagttcaacgtcaaggaaacaattggagtaactaagacatgtaatcagtcattaggtatgctagcaaattgaaaatgcataggtaaaaatagtgtacaaaatttaaatgaatgtttcatgttggcaacttaaaaatgaaataaatagttcatgataaatcaatgtgaataattgaaaagtatatacataaatgtacctcttattctgcaggatttctctaattttatttataagttggaagtctgctagtccttcaaatatgttggctttgttgtcaagttgatggagtatactctttagaatattcctgatatcagatttgttggacaccaatgcaaagaaatggcaatcaaactttactctgagctcatgaagcaatgcgttggcaatcgttgtcttgccgaggcctccaaatccaacaat

SEQ ID NO: 50818 - DNA, 1349 bp, Oryza sativa
gggactcgatctccttcttcacgcccttctgcagcttgtactccccaaccagcagcttcgcaaatttgaggagcagagtgtttattgctcctgttacaatctccatagttatgtcataggcaagggaacaagaggtgttgagggtgttggtttgcaaaaggtgttcttgcccttggctttatggagcaccagcttccaaaggcaggcataaatggctagatggttaggctcgatggaatataatgatcaccaaagctacttttctcttcttcttttttattttaagaaacatcaatcatcaatgagtagtttagttgcattattgtactagctagaacatgaccctaacccgtgaaccatgactattacgtcacgtccatgaggaaagaaaccactactttaattcccaaagtatgaaaccggatattgtaacctgaagtgtaaatagttacggaggtggccttcatatgccacggctatttgtaggatcgaatcataagaactaagccaaccagagggggggtgaatggttggtatacccaaaaaccgaaaatttttatcggaaataaaagttaccctcgaaatcgatggatcgcggtttgaccgaagtagttgcaccggtctgaccgcctgatgaacgtcggtctgaccgatgtagatcgatcagtcgaaccactgagaatgcctgccgcgcctgtcgccgctgccggtctgaccgccgtgtacccgccggtctgaccgccgcttgccgccagtctaaccgccggtagatcgccggttagaccgccgaaacccggtaaacacaaatcgaagaactcttaaagtggatgacgactttattgattctctctgtgtttagaaagtgcaccaacagctctccttacaaaaatttcgactaaactcaaaaccctaactaaaaactcaacttaattgctctctaaagcgataccgggaagcctcacgctccccctctatttatacatgaggtaggcagcctaaagccacgaaccaaactcatactaggagtcctaaacaccttaggaaaccctctagtataagaaagaaactttacataaccaatcgtaccaaatttggactccttccaaattcgactccgcatcccatacgcacacaataactccatcgtatgccatatggaatctccatcaaccacgtgcatcaactctagccttagtatcccgtatgatctctgactgccacggacgtcgtcttatccccaagccgactcctggtccatcaccgcaaatactctcccgagacatcgagtcacctacacatggaacaaacaaagaaaccatattccgagaccaagctatctccacttgact

SEQ ID NO: 50819 - DNA, 1632 bp, Oryza sativa
ataatagtaatcaaaaacttctttgattttacaatctcccccttgatgaacacattggcaaattcataaaaatgttttggtgtttggaaaaataaaaacaaaagtggtaaaaagcacacttcgtacaattgtacacatcgtgctcaaaaatccaaaagaaaacttctccccctttttaaaagaaagaaattcccaattgaaccaaaaacatgctcttctcaacaactcttcaaaaaaatttttccttgcttctccaaaaatccaaaaattttcacattacttctcccccttttgacaatgatttcatcaagcataggaattaggttcattaatgttcaagagctcagcatacatatagcatatcatgtcatgtgttgcaataaaaagaagatgaacccatctatatcataacaagcatgcattaaagtataaccatgaaccaaagattttacaattaagcttgaatcaacaatcagaattcatgattttaaatgatttataatgcaacatcttaacaagcacataggttgaagaataaacacgaaacacatatatctattgcatttatcactctttctcaaataacctttagcacaaaataaccaagagaatttttcaactttttcttttcttgagcctttttctcatatttttctcttttattccgggtacgtccctgtcgtcaagactgtttccagggattcggcacccattattttgctcatatcgaatacgtccttgtcgtcaagactgtttccaaggattcagtattcatttttttcatatttttattctctttttcacaatgagcaattaaagctatttaaggaataacaagtcaataaagcatatatatagagcatttataaatcaaaccatatgctagcatcaacattgcatattttcttaattcaagtaaagaatttaagtgtcatgcatcatctcccttaaaagcaaaatctaaatatcatgaaaagactagaatacatacaagctatgctagagacaaataaaccttcaaagtattgctagcatgcacaagaaaataccatatgcataaacaaaagctctcttttctcaatttttatcattgtcatattattgcttgctaaaaccatgaggtacaaactccccctcaaaccatgccaaaagaatgaattatgcccaattcaccacgaagaaaagtaaagcgattagaatccaaaggtttagtgaaaatatcagcaatttgcaacttggtgtccaaaaactgcaactcaacatctcacttctcaacatgatccctcaaaaagtgaaaacgaatatcaatgttctttgtgcgtgagtgttgaacaggattcttagcaatattaatagcactagtattatcacaaaagagaggtactttctcaaaagtaagaccataatgtttcaaagtagataaaagccaaagaatctgtgaacaacaactagcagcagcaacatattcagattcagcagttgattgacaacactagattgtttcctagaagaccatgcaatcaatgatgtaccaagaaaatgacatgttccactagtactttttctatcaattctacaacctccaaaatcagcaccagaatatccacttaagcatatagtagatgaagtaga

SEQ ID NO: 50820 - DNA, 717 bp, Oryza sativa
cttcgtttgatgcacaaaagtaccttgaggttcaaaagaagcaacaaatgcagaatttgcacaaacatcatgagtcgttaccttagaccttgtagtccgctcacctatattaccaataatttgttcaagcggatgtcgtcgttgaatgtgcaaaggagccgtgacttctgaagttgatccacgttctgtattagtactggtcaaagtagtaatctccggaggaccatctcgatcagcatcagcagtacccgaacccgacgaccctggccggtctgaccgctcctcatgagccggtctaaccggaggtgtgccggcggtctgaccggcctagcgctcggtctgaccggccgagccaacctcgtcgtcatagtcatcgtcgctctcgtcttcaaaaatacaaccatcctccccctgaacctgtgacagtgtacttgcaatatcgggtctagtacctggactagcctcatcaaaagaaacctcgcaagtctccacgattttgttagtccccaaaataagtacacgatagccacgagtatgtgcggggtaaccaagaaacaatccatcggtagaacgtgcctcaaacttatccaaatttccagatttcaagacaaagcacttacaaccaaaaacacgcaaatgtgaaactttgggttgatgaccaatcgaagttcataagaagtttttctaagtttagatctcaagaaaactcgatttgaa

SEQ ID NO: 50821 - DNA, 13772 bp, Oryza sativa
ttcagggacagcctattcaccccccctctaggctcatcagcgcgttcaacgtgcagtaacaacactaaaatatagttcaaatatagtcacgacggatctacttttgacaagtactttttttctagcatcatagtgcaaatgatttcaaaaaataatgcatattttgcgagatattgctcttcaaaggttagcattttgaagtttaatcctccatatgtagtaacactatagcattactattactaccatttgttccgtgttactacgagagtgcagtaactactacaacttttacagtaacagtgtgttactgcaattgcttggtaatgttaccacaataacgtaataacaaccaataaattttacatagagaaaaaaatagttttctttatgatgaggaggacatgtgagagacgaggggtggtcagtgtttgctcgaatcgggaatattaggagtgtaattggaggccaagaaccgccaccaattttgctcaaactagtcaaagtgaatccatgatgactaatctcgttcaaactcctaagcggatgcaacattcatattgtgaaaattgtgcagtaacgttagtgcccgtgtacattaacaatatatgtgttttgcagtaaccgatcgttttactgcaattccatgatgatgttactaagaaattgtaacggaattgatttgcttctttcatggaggtagaaataatctaccttgttttttgtttgaatagcttactaaacaatatatgatagcatattagaatgaaaatgatactatacaaattgtccaatcttggtcaaaccctcaagcggatgctacatttatctagttagaattgtgtagtaatatagtgctaaatagcagtaataacttgtgttttgtgtattaaccgagcatgttactttaattccgtgatgatggttactacgaaattgtaccatgtatcttaccgtgctaaaattaatttactatatgtttttgtttgaacaatgtattgaatggtacggatgagggaggagagtgcagataaggcgggtgaggagagatgcgtgacatggcagagaaaggatgtgttttcacatgataggataaagcctcacgtgctaactgtatacttgttactgcacaaaagtataagtgttactgcatgataggtgtatgttaccacttccaactagctatgttactgcacgataattgtagttttactatgtcatttttacgagatgaagatcgaataggtgggccattggtaaagtctgtaggtggctttgagcgaggtctgattgatgtatgagtgttttgaacaattttatacatttggtaaaaccatgttactgcatgtatatgcccttgttactgtaaattatacattctgttactgcatgtggagggctaaagttcaaaatattctttgaaaagcaatatcttataagatatatattatttttgaaaaccgtttccaccatgatgctatagtgttactgcatatggagggtttccacactatgttactatgaaacttataatcgttacagtaacgacatgatgtgattacagtaacacaaaacagttagtagtaacacttttgatatagtattactgcttgtggagagttaagtttttaaaacatatctttgaagggtaatatctctcacatcatatactacttttaaaaaccgtttgcaccatgatgttcgaaaaaaagtgcttatcaaaagtagatccatcatgactatattatgactaaattttaattttgttactgcaagtaaaacacggtgttactgcacgatgaacaagacattactacgtcgttccgagacgagagctaagaagagagggggtggtgggaaaagtcaccggtgggtttgaccgacgtggggaacctttgaccagcctttaactgaggtgggaggtgggttttggacccttggggggagaggaggtgggttggagggaggggggtatagaacaactattttataccttgggtgtagaatagttttttctatatatatatatatatatatatatatatatatatatagttagcgatttaaaaatcaatacttgaaaaataaacattgataaaaaacttcaaatcaacttcaaaattaaaatttaaaatttaaaatttgactatggctgatttctatataaaaccagaccatatgtgcaatatagtgcatcggaagctaatcctttaacttatctgcacatataaggtctgtttggagagcttaagattctgataaacaactgattagtagccagctttcttaaaaatttggaaaagctggatttttctacttctggcttctaattcattctggattctatactataactcgtgagaatcatcaatcaataactcccctaaccatcccctttttctccgtttttttaatttttttctggctacctcggtgattaacacgtcgccgttttgcgattacggctcctcgagagcgcgtttgcgaccgggaaaacgcggtttaccggtaatttcactgttaatctcacgtttgaggatgcccgcgtggcggtttcctccaccgctggtgtccggtttgcgatctggttattttgcaaaaaaatccttgtctatgtataaaattttaaactaaccctcgtactacctgacagcctgttgtacttttcacaaaaaaccccttaaccttcagagaaatacaatgcaaagaagagaaaaatctgattttaggggtagctctgtaaaaataacaaatacaagggttttattgaaagataaccacgcctacggcctaccccccacaccccgagccctaacccaatcgtttcccgttccccacttcctccccactgcgccccgcgccgccgccggcctggggctgccgcccggccgccgtcgtcgccgtggtgcggcctccccctgtcgccgccttcgtcctccgcctccccacccccctccctcgccacgccgtggcgtgagccctctctccgtcgccgccgtcattgaccgccttcctccgtcctcgccacgtccccctaagcaccaccaccacggcccttccctcaaatccgcctccgtcgccgacccatccgcgccgccgctcgccctcccgcacctcctcctccccagtgatgtctcctgcctccatccccacctcgtgcaaatcgggggaggtggacttcggcgtggaggaggtcggcggcgtggaggagttagcgaacctcgagtcagcacggaggcgaagcggagtttgtcggtggcggcggctgcagtacgaggccacgtcggcgtcgttcctgccgatgggtggtcgattcgacgagcgtgctgctaggtacgcagccccttcgtctttcttcttccctgcgacccgccttttttcctttcagcatcgggtcagcaacgtacccccccccccacgccgcccctctcctccgaccttccccatgcgtcggcagccgcctgccctcgcctccgccagtcctgttgttgccgctccactcccctcctcatggtcggacgggttcgttccgtgtggcggtcgccggcgggggccatgatttggtggagttgagtcgattcggtggatttggggagtagtgtttcttcctcggtttagtctcttctttccctcacaagttgtggctgtttctttgggtttcttctcctatgggtttccttccgctgtgtttgctgactggaggaggagctgaggatgctcggcgggatctgcgcacggtggtcggggatggcgaggaggagaagcagctctgtcctatctgcctcgacggcatggaggccgggcacgccgtgcggcgtgcgcgtcctccccggatgtagctgcgccttccatcacgactgcgtccaccggtggcacaccatctcgccgcgctgcctcgtctgcaacgggtgggttatgccgccgttgccaccgcccgccaagcctgctctggattcttgagatggcagcgttgccgccctaccgatcatggctcagttcttggttcttgacgagttcttgatgaattctcggcgattgtcatcgtcggtttctaggctctggacagcggttcttgccaatttcttgttggctatcttgttctcttaagtatgctgccttttagaacttgtgctttctggtcatggacttctataagatgattgatttgtatggacaggtgagttgttctataaatctgacatagtttcagtggatttggccaccgctgacgatagccaccgacagctcgggttctctctgctatcaatgcttcttatttggtatgaattctgaaagctcatttggcgtgttatctgcatgagagtttatgatgacatgtttttttgttcagaccagtgcttctgtttacagatttgttggtctacatattagtaaattcagatgagctgatgaatcagggaattcaggtaagatcatgacttccagcaatttggtactatacaacaaagttttgtcctattgtcctctttaatatgtatttcaataatgctgagtttattttctaatttgtcaaccatagcgagagatatcagtaaactgatttcgcaattgtttttgtcgaactgctgctgttaataagagttctggagtaatatatatttataggtacacaggatggttaagtaaatgtacttatttagattgctatgcctaacatccttagtttatttgatgatgctacatccttcttcaactttaaggtctgctatgcatctttgtattttgaaatcatgggccattgaaaatgtagcactagcaattactttgtctcttgtccagtaccttttctagatttctattctgtacttatttgggatgatttttttgttacttggaccaactagactctagagcgctgtgtgtgtcttttgatcaatgctgaacagtgcttataaaataagtgttgtaaacacagtgctgctttgatcatgtatttgagcctaacaatctctagatgcaccatgcaaaagtagttttttgttttgcccttatagctgttagacataagaatttccttactgttcgactaaaaagttctctttctacttcgataaaagaaaaacttgatgtgaccaggcaaacatgtcatcagtgcttcatataatagttgattctatgaatttttttttagtttcaggtataaaaacgacttggacttctatttcatggagtcatggttaggaataaggaatattctatgaatattccttattcccaaatttgaggactctagcatggacatcctaggagttcctacactggtgggtcgttctcaagaattcttcaagccgagttgtttctttctcttttttttcatctgatctttatctcacatggaaccatttatttccaggatattaactacgtcattcagatcccacagtaagctaattacgcccaacgatctaacacaattcctttctcagctaattatgcactcttttgtcaggaagagctgcattcctggttctgctgtaactgagggttgatctgcctgatgttgatgtgctgttcagctgttgctgttatgaagtgggaatctctattaccaaatgatacctttcttattgttgcctcctctgatggcgcatttgagaaaatgactatgcaggatgtctgtgatctgatgttgtacgtgaaacttggtgttaagcaagaattaggatcctttgcagtaacacaacagaatttggcggattatgtagttgacctttttttatagatagggacaacggacaatgtagcagctgtgattgttccattgggatctcattatagctctaaagttacactaaaagattggtacatatgcttgaagaaaatttcaggacatatatttcaccattacaaaccattccaaaggacatctatttcaccattacaaaccattccaaacaacggaagtcaggtaggtttaatgtacaaaaactcaaaaagttcttttttatcgcaatcaattggcaagttggcaatttgtagtcatgaccacttgggcaatttttacattatgttttgtttataagattgagcttttcattagttttgagaaataataaattactccaataatttgctattgtattacactatctatttatttcaatacatttttaaaattgaagcttattttgtttacatagtcatccgctacgtgtttagagtttgttttgattaagctgttaagcatacttgcgtgcgcagctgtgcgcggcgtggcgcccccttatacttctagtctaaatcaaaagttgaattgtttggggagcttaactctcccacacacacgaccatagttgtgagtggctcaattggatattctttcctagcgcgtccgtaagtccgttgatctcctcctaaatgcaaatgtgataaaaaaaataatttggcattgggaagtccaaacgtcaaatatccacaggccacaggggtgcatccttctaggcttccattccattccattctttaattccccccaattttatcccccacacactccactccactccactccactcttttcgctcgcgtcgcttcccaaaccctctctctcctcaaaaccctagcgtcgcccgcttcgcctgagctccggcgatggacggcggcgaccgcctcagcgcgctccccaacgacgtcctccacctcatcctcctccgcctccgctccgccgaggccgccgcgcgcaccagcgtcctggcccgccgctggcgccacgtctgggccaccctcccggagctccggttcaggatggacgtcagcctcgccgcccacgcggccccggccctccgccgcctcgaggtctccaccgacgcggacgacccggcggcgtcgacggccgcgctccggctcgccgcgccgcgcgtcgccggcgaactcagcttctgcatctggccgcggtgggacgacgcgccggaggaggatgacgggccggcgccggtgaggcgccccggcgtcgtcaagctcccctgcttcgagaaggccaccgagctctggctaatcctcggcctcctcggcgtctcgctgcccaaatccggcgtgttcgcgcagctcaccgcgctcgccttccgcgacgtccgcttcaccggccgctgcgatctcggcgccgtcgtctcctcgaagaggtgccccgtcctgcaaaagctccaagtccacgactcccaggatctgtataacctgaccatcttctcggagtccctcctccacatcgagctgagcgacctccatggcgggatggggcggctcatgatcgtggcgccgctgcttcgggttcttgatgtgcgccattgcttctactggaggacgtacaggtcccattcccttgttcgggatcaaccatatgccgcggtcttcacgcccgcgctggaggatctcatctgggttgatgcgtatgatcctaccacggtccaatttggcggcgttaaacgcctccggaagctggttacccaattacagtgtatggactctctcgctgcactgatcacatgaattcagtaatgctcttgcggcgatttgagacggtatccattcttcagctagaacttgactatccagaggtaactgcacattttccctaaatctggcatgaatgtcattgaataaaacatagagattgaaatatttgtttggtagactctagtcatagtgtgcatggacttcattcagatatataccttcataagtattgacacagctgccctggtgaaatgtgttagatatttatcttttatgtattgaaacaattgcccttggtgatgtgaaaaatagcattttggaggtcctggatctgctatcgcactggtactgaacatatgagatactgaggaacggtattgatcaaccagatttagccaaagaagactagaatttgagtagtctgtcccacaaacaggaagtgggctcagttttggttctatgcatgaatggtggaatatagagtaagacactgcagatatttgatgctgttctgcctatgtaaaactcccatttgtcttgctgtgctcaagtcttgtagctgtcagcttcttgaggctcttctctaaattatcatcattgggactcgcatgtttattaaccatgtttcaattgttagcttgaaaaatccagttttctatcagttgcatttacgaagtattatagtttgtacatttcactatgcatggtaaaaattaaaattaaaattatagtttgacgcccataatctgatattaccttttagtagataatccctccagtcttgaatatttgacattccaaacatacatttggccaaacttttgaaagtttcaccttttgtcttttcccgtgtttacaagaccatgttgattatccaaatgacaagatatgcagtaggcttgtatgaagaccctgatagaagatcttaactaattaaaagattagtatttttccaatcgtcaccaaaattagtattagtatttttcgtccgtatgtgcaatttttttcactcgtccgtgtacgatctcctcccaaaattttggttcattagtacacgcgagatcgagagaccgcatcgctcccgtcccgtacgcgcgtagaagcccagaactaatgcacggaaacgaaagaaactgaatcacaaatccaacaacaataaagcaaaaccatcccaaaaattaaatcaccggggccaaaaaaaaaggaaaaaactgcaaaaaaaaaaaaatcaagcattggccggctcggcgaggcaatggggaggaggagacgaccatcggcggctcggacgcagcccagtgcgcacggtccaccccctcaccacgcacctccaaatccatggacccgcgtgagcgtgtgggcgaagagatgacggatccatgcgggaagggaagaggtcgctggatccacccctcccatcgccgccaacggcggatccgcgcgagaggagggtggagagatgacgggatctgtgcgggaggggaagaggtcgccggatccgcccctcctgtcgccgccgacggctgatccgcgcgagagggagacgaagagacgacgggatccaggcgtcggtggtggatccgcacgagcagcatcaacggcttggaaccgttgcatgaggaggccttgccgttgcccccagtcagccactgcgcttcttcatcttctcgctgtcgcgcttctccatcttttgccgcatcaaggagaggaggcgccgctggccgctgctgcagccggtaggcggaaggaggcgccgctactacagggaggaggcacaagggctgagtatgggaggatgtgagggcgcacgctggtggaggcgctggatgcctggatgacggcgtgcgatgtgaatggggaacgaccgaacgagtgagaagggagagagacacagagactgggatagaggagcctagagctctttgagcagaagacctcttggagctggcaacctcctcggtaatgaggtacgagcttcagttttttcattaaaaaaaaactacgaccggtcaaagttcctttctttattgtgctattgattttcgctgaaaaaaagtttttttagatacacgtaagagtacttcacaactaatgatgatttttctttattacttatattgttgacatcaaaatcacttgaagtttcagtaaatacaaaatatttgtttgagacaaaaaaatatcgattgaaaaaaaaagtttccacgagataagccaaattagagtattcgcgctatcatccacatgtcacatgacctgtctccacgtgagtccacgtataattttgagttgacagatcgagaaagcatgcatgaccactagagactatgagtaaatatgcaaaactattttcgatccgcgacactgctacatgatatattttcttggacgccacccacttttgtttacatgcggtccgtaagtagaaccgcatggaaaaatagggggacaggcgccgggctgtcgcccgtgggcgacttaagccaaccgcacccgaattttcacctgcacgggcccaccgcttttaaccgcgcccgcacacatctccccctccgcccgctcctctcctcccacctccctctcccatccactcctctcctctcctcccactctcctcttttcccctctcccggccggccggcggtgcgacagcatgcggcggcgcgcggcccctccctcaactgcgggtgggaagaagggcagcgagagcatgcggcagcgggcgaccacggcggcccctcccctctctccccttgcggatccggcggagggggcggcggatccggcggcacgcaccccctcccctcctcccccttgcagatccggcggaggggggcggcggatccggcagcgcgcaacccctcccctccctccccttgcagatctggcggaggggaggcatgggtgcccagcggagcggcggcatgcgtcagcggccggtgtggaggtgaggcgatggcgtcggcgaccggcggatctatctctccccctcctctctttgttatttgtgattctttgttatttgtgagatgcgttcttggagttcatttgttgctgtgagatgtgttcttgtgatgtgagagttcatttgttgatgtgagatgtgttcttgtgatgtgaaatcattgtgtgtcgatgtgcgactacagatccggcgccggcgaccagaagggaggttgtcctctgcatcggctacgacgatgatgacctcgccctcgtcgacgtcacctaccccaagcgtgacgtggacaacatgcagtggttccgggaaatcacactgctataccgtggccaccgccactccgcaccctttgtcctcggcctcatcgtgctctgtggccatgcgccgcccaacaactggtgcccatgggggcgagaagggcgtgcgcggccatcctcgggaccccggcaccctgatccgctacgtcgcgatctacatcggcggctcccatgccttgtgtaccagcccgactgcaaccagtccaagtacaccgtcagcgtgcttcctttccatgaggacggcggaaggatggcgcggcttgcagtggctcgcaacaaactaggcttggcttggctcagctcagttagggaaacaagctaaaacttgagctcgcctcggctcgttttctggctcgagccagctcgagctgtcttgcaagccttcctgttgaaacacctcttcatatatattttgtaattattaaaaaatcaagaataaatcatttaacatgtaaaatttaaataagtttatatattcaattcttcaaaatcttaatgataaatttcaatttgacaaataataacgccacaaaaagtaaaataatcgatataaacacatgatggcctaggctcgcaagccaaagcaagcggctcgcgagctagctcggctcatttcagcaatgagctgaaaaggaggcttgggcttggcttatttggcttacgtgctgagccaagccaaccaagctcgagccaagcccgagttgagctcacgagcctgagctttttttccacccctgcactaacaaatatccaacttttacatcccaaaaagttactcgtgtagtgtcccacagctaattaaaaccgtgaagtcacgatgtcctgtagcaaaatttgcctatttggttttgttacacagaggatgagttaatttctccatatcttcacaattttcagctcatgttttatgaagggggcaatatatttcaactccacacattttcttcacatatcaacgcacgggtatattcctatagttctctcatttttttaaggcttatctgcttagaaatatatatcccgcaaatataaagaagattaattgtcaagaacaacgcgactttgatcaaacttcaaccacccactatcatctgttatccgtgcaacgcacgggcattaagctatagtaataaatttgtcaactgtaacaaaacaacttatttttaattcaaggtggtactgtttttcatattgtttattgtggctccttatttgtgaatgtgcagatgggccgcagtcagtatttgatggaagccataaccatgctgccagcaattgaggtcatgtccctggagttgtcaaaaagagggcacgcttttgggcagtgtgttttccatttgctcaggatgtccactggtataagaaagctgaagcttgcattacgtggaggcctcaaggtaagtacatactttttaatattgtactttggttgtggggaattgatggaagtattttaacttttgcatgatggcttgatcttctaatggtcaggactctgaggagaggatcagtgttttgtctacctggttccagggacaccaggtaaaattttcaatctacactattagctgataactagtattgctctgtcatatgtattgctaatacatgtatagcacgcccagtaattcctgtacttgaatagccactgctaatggtgatatgagttttgactatttgaggtgatactttgctatgtaatttatgtagaagaggtaaatgctaaaggatccaaacatatttttgctcaatttgatgtgtatttccaaaattgtgaagtgttgtagttctttttgggtgcctggtaactgttaatgttagactttactgactgaacattgttcaggaactattaacgaatgatcttcatgttgatgaagatggtgcttagttagcgatctggataaatataactttaggcatgaatgtgatgtagtatgatgaggggaatgctcaaagaatcatgaatacagtctatctctctttgtttaagacaaacgaattgattgtcaagtgcatcccttttgcagtttttggatttgtttgatttcatttataaactgtacagggtactgttattttctatgaatggaagtcttgtcgcctcaattgttttgcctcaaaccacgtctctcattctattgttcttgtacaatagctgtaccatactttcggctggtttgactgtctaattactattctttcacctatactccaggcagatgctcgttgttctgcaagttgcatctgtaatcggccacaagcctggaaaacagaggacctcttcttggattctctccaggaagtggaaatcagtggattcagaggatcagagcatgaattggccttcttgaagcgacgttttggatgggcagcaattctgaagacattcaccatgcatcttcatcttgatcttactgtcagcgatgatttatgcaaggagcttcttagcctcgctacccctgagaccgatgtgaagatctacttctatcgtgatgatgatgttcacgctaggccagcttgggtgttgtatacaccagaagagtaaggcaccaatcggttgaagcctggtactaagtacttaattatgcagggtatgctatgaattaccatgaaactggatcttatattttgatgacactggatgttctgttatgatcgggattaattcccatactttgccctgcaaggttggcatgaagagatgctggtttacctcttctcatgttgtgatttgctgctttgcgctctaattgccatttgcaagatgatgtctgagatgactttgtagcatggatatgaactaggtacctgaatgctaaacttgtttaccgactagagaaattgcaacatatatacatcgaattttggatgctctacacggtgaactatgagctgggtactagtaccacacaagtaatatgattttgcaacaaaatgcagatgctccataaaagtaaatacgtttatgtacctttttacgacaaaagtacacattgaaaacttcccgagtagaaatttga

SEQ ID NO: 50822 - DNA, 4167 bp, Oryza sativa
tctcctctcttctctcgtctcatgtgtttattactaccttataaacaccgctttcctcgtctcttctcccatctcctgtgtttataactaccttataaacacttttttctttactgtaatcaggagtcaggacatagacacttgaattaaatttgaaaatatattattcatttgttttttctcatcaatattcggtacgcaaatatttttggtagaattatagcgtcgatctcatacaattgcgcgaaaataacatggtctcgagcggggacggtgcaagacaggtctaccagcgagcgaaaccgaacatgctggtcgattcaaattaattaattaccaggattagcgagtgattaattatttattaacagctaactagggtaattaatcactaattattactaattaatctctaattatataattaatcactaattattaactaatcgctaattagggtaattaataattaaataagtggcaccgttggacaagacgttaggttttgctgttccattctgcgtgaccgcgcaagaccgaggtgctaacggtcgtgctgttccattctgcgagaccatgcaagaccgaggtacaacggttgtgcgagatcgaatgcatatttataaaaaaattacatcttaaatatttctaagaaaaaagcaaataaacaatatattttcaaatttaattccacgatggcaaaaatgataattagcgatcaactacacgctcaactcagattttctgttgaactaatacgccattaaattggtctaaagtttattcgtacgtaaaatttgtaggtacaaagtttttatacgtacagattatttatctataatgtttcacgtattattttttatatataaagtctacgtataaattctgtttttgccttgactaaaatactactcataatttattaggcctaagattaaacctagagaagtgctaagagctgagggtcagacgctcggcggtgtatgggctggggtgggatgcgatcgtgcggctcctaacgatagatcgatcgcttattagcaatctcccactatggggcaatttggcaataaaaaatacggggtgtagtgaaagtggacatgcggtagtgtggcgggaatcatgccgattgactgcactgtgcattatcgttgcctactccctgagcaacactaactcagtgtcgctgaacctccatgcgagagcggcttgcctcttgacaactctgtaagagagggactagctacatgaagagattcgaacgggttgcaagagtggttgttcgttgggtgacattagcccatggagccatgggacaccagcacgctcttgccttatgtctttggcaatgtccttagccacggagttctcgttgcctcttcctgcggcaccaactcagtgtgaacatccctcgaggcggcaccgccggcatacactcgtgtcgccttcgctactagcgaaatcgagtatatcttcacgatttcttttcgaagatgacatatgtttgcacgatgtcatggaggtcgctcacctcgccgccgctggggtctccgtcctcgagctcgcccgcgtggcgatgccctcccctagtccccttctcctgcgtcgccgccgacgtcgacgccctccttcttctctcgtctctaggcctctccaaccccgagctcgcacgtgcggaacgccctcccttctcccacgtcatcgtcgtcgtcgccgctgccctcctcctctcccgcctcgcccaccctgtcggccagcctacaggaagagaagagtgagagagaggaggaaccgaggaagggaaagaagaggggaagagagggtgatgacatgtcaccaaacatgtcatggaccccacgctgactcagctgccacgttggatgaaaccggggtcaaatcacctgaggacccaaaatgacccggttttgtaaattgagggatgacatatatcttgttttacggttgggggatgattttgtaattcgatgataaggtgagggacctgtgatgtacttttggctactactctaaataagctggcccaaataggaaaagatcgcgtcggccggtggagaacgaagcccaaacgaacgcgaggcgcctccgatgtacacgtggcgcctcctccgcccctacaggtggcaagctcaaagcccgaacccgaccactccactgctctgatgctctctctctctctctcttcacgcttcccacgcgcgacacgaggttggagacgcgtcccgtgacgtcatcgtcgtccccgactccggcgagccccgcacccatggcggcggcggccgcgaggggcgccgccgcggcccgctccccgctcgtcctccaccgccacccccaccccgcgcaccaccgccgcctccgcctcctccccctggtcagtcactccgcccccgtctcatttcctcctcgatctctagctccctcctcttgggagtaggcgggattgggagctacctacctcgtgcttgattgaggtggtaattcggtcaactactgattggggttgcaggtggcgggcggcgggggaggctcgcccccgcgtgtggggaggaggatcagggccagccgggagaaggggcggcgggtcgggattagggttttcgcgaggtacagccaggcccaggacttctccactcgcctccaaggtaatcgattggttgatttctttccccatctctgtataattcgatttggtacttggttcaaagccactgtttaggcccagcttagttgaacatttgaacaagcgactgtttctcattaggcaggatacgggtgatgatgtaatatgaagcgagaatttccggtgtggattttcacgagtcgtgagtttgttttctgttcatcgcagtagcatagagaatgttatgtattttgggattcgggtgggtaaaatgtgtgtctcttcagattaatgtactccttattaacattcctcacaaaaataagtagttatgaacaatcttgggatagctagatcacagatgcattgaatattaagtttgtttgttcttcgcaaaatcatcccatgtctttgatttcgttcaaatgcagatagagctggcgaattgcctaagttggttgaggaccttctacagacatcaattagcacagggccacgaggtgcttttaggtttgcccaagggatccaagctgtccttggggttggtggggagtggctaaatgacttctcaaaggttatttcttgtttgtgttattcatctattttgtctaaaaacttgatcttagaatttctgagaactgaaacaatggaagcagctgtagactgaactactaatgaactactgatgtgttgagttggctgaggttgtatgggagaatattggggatttagggctagtctagatgtggatttttcatctatgtagaaaagaggaggttaaatttttgttggtgcacaatgaccaggtttatctaagatattttttttattgataactttggtttcagaagcgtaatatcctgctgttaatatgatgcagacagccaacacatcagcaggaataccagctcagatgcagctgggtttgctttctcctctttatcttagaaggctttttgagcgcatgggtgcaacttatatcaagctaggtcaggtaaggacatgttcatactttgcggtttatgctatcatcaactacaaaatgtgtccatctcaaaagaaaaaataaactacatgtgtatgtgttccttaattaatagattgtcttgaatttcttaatcttctgtaccttttgaaagaaatgccagaattcttcattttactttgtatatgtagcaaacagaaacaaagaccactaatatatctttcagcaacccagacaatagtcagttgcttacttgtcactagacaggtagagtaacctatctttagagtggtcctttgggatgggcaaagggagaggagttaaaatagttattcagtttaatagtcatatattttatgattatttcaacctggatagtcaactgactgtggtggtgcagttcgtagcttctgcaccaactttgtttcctgcagagtatgtcgaggaattccagaactgttttgaccgtgcaccacctgttccatatagtgagattgagtcaatattgcgtgaggagttgcaacagccgttggatagtgtatat

SEQ ID NO: 50823 - DNA, 3737 bp, Oryza sativa
  unsure (1)..(3737): unsure at all n locations
tgaagacactttggttgctgacctgaattttatctatgtttttgcacgtattttggaatttctaaaccctgaactacagaggacatcactggtgagttatcgcctaatgagtctttcactggacaggatttttttcattcattgaacaatcactggtcctggtgttctcggagcgcaggaaaccaaaatttactgctttctttagtataatcagaagccagaaggtcaaaatatatttttgtttgattcctgtatgcagcaagcaatgcatgccatgaaattgctcccatgaccatgaggatatgtttttcttttggtagttgaggcaagatcattgaacttttcacagttgatttacatgtatttttcaattctagccactgtgctagagttggcacaattaggtgcagaaacttttaatatctatatccttaaaatttattagttggattgaaggcaccacaatattcctaagatcagaaaaaatatgagtttaaaagattaacagaaaattcagaaaattctcccaataatcaagagagaaagaaatgtcttgccacttgcgtgttgttttgatggacctagattgtaacctagtagattaactatagttgttatagttgtgtaacaaatacaactgcacctctaatcattgatataagagctttatagcaaatggaattattgttaaatgtaatcatgcaactgcatggatatcccactaaaaaattgaatatcgaataaggaatatttcatggtggagcacaatatatcttgagcttgtgacatgaggagttgactatatatattattcacgtactataactaaaaaggaaaaaaaacaattagttcacacaaccagaaacaaatgaatacttatactttgtagttcatatatgtggaagtagagacagcatatagcaatcatgaaattttctgtatacttggttatccaaattttgtggtatcacaagttatagaagaatataataagagatgtccttatgctcagaattttatattataggtaggaattgtcaaggatataaaggaatctatgcttgaagaagttgatttcaggaaagaggctatgaatattgaggcttttcagaggtacatcgatgcaatgggatttgacaggcaggccaaagccccttttgtgtatcgccactgtagcacaaagcgtgtcctaactatggaaagattgtacggtgttccactcactgaccttgattctataaggtctcttgttcctgatcctgagctgactttagtcactgcacttaatgtctggtatgctccatgcgtccttgtgattccatacatcatatatttgggtatttctgccattcattgccttattcaatcctcagaataggcatgttgacatatgtgcaaaatgtgcaggtttggaagcttgatttcatgtgaatccttccatgcagatgtgcatgcaggaaatttatggttgctccgagatggacgtgttggatttcttgattttggtatgtaacatattctccaatctccacggtggcacggttgctctatatctcattaggcaatttaggatgcaccttgtatttgctaaaaaaggaaatattctggccttttaattcttacattatctattagtcaaaacacaaagtggtcaagaaagtttatcactattggttaataccatttcacaggaattgttggccggaatcgccaaggacctgggctgcaatggaggttctttttggcttttcatttgccanctgacgattataatgctatggcatcagccctttctgaaatgggtgctacagggaatgatataaatgttaatgaatttgcaaaggacttggaaaaaatattctcatcaatacaggtaatatttccaaaatagtaggttatttgatgtcatgaaggcctggtatcccgtgaacatggtgacccaatttcgactgttgaagtgccaaaaatgatgccagggtgaaacctgggctgtgtttcacaccaaaattggaagtttggttaaaattggaacgatgtgacggaaaagttggaagtttgtgtgtgtaggaaagtattgatgtgatggaaaagttggaagtttgaagaaaaactttggaactaaacacggcgctggtctggcagtagtaaaatgctgaatgcaagcaaaagtggcttatggacaggaatttttgtggctacttgggctagtcannaatttggattatcgtttcttttagttaagtgttttaaccacttatctcgtggttaattttcaattgcattctcatttgtgcgcaggatttggatactgaagtcatagttgcaacagcaagaactcctgatgctacagcagtatcggctaatgttgtcgtgacgagagacagatgaatgcattgtttcttgatctggtgagctactttcttttctctctcggttagaacaaggtagagagaacttctaccttatacattcgtatcactgtatgttcttgttggtaaatgttgcctgccagcgtgtattgttttcacgaaagaagagagatgagggaaaaaaaacaatgctgacaattctgttgctctgcgtcttccaggtgagggtagcgagtcgtatggattgaaatttcctcgcgaattcgctcttctgatgaagcagcttctgtattttgatcgctacacaagattgttggctcccagcatgaacatgctgcgagatgagagggttaacattagctcccgccaacaggccagaagagtagatcgtttccagtgaccgatgcttgtgatacactgacaagtagtacgtaacaagctcgtgtaagtgtaacctactaactgtatatattttcaccagatcaacataggaatgaaccgcagtgcagcggccaaggaaaatttggacgagtataactggacattttcatagtagcaagtcgctctgtaaaaggtgtacgttaagatggaagtaaaatgtagagaaaatagaactgccggggccgctgggctgactccacatcatttttctgaattcttctttactgctctcctcacaagccggcgctgcgtaaagaaggccagtttggaaaacatgattattttgaccgattatactctagtggattattaagatgattatagatgtaaattaaatattttgataaataagcttaataaatagcttagaataaataaattggttagaataaaatggagtgttttaaagaaaacgtatttttatagacgtagagcaaatggtttgggacaataatcctagaaacgcttcatatcgagcgtacggtagtgcatgcctcggacgccctcctcccccgtcttctctcccccatgcccctcctcatctctctcacgccgacagtttcttcgtgctcacaatctacaaccttggcgagttaccgcctaagcgcatcgtcccactatagctgtttgagaagggttctagctagctattatatttgctctcatacagtgcaatttagccgctatagcttcatttaacctgatatatatagctgtttgaaaagctaaccgctaaaacattgatcgccaaccagccattgagagctgggccggcaaacgagctgatcttgtgctcggcgagtgccgtgcagaggtcttgttcaggcaggctggagctgaactgacccagagcctcaagctcggggagaggatcgatgacctcgatcggtgatcactcgctcttcttgggggcgaaagacttcccgg

SEQ ID NO: 50824 - DNA, 6755 bp, Oryza sativa
  unsure (1)..(6755): unsure at all n locations
ccagtaacgagaaaagttgtccttaccagaatattcatccaaccagtagtaggaatgaaccttcgtacccagcttatgaaccaaccaatctgcacgctggtatactctttcatttgcctcattcaatagcctgagttttagcaggtgatggtagctctcgattgctgaagcaacctcagtagtagccaacggggtggttcttaacatagttatccatgaccctggaatacattcggcagtcagcactagcagattaaatagtgatagaaaacttcatcaaataccagtagactcaaacaacggaaactgaaattcagatgtgggctaagcaaatgtgatacaggaaagagacatggaccaaccaagtcttgaaaccatagagctctgaagtagtctagaaaaccagcacaatcaacaaaatcttccagaaaggcttcaaataattccatgccaccatttcctctgcagatattgcagattaactccccaagtcgtttagccatcatcggacgcttctcaatatctgggcacttcttcattaaatttttatgccaagcatgccttatgcgccatgggctaatcagcacagggcactggaatacttccctgttcagcatgctattacactcaggaactgcaaccccagaaagcgtatagtaatgcactagattaaaatagaaaagcatcatttaccttatcgtgcgcacatctgcaaagggatcatcaataataaagccacccaactgccatgttggatcttttgtacgaactcgatcataaagggcacccatccatctatatgcttcaccatgtgaaaaattcggagttatgatccaagcaacaggaattgcatttttctgcttgtcgaaaacaaggaggctatgtacaggatactgcaaaatggtaaatagaaatgctaccatgaaatcaagcaaaccttaaagcactactggaacaaaaatgaaacaactgtcattgacaaacctttaatttgtttgttccaaactttgaatcagaagccaataaactacggttgccatactgaatcatctgctggagctgccaatctgtctggatgcccacgataaaggtgtccttatctgaaaagtcctcatacaaaaatatatggttttggtgattttcaacccatatgttaatgcttatagcatcatcgtcatcaagttcgtaaacagaacgacgaattttcctttccaacctcctaacatatctgtgagtaagaagaccatctcggtttgatggtcctccttgcttttcgatcatttctgtatgtctctgcattatggtctccactggaataccaacacagagcaaagacataatctgaagacgaagttcatctgatatgtaaggcgcaaacatggccttcgtcccaatagccatattgtccatgggaccatggcagggcttccctatcttatctacatgcttatcatggttatatatcacaagagcgacagatggttcagcaatcaaacgcttcacaataaaatggcaaatacagcccctctttgtatgaggacgaccagcaggtgttttcctctttgttgaagagttcctgctagggcggacagagccaccctttctataatcatctggaccaaaagaacaccaatacctgaaattaatggtatcatgaggttcaaaagcttaatgtaaattataacctatttaacagagcatatctaatgttaagagacataaatagaaggagcattatcagccatttaaaagataagatcgatttaacaaatagcaataataaatttgttctagtttacaagatgaataagaagcccaggttcacattccagtttaaaaattagtcggacagaaatgcataatgcttacatttacttacagaatatactcgagtatcccatcaacttttggtttgcagttcattgttggtggacgccttcgccgtgctttacatgaaatcttgttgggcactctttgttgtttgattctcctctaacaaaatcattcacccttgaaaatggaataagcgcaagcctgtccattgagtccttccatccctccaccctggaccacatgatatctgatgccgaaaactctggcgtgggtggattctgaactggaagagtcaaaatttcatcccacctagccatctgcatttgcataggaatcatcacaaataatcaacgaaatcaaagccaaagtagcatatatttttttaagaaaaaaaaaagctatggtctgtgcaaagaggacagcatagacaaacaaaaaaaagagcatatatttgtaagacagttacacctaaaccaagtgtcatgttatgccttcgaaaatttaaacattagtgttgttcacatcacatgattaaaaacaaatacttgcagttgaatcgaaaagagcatatccacaatctcagtaggtgattcaagcaccccaagacaaggggaagttcgcattagattttgtggtatgctaagactgttagacatgaatcagcggtatcctttccacgttcatccttttctaagaacccataagtaaaccttcttttttctcaagccgggcattcgataacttgcattctggttgcaagagtgctgtaacagcattactacctctgaatgaatcaactcgctagcaaaccagacatttctaagcaatcccctcacccaagaacctgcaccgttggctacacttgttcaagtcctaaccctcctcaaactcccccatattggcctacgcacgccttaacccttctccaaaactcaccaatcgcgcaagtcaatggtgacgacgcacgcaagccaactaaaacctagtatatgctctacgatattgcagcggaaatattccaattccactggaatggattctttttgggaagctgacacagaagcccccagatctacaagagaagctagttctatgggtagagggaggggatagtgtggaggtaggtatgggtgctcaccggtggcggcggcggcggcggcggcggtggcgctgctcccttcgctggatggaggcggtggagacgggaaggccgtggggacggggagatcgactggctagggcgcacgcacgctgaggctcgaggcccaatcacatgtgtatgggcttttcctgtttccaagggaggctaaatagacttattcattgctgatggaccatgggaccaggctgaaaaatagactgccggtccttagagttagagcgtggtgtcacttagttccatggtcttgtaaaatcgacgttaagacccatgaacttgtttaagtgaatcattgcggttcaaagcagtctgaccagaatttccgtcttgcgtggttctccatcgtggccgcatatttgcaattaggtccctccacgcccgttccacccctcctccccaaatcttaagggctggcgccaccgcctgcagcagcctacgattgccgacgcccaattgccgtgttggagagctggccaccgctagctcaagtgcttgtagacgagatagccatatggctaccaagctcatccccaaccatcgtcaacgagctagccctgcccgcgggccgctgggtatgaggtcgacgaggtggccgtcgggagctcgatagtgaatcaggagtcgtgtccacggcgtggcatcagacgagccggccaagagccagaacggtgagggaggcagcagcgaccgacgacttagaggtggagaagcggaatccccagcgcgaactcgccgctcgtggccatggctcgccatcattgaggccaccacctggcagatgacagcgacggacggatcaggcgagggagagggatgcagatgagatgtgcagtgcggaggccctccccttccccttgtgccatctcccatctcatccgccaaattggctagctcagctccaggccccagctgtcgtcgtcgaggccctccgctttacaccatctcctccaccactccggctagctccaccccagccatcatcgtcgaggccctctattttccatctcctctgccgctccggctagctcctccctagcagccttcgtcgacctccttcactttcccccatctcatctgttgttcctgctagcttcgtcgttgtcgtcttcatcggcgagccaaggtcgtgaagcgagcacctcgtgcggtagcaattagcagacacaatgagaagaagaaaggaaaataaaaaggggaagacttgggggaggagggatggattggccgcagaggggcttaaatgcaaatatagggccacactagacagccacgtaggacgatcaacccggtcaaacgtgttttggattgtaatgattcacttaaacaacccgatcagacaaggtttacgtcaattttacaagatcgttgacctaagtgacaccatgtttcaactttaaggatcggcggtgtattttactaagaaaacaagtaacggtaagttggtaaacggacttgcccaaaatagtctaatgggaaattcactttatcgaaggctttacttctggtccattcactttatcccatttggacatgtcatcgcaggccagatattaaatttgtattctctagaagatgcctctaaaatgtaacatattggaagaaccgactgagcagatattctctcactcctgaagcatgatatatacaacggatgctcgtgagatcccccatcttttgcagtcacaatttttagcattaatgtcaaacaatgtacttagaattcatatgttctacctaaaaatagtacctttttctagctagcaaagcataacatgtgttcaccatatctgtattcttcaacaccttcttcctcatcttggggcatataggctattgctattgctttgccatttctttatgcttattgtattacctactcatcagttgacctttgattctttctagcattttgaggattggtaagtctctagcctctgagatgtacttgctgaatgcttcacaattattgttcagtaagatgtcacacatagggaactcaccgaaacacactctgaccttgcggaggcgaaatcgaagtattcataaatctcccatggcacaccacaagtccacaacctcctgagcgctcaccgctgactcttagccatataggatactttctccaagagtaacaaacacagtcgattatttgcttactataaactctcaagtgctcaaatggatggagtgtatctctcttgttctcaatccaactctttcctcttctcaaatccttctcatagaaagctactccaaggtaaggggatgaggaaatactatttagttttggatataactcacttttgcaaacccccccccccaaccagtagaaaagaaaggatgaggggtatttaacaacatatccagatttttgccattgggataaaaagattacaacatcataaattctgatgtggacatcagaacttccggtcatttcaaaaagaaaaacctaacagtaacaacacacatgctttgacctaggattttacacataagaaattctgatgcacaaattaaaacttccgataatttgaagccatccaaactgagagcaagaactttggagatatcaaacattttaatactcaaaaatctagatattcacattgaaaaatctattcataaaccttgaacacaacccaaaagcttaactttgaagaaaaaagggacattccattaaactgccacataagagcttctagtattactcaaaccataatgacttgctttgaagtctgtttttaatgatcgtgaactttatagaaagctcactcagagggttacccggccaaactaaaacacaaggtctaaaatcacttgaacgatacggcaatacttgagtttctctcaacaagcacttcgatagatcattttgagtaccaagacatatacaaacacatcaatgattgcacccctcttaataggtattcatatattcaaatgtaaatagaaaaaaaaaatataccaatagaaatacattaatgtttatttgtcaataccaaaaccatttcttctttcatacttaaaatgattgatgtggagtactcatagattcaaaatttcaaatggctttatacggtccatcatgacaaaatcatcccttgcccttcaagatcgtttggtccatcgcagctgagtattgcattccctttacctgtctcgccatagatattcactttgttcttcgcatttccaatattttcactttgtaattttgttcatcaatttgaattttccatttcactttgtttttgttgattgatagtttgaaatccatcttctagatcttcatctattctcttgacagcaagcttgatcatgaattgagaaaattttatctttcacaccattttcttcttgatcatgcttctcttctcatgaagtaacttgaaaaccaatggctgatgtctaccttgaagttcttcgtagagcatcttaattgtcatcaacttcacatatggtatttgttggcagttgttaaacaccattttgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50825 - DNA, 8061 bp, Oryza sativa
  unsure (1)..(8061): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaaaacgttttcccatctatgacatgccattatcttctacttcaatagaatgtcatatcagctattactttgctttctctcagatacgtattgtggtgttagaatatcatatcagctattactttgctttctcacattcgtattgtggtgttatagtttggtattaagtcaacctctctaatttgaccaaatttataaaagaatgcagtggcacctacatcatcaaattattttccttaaaatctaacatgaaatatgtcttgataatgtatttattggtagtgtaaaccatgattattttttatgagcaaatttgacaaaaccacaattaatatggatcaagttgcataacgataaagattttgacgcaggcagcctataggttttatggtcagaacatttcacaaaaacgtactgttgatctctctaaggctatgtttggcattccatgttaaaaaaaaatcctcccgacgtatcaaacataacggtttattaatacatgatcaattaagtattagctaaaataccttaaaaattggttattatgatttttaaaacaactttgctatagactttattttaaaaagtaccattcaaaaagcgtgcgtgcgacaaacgagagagtaaaaattgggaaaagggatatagaacttagcctaactcaatattgtagcaaaataataattaatgaacttagttgctactacaacttatgtatgatggattagaggacttataacattttggatataagtttaaaactcatacaattgaagaaaaatttattaacagcatgattttataaaactgtaggactccataatatcgtaggccgaaacctctctgattttatgcaacatgaaccataatgagttagggttgtgtttagattcaaagtttggatccaaacttcagtctttttccatcacttcaatctgtcatacacacacaacttttcagtcacatcatctccaatttcaactaaaatccaaactttggatccaactaaacacagcctaggttttataaatatcttttctgtaaacttgatccaagtttaagagcttcaacttagaaaaaaaaacaccttacaacttagaacggatgaagtattaatagtttacaagtgatagaaagacattcagatctcagtataccttattaacatctcatcaggataattgatagtctttgcttgttccaacagcacatcataattcaaggtgattttaaattttaaggtttgggtttttaaaaagctctttaatttatttgtcatcttaaaaaatcatgaaacaagagatataggcaaagaaataaaataaagggatgatgaaaacccataaatgttattcctaaaactttaaatcagcttccggctagtataatccaatgctgaagcatgaaccacctatgctaaagcatgggaatttagtactagtggctaccagtggtccagcgtgcccaaagccctgatttttttttcactttgttggtttagtgtaatcatttcagaacgaaccaaaatgcacgaacagggcagtgcagagtggcccctcatccaaaaggaggcaccccattcgggttttgccatttgtgtagtctccctagtctcgtgcgatcaatcattgacatatcctgtctcgtgatcttttaaactagccactctaacagtacagccaactattaactctatctattattgtatcgtccatatctgatctaataatctacttgtacaatagctaattatatattcaaactatacctttattgcttggccccgctccgctctatcgtatttttttagctcgcgtgctacaactgactataaatatatagctcgattttcttttctattttaactcagacacgaatttaagataatggcttctatagctcacctacgtcaccatatttatattgcacttactttaatcacaaacagacactacattgtagccgatctaaaaggtacagatctactagctagttattaatatatatatactctccgtctcaaaaataacttaacctatagaacatgatttatcctagtaaacgaatttggataaaggtttgcttagattcgtcacgtcctatcctaggttgggttatttcgggacaaaaagaatactatttcagcatatgtagaactcgacaaaactttaacaatatatatttttagacaaaactgaatatataattttgatgtattaagtatagttacatataatgttttagaaagatatgaaccgtatatactccctccgtttcatattataaaacgttttgatctccccattactcgtattcacttattcactgacacctgtaaaaaatacatagattaatacaaaattattcaaaatcgaaaatgacttataaagtgaaacatataaaatatgttcgggcttgtgtgaggttcagcttaagtataagccaggccacaaatattttgaatctctagaattaattttagggcattttcctttttttaaaaaaaaaaatagacttggcttttggaccgttgaaaacacaggcctaaaaggtactagtatatctgaaagttattattattattattactttggtcatatatctttggtttatacgccataactttagataatggttttcaagcataccttatccagaacaatgacatgtagtgtagtatcattctggccgagcgaacttcgtcatgtccgcacatttgcgtggaaatggcgtgcgttggtctccggtcaccggttagaagtacccgcgtgatcgctaccgcttggtagcctgcaatgtccctttgcctgattgcgaccgttctctcttctactcctttttttttttcttttgagaactctcttctactcctaactcctctctaccttccttgctatagctagcttccatgttgctgctagtgatgtttggtgcacccaaccactttcaggatacgtgtcccagctgtacttttcagctaactgtagtcttcgtgcatggtttcgcaggtcagacttttttatttggtaaggaagtttctctaattctactctctctgtcgaaaaattatgtgtctagattcatcgtgtatagagtttgactctttcctagatagatccgtctaaaaataaatcaacatttatacataaatctagattagcctaccttcagtatgaaacttggtttattttttagatagaaggaggagctaaaacccaattgcatggtcatgtaaatatctctctactctttttctttgactatgttatatgaagagatataattactccaaatttacaaataagaacaggttccctccatcttaaaatgtatctatttttagaattcaaatttgtttaaaaattttagatgtttctacctacctctgtctcaaattctcaaccaatcatacctatcttccatttaattcttcacctatttttttcttctcaactatttacaatattgcaccattcaatttttacacacttctttaattcccctaaaaacatctgaaaatgcttaacttttgaaacgggaaagtaccaataattacttcaaagttaattatgaataaatataaggaatccatactatgtaccagacaagtgtactatttgtccagatacatattctagatcccttatatatgtggttggaagtagtagatgcaatactacaatctagctaaaagttatttggattttagccttttctctttttctcccacttctctatttaatttgtatatgttgcagcgcgtctaaagctgatgaaaaagtgtggtaatgtgttataactcactattaattgtatatactctatggagtatgttctaagtctacttcttccgtccaaaaaaaactcattcctagcatttcaagataaaaatagtggagtgagaatgactaaaatgccattaatcattgaaaaaatagtaagagtgataggtaggtaaagggtattgaagggataaagcttctcgttttacgtgctgagggtaggtaggatgatagaaattagttttttttttataaaatttaaactctagaagttgctttttttttggacggagggagtacaatagattctatttttatggttaactataaaaacacattatttttgttgtgcaaaaaaaaagatttatgctactccctccgggctgataatacttgtcgttttagataagggtgaggtcaaactttagaatctttaattatgaatcatttttaaaatatttatctttcaaatatagtgactacatgtatagattagtcttaaaaagtactttaataagatcatatatttgttaacacttttttacatattataatagaaaataatggtcaaagttgtttttttaagaccgcgcccttgtccaaaacgacaagtattatcaacccggaaggagtatatatttatcgataaattttcacggtataattatagtgtaattatattgtaagtacaatgtaactttcaggcacatctggaagtaaaggaatggcttaatatttcagaacgttcaaccttcctttcaagtatggagatcttttttttgtcaaagaagttcttatgcatatgtgcagaatgaaagatcctttaaaacaaactgtttttagttggttacaaaccttatagtcttcttgtgtgacctttatgtaactctgtaaccttgtaaatattttctttttttataaaactacactgctgggcaaagccctggcagtatttccaataaaaaaaagtaactttcatattattttgaatcattataccaaacgaggaagaaaaatcatagcgcatcgtgttaccgtggatttttaaaagttacatataatttatattataattaaatgcaagtcataatatcatggtactaagattataaaatttatcaataaatatgtataaatatgagggaaaaaattccaagaaaacgggtgctatgtaatttgcacacgattagttaattagctggtcttgaggtcttttccgtggtcacctcagcgaaacaaaaaagaaatgacttttacgtgcctttgacactgtctcgtgcttatccgtacaaaccatgcgtcgtccgttgtcgacggaaacaaaattacgagctggctgtcggctgtcgccacttgccaaaataacaaggacttcgcatttgacagatggctacaacataaatgacgcaaattaaaggagacgttccagaattaaccaggacaacacacacacacgtaacaataatggtttgattgttcaataaaagaaaaacgctaattggattggctccttttaccgacggatagatggatcagccgtcgccatcgcctgtctctagcttcttgccgacgtcctgtagaactcctaagaaaaaaacatcaacatcaagaatatcaaaacatctaatccctccttctcattttaagcacagctatgagtttccttattcaactttaatcgtccgtcttattttaaaaacatttaaaaaaattaaaagcataagtcagcataaaataatattaatgttttattatctaataaaaacaaaatactaataatagagaaaatttcaaataagacggacgatcaaaattagacacggaaactcataggcgtgcttaaaatgggacgaagggagtatccttttaaaattaatcttgattggtcgcatatatatgcaggatatttcacaatgcacatttactctttatataaataagcaaatatatttttttgtagatggtgatatttttaaaaaaatatctcaaaaatcttagataataattaaattggtatagagggatcacggagaagagccgtaagagactagtgccaattcatctatagctaattcatataatagttgcttactatactattaatatataatcccacctgtcatacacacactgtgtcttgaagtccatgctgcagctggctacagatctgtagcccgctgctcttctctcccatcttttatctcattaaaatatatttatagctggctaataatctactattgtacctgctctaacgctgctgcctacggctaccaacatcgatcttgctcgtgtgtatcctggattcacggtgacataccctttttgccttttttatgttcacgctaacatcggtttatggccaccgtttgcttaccgaggctggataaagttggagcccatcgattggtctaataaatcaaactaaaaaataaaacttaaattttcgaacatagttttttaagatattttcaattttaacttctctatttagattcgtagtactatgatgtatcacatctctttaaaatcctttatatatattatgggacaaaggagtatataacataacgagtataaaagctaactcgatagtttctgggctgggagattgtcctcatgcacatcaataatcacttcatgcacatttcccaagccagctaggatgttggtttgcccaacccagatcttctcgccgtatagatttggccatcgagagtgacacaatagtaagggtgtaagtggctagctagcccataaaacccacttataaaacaaagcaaaccacttacctatttatttggatctatgagtgggttcatggattagccgcttacacccttacaaaataatgctcatgaattcgtttattgcagaaggccatcgctgctttcttttgatcgtcacatactcacattgagtcgataaacatcgttgcgatacaatggactggtatattcatctgaaccatggcattgaaaaaaatcagttgcaccatactagtgagtcaaaaaatggtacaagtttaataagtatatatagatggaagtgtcatttactcaatccaccctaatttatatctctacttctataaaagagagtaatggtagtgatgagtgatgaatatatcaccatctacagcagtaactctatacttttaaataaaaaggaaaatattataggccagaggactcatatgtcaaccacccctaccaccacattccaacttaaaatggaaaaaaaaaacgacagtgtgggccaaaggtcctacaacttagtagcaaatatatgtagaaattaatagatgatatatgtcaaaaatgatgctaataatgggtcaacaatcattttatttgtattaagatcatgatgcaacgctgtcaatatgcacctaataatgtttcgaggcatgaagaacacctatagaattgattgcttgaatagcaaaagtttttttttctgtttagtccactcccttgtgtatcgtagcataggccctgtttggagcactaacctagagttattttaagagctattttttagcacaaagatatagccttacaataaaatagccataacttgtttggatccaagggttattttgagaggtatttgacctttaatgctacattcccatggagagagaagccgcttttcagtgagccccacccaaatagtttcaattagcacctcttgaggggatagtttttttggtgggttatttccaaatagccctgaaatagctcacctgtttagaacttttagattatttggggctatttgagagggctaaaaaatagcccagggatccaaacaggggcttggtgtcgccgtgtcatggaaaaacccgtccaaaaagcatccattatccatatcacggtaagagccttgagtaaaatgaaaacagggacaaaaaaaaaaaactgttggtccaaccgatccaaccgatcctccatggccccatgccacgctatagccaccaagtaa

SEQ ID NO: 50826 - DNA, 9859 bp, Oryza sativa
tggacttccaaataacaaatgctaacttgcctaatttttgctactagtgtttagatttattttgctaaaaagtggtcctaaacggtaaaacttttgtcatttcgaaggatctaaacaagctcttaatattctagtgtctataaacatcacctactcacaaacgacacttttaataagaatttacattttaatgatatgataaatttagtgatggtctccgtctctttaaatgtgtgttctggaccatattgatggggtgtatgatgtactcattttaagctaatccatacagttcaaaatccgtcttgatttttatctcattaactacatttaatccataagttgataagatttatcctccgttattccttatatatgcctacaccgatattatactttcttaatgagtagctattttagtttttcttaataaagttatcttttgaattaggagcatgcgtgtgtgtgggtaagaagaaagtgcagagtaaaaaggaatagagaaaaagggcaggggagtacggatccccgtgaagctgtgaagcgtccacttgcttgcacttgcccaaagaatccgatggccgtagaaaattttttaggttttgttgtcacattaaatatacgaagtattaaacgtattctactagcaaaataaattatatattccaccagaaagcctaattaatccgttattaacaaatattttactgtagcatcacattatcaaatcatggcacaattaagcttaaaagattcgtctcgcaatttacacgtaaactgtgtaattgattttttttcacatttaatacttaatacatatatccaaacattctgtgtgataggtgaaaagtttttgttctgggaactactctctccgtcctataatataagagattttaagtttttgtttgcgttgtttgaccaattgtcttattaaaaaaaatttgaaattattatttattttttgtgacatactttattattcaaagtattttaagcctaactttttattttttatatttgtataaattttttaaataagacgagtggttaaatagtgtaaaaaaactcaaaattataggacgcaccccgcctcctggctgtccttggttgcccacgcacgaccgtccaccccgcaaaaggataagaaaaaaattgatcgacgagacacatcacaagtgggaacattttactaccagtgacagtgagagactagcgtcgcgcacatgcacatcttgtgcgtctcaccctcaccggcaggttaccgcaccgctgctaggcagctaggctgctcttgtcggattttttccatgaaaacgaatctcttcgtggccgtgttccgttacttttaaaaaaaattaaaggatacggacacacatttaaagtattaaacgcagactaataataaaacaaataatagatatgtattaagcctaattaatctatcattagcatatgtttattgtagcaacatattatcaaatcatggtgtaattatgcttaaaagattcgtctaataatttatatgtaaactgtacaattagtttttttcgtccatatttaatgtcttatgtatgtgtttaaaaatttaatgtgatgaaaaaattagaagtttgaagggagacacagccgtagccgcatgcgtttgcgcgagtgcacagctactcgcacgcagcgagcagcgaccccgcgaaccctcctctaccagcacggacggcaaccacgttggagtagtagaagtagtactcgtacgtgctgggtctgtgacgcccgcgtcttgtcgtgtcgatcactcactccacacccgcgcgcgtccgtccaccaccacacccaaccccgcgaatcggcgccccgatcgaaaccgagagcgttttccttttctctttcccgttttttcgccgctcgcgcggcacgggcaggtagtagtacgtcgtcgcgcgtcgcggttgggggcttggctaccgcgcgtctcgcggtttcgcaccggcgcgagcgcgacgagaagagaggagcgatgcgacgagcgttgcgttgcggtttttttgcgttttggttgggtttggatcggggtggggggtggggggtgggggcagaggcgcagagcgtgtcggctagcgtacttgcccgttttcatatttcagctgttgctttctcggctggagtcgagacttttcccctccacatgcctgcctgcacgctttcctggctgccatctgcaccacaggccacactgcatccgctgcccggcacagacttccgggtgggtgcaccggataataaaggtatggttaagccaaagtagggagtttgaatccaaactagtacttctctatcacatcaacatatcatacacacaactttttagtcacattatcttcaatttcaaccaaaatccaaacttgcgctgaactaaacacagcctagggcgttatcattaagaacaattcttttaacatcgagtttagttccaaactttttcttagaacttctaatttttccatcacatcaaaacttttctacacacatactcgtaaactcccaacttttccgtcacatcatttcaatttcaaccaaatttctaatttttagcgtgaactaaacataccctaagatgtactctctccgttcaaaaatataagaatctaaaatcggatgaaatattttctagtctgttcatatttatagtattagaaaatatcccatccgatttaggttcttatatttgggacgaagaaagtatattttattttagcttccgttaatatattttttaagctactaaacggtgtattttgtgcgaatactttaagtatagaagttgctctaaaatattaaataaatttattttttaagtttgaaatattaaaattcaattaattatatgctaatggctttctcagtttgcatatccgtatataatctttatcttcgtcaaatttaaatgggtcttaacaaacatttcttttctctgcttcagcaaatctaaacgtcggccctgtttggatccatgggttattttttaccctccctcacgtagccccagatagcccaaaaattccaaacatgtgagctatttcagggcttttttggaaataacccatccaaaaaaactattcctctcaaggggtgctaagagcaagtttaatagtatagccaactactagctccaaatcatttatagccaatgaattcatagaatagttgcttactattaatacatggtcccacctgtcatatacatattacgtcttagagtccatactgtagctagcaacagatcgtagcccgctgctattatctctcttcttttatctctttaaaatatatttatagctggcttatagtatgctattgtacctgctctaattggggctatttcgggtgggcccactgaaaaaatgtcttttctctctctcttcgtgggaaagtgcattaaaagccaaatagctctcaaaataacccttggatccaaacaacttatggctatttcgttatgtaaaaaatagctcttaaaataactcttggctagttctccaaacagagccgtcagtacgtgatggggctaaagtcaatgttttcttgggtaagtcgaagacattatacttgtagttgtagttgaagggaattaaaggacggatggttcggaaaacagatgaagaatggtccaaagaaaagaaaattaaagtcatcattcggtgccaaggtcatgaatatcagttgaataaataaacaccgaggcatatggaaaaacgataaggtaaatttcaatctgtagaattatactctctccatctacttttgataatcatatttccaaatctaaaaattttatttttaataggcatatttttattggtatgcaatatttatttttcaatgaggggcaacaatagctgccaaatattgtaccggtatttataagtatttatttattgagaaagaatcaacgactcgcagatacattatggatgcaagatcatagcttgggtaaaactaggtcctagcagcttgattttcccaagagtttgaactactaccaattggagcaataaggttatcatgggctcatggccactaatctaccaaacggtccattggttggctgaaatgaattcaattttcaaattttgatttcaattcacagcctttcaaccgaactactccctttagttattgtccggttattaccagttggttactcaacaacttaggttggtagtggtttgtttagatgggaacaagacagaaggaaggaacatatgtagcgtaatgcgtatctttgtttactctgtttgtttttggtcatcaaggacacgagcgagttacaaatggccatacgagcaaaaatacaggcaaaacgccctctgcttacgtggtaaaatgcgcgtgaccagtttaaaatatgtacagagcacatcgtaatactctctccatcccgatttggcgatttgatcatctctaagcaaatgacatcaagaataagggcatccaaatactccctccattccaaattaatctatatatagttttttttattattcctaaatgatctacatatttattcatttattaagcctattcgttatttgtgcattggagtaaatggacattgatacatgcatccatgcaaacaagtatttataacccacatgcaatatcttgatttactattggctagaaaatagtggagatggtgcatacattgctagagtaaatatagtatgagaaaattattagcttttcttggtcttggtgtacctctaaaatatgtatatcaatttagaatggagggagtattcatcattactccccccgtcccataatacaagggattttgagttttagtttgcattgtttgaccactcatcttattcaaaaaatttgtgcaaatataaaaaacgaaaagttgtgcttaaagtactttagataataaagtaagtcaaaaaatcaaataattattctaacttttttgaataatacgagtggtcaaacagtgcaatcaaaactcaaaatcccttatattatgggacagagggagtatcaaattaatcctcattggttaaggtgcttcatcgcttcatgtcctgtgtattgctcatattttaaatattgcataccattacacgaatagaaattattttttattggtttcatacaacaccatttaatgatgcatatttactctttgaaaaaaaacactttgttaaatgatgatcattttgagaagacctcaaaaatcttagaggatgattaaaatggaatggagggagtaataagagcaggtacgataacagactataagccagctataaacacatattgagaagataaaagaggaaagagaagagcagcgggctataacagccagctgcaacatagactccaagacacaatgcatgtatgacaggtaagaccatgtattaatagtataatactctgtatatgcttatagataactattgtaaatcgaccatagatgatttagaactaataattggctatactattaaacctgctctaattaatgaatcaaactgtcaccaatgaatgaaattagggcctggtttagttacaactttttctttaaacttccaacttttccatcacatcaaaattttcctacacgcataaattttcaacttttttcttaaaacttctaattttggcgtggaactaaatacactctaaatataaaatcctgggcaataaatgctcgggctaaaacaaggatggaacacgtcagcgggtccatccctatctcactcggtcggtgctagtactgcttccacgagatccatccgagcagcagcagcagcagtagccgccgccgatccgagaaaaagaagaaaaagaaaaagaaaaccagcaaccgaagcgacaactcctctcccgcaacttcaccgtctcgtctcatctcatctcgtctcgccccgctgtaatctcgtaccgcgtcatctcgcggagacgcgagaaaaagtccgcgcgcttctctctctctctctctctctccctctcgtgggccgctgcccgcacgtcgcactcacgaccggacgccagctcacgaatatccacccgatttaatcccgcccccttcgattccgccgctccgcgcgtatcgcataggcgagttgtcgtatcgatacgcgcacccacttatacataagccgacctccttatcgtagataagcaagtgggggtggcgtggggagagagaaaagggcgagaggtctgcaacgcatcgaagaaagcgagactaaagtttctctctcctctcctctctctctctttctttctctcgcgacctcctcctccttccacatctccgtctctctctctctcatcacgaggggaggcggcggcggcgacggggaaaccctagaattcggcggggtgaagcggtgaaggcgcccgcggcagatcggagccgggaggggggtttcagcggcggcgggggggcggcgccatgtcgtcgctcagccgggagctcgtgttcctcatcctccagttcctcgacgaggagaagttcaaggagaccgtgcacaagtgcgtagcctttctccctcccctgcctctctcgctggtttcttcgttcgccggttgggttggaccgtgggctctgtttttttttgggtgattcggtgggaggttggttgggcgcaggcgactctgctttttttgggatttgtttcgcgagtgtttgtgcgtgttttttttatctatgatttttttttgcgtgatgcgtctccagattttttttttagttttgggctttgagttccatcggaaaaaaaaattcgctctgtttgatctgttaatatgcaaggaaattttttccgaagttttttttggctggtttggtcaaagtttttttcctcgtggttttctccaggatggttgttagtattttatcaatttggtcaatatcaatttttgggggaggggctctggtcatggtatttttattttattgggatagttgagggggagatttgaaatttcgagctcacatgcgcctctttttttttttcgctttgccttgttcgggaaaaaaaaacttgtctgttttttttatcccgaatcctattctctgtcggctgcttaaattcgtctgaacaattgaatctctagattcaatgtgattaagtcggtgattggttttgtcattataatcacttgtgctgtgtcgactgagccagtaattgtacatgtcatttctctggattgcatcaacaccgtcgaaataattgagaattatttacgaaaatataaccaaattttaagcaagcagtcgggcaattataacttacaaagctgttgttgaacttgtctgaacttatgttctgtactttctgtcgtttctgctcaaatttttacattgtagactttatagtggcatacggtaggttagtccgaattagagtgtccagcttgacacccgaaggtctccgtcattgcaattgagctctgctgtcactcgtttactgctcattctacgaaaagatggggaaaaaaaatccttcaactaatgttctatttccttgtcacgactattatgttggattcaatggtacatttggtctagcaaggtgtaatttcctaatatggtacattctgttttaggcttgagcaagagtcaggattcttcttcaacatgaagtactttgaagagaaggtccatgctggggagtgggatgaagtggagaaatatctttcaggtttcaccaaggtggatgacaataggtattctatgaagatattctttgagatcagaaagcagaagtatttggaagcacttgacaggtataatttcatatctgaagggaaagttcccatttcaaccaaaaaaaggacttgtgttccatccttttggcactgggtgagatataacttctactaattttcatattcatttatatattttttttgtaacaggcatgatagagcaaaggcagtagatattcttgttaaagatcttaaagtcttctcgacattcaacgaggagttatataaagagataacacagcttctaactcttgagaatttcaggttcttacttcatcttgccttgtattttctgttgactgttgtgcgagtgtgttgataggcttgctagttgaattttgcattattagggttctttagattattcctttatctgaacaatgacaccaaagaaatgtataatgtgttgacagagacaatgagctgttgatgtttcttgaattgatttttttagttaccacttaccaggtaatggtggtttagttgtgctcatggatcattcatatcttcacactgctgatcaggacatgaaagcatttccttagagcgatatacttcatgagcattttaagtttccacttggtgcagctgtgacttgcaataagtttgccatcacggagaactaaagtagggcatggattcttcttttttcttttttttgatagaacatgaaattgaatgtgtagttgagtgcgccctccagtacagaagctacacaaacctgctctgataatcgagttgtagttactttgagttaggcattttggagttttaagttatgagtgaatacattttccttttggaaagagcttctagtaagagtttactgccactactttgttaattgcctttgaattaacaaaaattgtggaattacttgttctgcttttaacagcacttcccatgccttttttaatcaacctactgtgcttcatactatcatgttcttagcttcctattgccataaaactgtcaaattatcaactatctgttgttttcttgcagggaaaatgaacagctgtctaagtacggggataccaaatctgctcgcagtataatgctgattgagctcaaaaaacttattgaagcgaacccccttttccgggaaaagcttgttttcccaactctcaaggcatcacgccttcggactttaatcaaccaaaggtttgggaagacaatatactattgctatttgttacattatatgacctgtttgagtgttcactgtgattttctgttatatgtgagttcataattctatgacgacatttgcagcttgaactggcagcatcagctttgtaagaatcctcggccaaatccagatatcaagactttgttcactgatcatacctgcactccgccaaatggagctcgtgcttcaccagtttctgtaccactggcagcggttccaaaggccggtggcacatacccaccacttacagctcatactgtatgtttgagatttaccatttcttctttgcatgattttatgaatgcctcttttcacttttactcactatatccattaatgcagccatttcaacctcctcctgctggtccatctttagcgggttggatggcaaatgctgctgctgctacatcatctgttccatctgctgttgtggcggcatcatcactacctgttccgccaaatcaaggtaagatgatacttttctgttgatatttgctaattgataatgtgagcgtttttactgttcttttattatattattctgacctaaatctgcaatatttcctactgtacaacttctttattcacactaggtattgctatttctctgatactaatattttctaattcattgcactaatgatcattgctttctgatttcacatgtctgacttaatggttattttccatatgaatttgacatgttttctcatttttttaataaagaaaataagtttaaaactgctaaataagaaaaggtgagttgggacatatactagataccccctcagtttcataatgtaagactttctagcatcacacacattcatatagatgtaaatgaatctagacatatatatgtgtctagactcattaacatctata

SEQ ID NO: 50827 - DNA, 11923 bp, Oryza sativa
gcatcaactattcagcaatgcggttctttggttctttgatgttttgcctaatccttctagcttgaagtacatctaacacctctaagacaaagcctaattctctttggcaacataaatgtacatgaacatttattatttctgctttgcatgtcctgatatgttgttttcttttgtcacgttctcatgacatacaacttatcgtactatttcctcagctgtcccaatcatgaaacgaccaactataacagactatcaaagtgcagaatctgagcaactaatgaagcgattgaggccaagtggacatggtgttgatgaggtaatgttgcatttgcatagaagatatatggctggtgcattttctatcaattattcaaagtcatctacgcttatgttcaggccacctatcctgcaccaattccccaacctttatggtcagtggaggatcttcccaggacagtagcttgtacattgtcacagggatctagtgtaaccagcatggattttcatccaactcggcatacactattactaggtacaatcaagctctttatgttattaaaatctatttaaaaaatatgtgcaatagtaagtacagaagtctgattctttaagcatgaatgattgaatacaacttagccaaacgatatatcattttcttatcacgcttattactttatcagttggatctaccaatggtgaaattacactttgggaggttggtatgcgtgagagactgttttcaaagcccttcaaaatttgggacattcaagcttgttcaccacaatttcaggtatttttttattgctttttatagttgatccagtacaaacatctatagttgtgatcttatatgcctctttattttacctcccgtgaaaagagtgtggctaaagagtcttccatatccattaaccgggttacctggagtcctgatggagacttgataggttggtatccattttataattctgtcagtaatattgtgtttcactttatttgttgcttaggtttcctttgtggtttcaggtgtcgcatttgcaaaacatttgattcatctgcatgcatatcagcaaccaaatgagacgcggcaagttctagaggtactgcaatacttccaactgtccttaatcatatggttatagaccaaatgtcagttttataaatatcacaatactttattagttcaagtctgtcactaaacccttttattcatcatgtcagattgacgctcattctggagcagttaatgacatagcattctcccggccaaataagcaactttgtgttgtcacttgtggagatgataggctgataaaggtattagatgcttcttggatggttatcttcaattttccccctagccttggtctccttcaacttcacttttcttttgtaggtctgggatatgcatggacagaaactgttttcatttgaagggcatgaggcaccagtgtattccatctgccctcaccacaaagagagtattcaggtgggttttctgaacagaatatgatatttccagttgtggtgcttattttataagatagacaatttcttctcaagattgaacagaggtagtatgcgtgattattaatgtgtccatcagtaaaaaaggggctgtctaatgttattaatgtcgatttcttgtgttgatgtgctattcttatgttccctgaagtttatcttctcaacctccctcgacgggaatattcaggcatggctttatgatcatatgggatccagggtagattatgatgctccaggaaaatggtgtactagtatgctttatagcgctgatggaactaggtaagcagaggtattactttcgtaccgaaagttgtctttagttattggtgctgtactaatttacttgtttttcatatgaaggttgttctcatgtggaacaagtaaagatggagattcatatttagttgagtggaatgaaagtgaaggatctatcaagaggacatattctgggtttcgtaaaaagtcagctggtgttggtgtggtgcagtttgacacagctcagaatcacattttggctgctggtgaagataatcagattaagttctgggatgttgataatacaaccatgcttagctctactgaagctgacggaggcttaccggttagtctatgttccctactgtgttaaacatttttttctcttttggtagtctaaaactgtgtacattctatcagggtcttccacggttgaggttcaataaagaaggcaatcttcttgctgttactacagtggacaatgggtttaagatacttgcaaatgctgatggactcagaactttacgagcatttggaaaccgacctttcgaagcatttagatcgcaatatgaagcttcttctatgaaggttcctgcacactctttgctgcttgttattgttgtgggtctagttttagaaaatccatgaccttgaatattgcatttacaggtctctggtgctcctgttgttgcgggcatttctcctaatattggtcggatggatcacatcgacaggaattctcctgcaaagccatctcctataatggtatggtaatccacagacgaaagatttcccaaagtttcatctgtttaatgcctctttgcttaccttactgttagcaattgaaacacaatctgacttaattatggatttaatagaatggtggtgatccagcatctagaagcatcgatataaagcctagaatttcagaagaaaggcccgataaagcaaaaccctgggagctgatggaagtcctaaatgctcagcaatgccgtgtagctacaatgccaaaaactccagaccaagccagcagggtttgatccaacttgttcttgcgtagtttgcacttctcttcatgtaatcgttcagaaggctaacaacatttatagacaggttgtcagacttctgacacaaattctggtgttggcttgctagcacttggttccaatgccattcaaaggctgtggaaatgggctcggaatgatcaaaatcagtgggaaggtatattactctctctttgttctttggggtttaggctaatcaagggcagcgtgtaattctgtcaattctgctaagcaggccacagccaatgtagtgccacaacattggcaaccaaacagtggtcttgtcatgcaaaatgatacagcagataccaatcctgaggatgcagttccatgcattgctctctccaagaatgattcttatgtgatgtctgcatgtggtgggaaggtttcactgtttaacatgatgacatttaaggtaaatgctcaatatcttttttggataaatacttcaaaattcaggaaattttaattatgcttccttcatgcaggtgatgacaacattcatgccaccacctccagcatcaacctttttagcatttcaccctcaagacaataatatcatagcaattggaatggaagattcaaccatccatatatacaatgtcagggtagatgaggtactgcatacataaaatttgcacatactgtaatttattgagccattgctattcatttatattgagctttattttctttccaggtcaaaactatattgaaagggcatcaaaggaggataactggtttggccttctcaaacacctacaaatacttgtgtcttcaggggctgatgcacaggttactatagccaaaacactttattttacactttacattcattgattctgttgatggatcagtatggctgctagtttatttatctttctcaaaagaaccactcaacccttggataataataatgtcactctgtttccactttgcagctttgtgtgtgggccaccgatacttgggaaaagaaaaaatctgttgctattcaaatgccagctgggaaaactccatcaggggatacttgggtccagtttaactctgactggagtcgtttgttagtagtacatgagactcagctagctatatatgatgcatcaaaaatggaaagaatctaccaggtagctatatatgctgtatcaaaaatggatagaattcctatgttcataattgatcaaataattttgttctggtttgctaaaatctcttttttatctctcttgtttcagtggatacctcaggacgctttgtcagctcccatttcacatgcatcatactcacgcaacagccagttggtttttgctgcctttaccgatggtaacataggaatttttgatgtggagaacttgagattaagatgccgaattgcacctccagcatacttatcttctgcagccataaacaggtactcactactttacgtatgatatacgcacgaaatttacctaaggccatatgagaactagatgtgctgatacagttttaaatttcagtatctgattgtccatgtatattgctacaatatataatgtagtacgagtgtcctagcactttgacctgtaatcatcgtgcattcgtgctcaacatgtcccacccctcttctgccatgccttgagccatgactcctttctgttaggaacagtgcgatatcctaatagctaatgccatataagtctactaatcgaagtttgagatatgaggattatgattttacatgatcctgttagtcaatttaagaaggattaactggcatttttgttctaccaagttttatggcaatcttagttgccctgaaatactctgaattggtagtcttatctagagtagctagatataatatgatcaaaaacacctaatttcaagtgggaaatacataaacattatatgccaaacttttgttgacaagttttgacatttgaaaccccgctcattagaaggttgcgtattattgctatttattcctccatcgagcttcatctaaaaacatatatgtttccctgcaccagcaatccatcggtctaccctcttgtcgtcgctgcacatccacaggagtcgaatcaatttgcggttgggctttcagatggatctgttaaagtgattgaacccttggagtccgaagggaagtggggaacgacgcctcccacggaaaacggggtgcccaatggcaggacgtcaacatcatcagcaactagcaacccagctgcagaccaaatccaaagatagacgtgcatgccggttggatcttcactgtaaagcttttctaatcttttacattgacttgtttgtatgttgatgtgactaggctattgttgcatttgttggaaaagcaaacagaaaaaaaatggaatcgtaagatcaggtgtgcttgtaacttgtcggatgtttgccctagttatgaaaaggttatcttgtaatagggatagtccataaaattaggttttctcagtataactgggacgtcggatgctgtagttatctttgcttagatgcttttcaagctatacatagtttttccttccttcatgttcattttttttccccaactgttgtggtggttcggacatgaaaaggaagacggtgattgacggatgccttgaatgccgtcggatttttggtagaaagagatactagcatctacctaattgttgcataagttcgttgaaagaaaataagtttgtgtgctaacaacgggaattttatgatttatgctattgaattgcctatatgggcacaatgagatgtcattaatgtaccatctgaagtcgttgtcagctaaaaaaccatatttgcttgtagattttgacggccagagtcacctaacgaggaactttcttgtgctcattttaaagagtaaattgagtcgacgttacatgaggaactttcttgtgctcattttaaagagttacatgaactgaacttgtaagaggtgtactatcttaatacacaattgggatacacaaatgcatgcatgctcagcatgactcttgctgatgtccacatactattactcctttcgttacaatgttagtaaataatagaacaacttatggatgtgacatatcttatttctttctataatataataacttatgattggatatgtcacatcatagtgttacgaatctaaacaagatatatcatattcaatattaggttattatattatactagcaaggaagagtactaccgtaaacttctcattctcatgagtggtcctatgtatatcggctgtgttcggagcagtagtcagtttttcagttgcacatttagtagggtattaattaatcaaatactccctctgttttatattataagacattttgactttggtcaaagtcaaactactctaagtttgactaattttttagaaaaaaatagtaaatttttaaccgaagacaaatatattatgaaaaattattcaattatagatttaataaaactatgctggtgttgtaaatattactattttttttctacagagttagtcaattttagagtagtttgactttggtcgaagttaaaacgtcttgtaacctggaacagaaatggagggagtattaactatcacaaactataaaaaaagtatttgttttcaaagaaatttctctatagaaagttgacttttataaaatatatatatttaacaatctaggaagcatgcttactaaatcaaaacttgaaaatctagagttgcaatgtttagtttatttagccaaaactaaaccgaataaaacgactatactctcgatctaaaataaaccaacttttagagtttgaattttattccaaaataaactaacttctatcttcttacctaccatcaacacatatcaagaagataaaagaagagagaagagtaacgggctatagatttgtagccagctgcagcacagactccaagtcacaatgtatgtatgacttatgtgactatgtattaatagtgtattatatgtttataggtaactattgtatgaattgattattaagttgactataattgatttggatagttggctataataaacctgctcttagagccggtgcaacagtagatataaaccagctataaacatatttaaaggagataaaacaagatagaaaagagaagcgagttacagatttgtagtcagctatagcacggactctaaaatgcatatgtgtatgacaggtgtgaccatatattaattatgtaatactccctccatattttaatgtatgacaccgttgactttttaaccaacgtttgaccattcgtcttattcaaattttttatgcaaatacaaaaatacttatatcatgcttaaagaacatttgatgataaatcaagtcacaataaaaataaatgataattacataaaattttttttaataaaacgaaaggtcaaacgtttattaaaaagtcaactgcgttatacattaaaatacgaaggaagtatatgtttgtaggtaactattatatgaattgaactattaagttgactgtaaataatttggagccagcagtttgtcctattaaacttgctcttaacgagtagtgccctgtgcacgcgtacggctgcctaatgcagagcctgacgtggcgagctgccgccccggaagcccatagaaccaactccaccatagattagtagtactagtactagtattagtattagtgttaaagcgatgcaagcaaagaggctgttctagaagcaagcagacgccacgccacggaagaatctagaaccccacccccatcccccagcccaacccccacacgaagcgaaacgcaatttctctccaaaccaaaacacccgaggcggagaggccgaggcggcgaggcggcggcggcgaccgatctgtgcggggagggggatcgccggagatgttcctggttgactggttctacggggtgctggcctcgctggggctgtggcagaaggaggccaagatcctcttcctcggcctcgacaacgccggcaagaccaccctcctccacatgctcaaggacgaggtaggtcgcccggatcgatcgatcgatcgagatttgtactgatttggttggttctgatttgtgttgggatttgggtgcagcggctcgtgcagcaccagccgacgcagtacccgacgtcggaggagctgagcatcggcaagatcaagttcaaggccttcgacctcggcggccaccagatcgcccgccgcgtctggaaggactactacgccaaggtttaccttcagttctaattctactgctcctatatctttgttacttgctgttagatttgttccttgtgcgatggatgggaagcagcgcttgtttgattggaacgaactagggttttaggcatgagggtatcggggattagacatgatgcatatgagtagatgaagaatcggtcgtcttgctcacttcatgggcagggatttggtggtttaattcagtaccgattgctctttttggatcttgcagaggaaaaaaaatcccctgattgagcaattggatgtgttgctggtgcttgtactcaatttagccatgagctccagcattcagattagttataataaggaaaaattggttctatgccatcgaaagttttcaatgggttgtcttgtgaacatacaagctggacaaaaggttgcacatagtacttttttcggtaaacttggcctgtttgtttcagcttagtcttattaccttctgcgtataagctggccttttgatttttgcagtttatgaagacctgcaaatttgagggtagtgtaataactctagtccataaaaaccaaaatgatgctaaaaaaatctagctttttgcttattagtgcttgtgttatgacttaaaaaaaggatgatgaactgttcgtttgctacacaaaatatgtattagcatcagttttttttttaattattgttctcttgttctttttcaaaacaaaaaaggcatgttcactataaaaaaaaagtgaattgctcatgttccgctgtgtttggagagcttttccaaatgtatgattgatgcttcctagttgaccaacataccaccaaagactatgaagcctggttaccactgctaataacgctggtacacaggctgaactgcagttttcggtggtatgttggcaatgtaggaagtctgagtgatatatctgcaaggttgtccagacatactggtcgatagtcaatttccactaaaaaagtcagagccttgccaaacaaagcatataagggtttaacaaacagaacaaatttacaccgactatgggttgtttattatccaattttaattgttcttgtgttcttcttttcccgaagaaagcactgacaacaaaagtttgaaattgtccatgtaccactatatttagagaactttccaaatgtatgcctcatacttcctcattgaccaatataccacaaaacactacaatgttggcctctttaccactatcaagacacttctcccagtccattttgtctgttgagcatcaggacattaataagtgtggagtgccttgctctacatcatcctctgtaaacagtctggggttgcagttttatgtggtatgttggcaatgtaggaagtctgaatcgtatatttgcaaggttgtccaaacatacttgtctgtaggcaatttctcagctaaaaaaattgaagtcttgaaattatctataattttgtcctctatatgtgcttaaaacttgctgagttcacatgccagttttttatgaaagctccctcgtgccaacaacaaggcaaatgaattagtttgcgtatattgctgcgatcaagggtactgtacattatgttgacctttacttaatctgcacaaattgtcatattttgtttcctttctgggagtatttcatggcttagctactattatagatggtaagtatgtttaaccaattttgaccaaccatatctgtcatatcaatcttgaactttagtgcttgaatagtttggagcatgatttccatcttcctctaagagtcctctttgaaaagataatgcgtcactttctcaggtttcaaacttcttcctctctagtccacaaaatgcctttcaaatttctgcagaaacacgttagaccaagcagttcacaagtttcaacaaatagaacaacttcataccgatcttgattattctcatgttcttttttccaaagaaagcatgtgaaccataataatttgggggattgtcggcatacctggagaactttccgaatatattactcatgcttcgcagttgatcaacataccaccaaaggacgggtgttggcctgtttaccgctgttgaggcaatttttcctcgtattttctggcaagaatcaggacatcgatgagtgccttattctacatgaatctcgggcaaacaggctttggctatagtttcagtggtatgttggaaatttaggaagtctgagtggtatatctgcaaggttgtccagacatgctggtctcttgcaatttccgctaaaaatgtagaaatgtaggagcctggccagatgaagcctaagggtggactggcttaaagaaaagaacataagtttcaacaacagtacaaatttgcaccggctatggattgttagcatcagtgatcagtctttgactatgttagcgttcttctccaaaaggaagtattcacaatgaaaatttggaattgtccatgtaccactatgtttggagaacttcccaaatgtatgactcatgcttccatgttgaccaacataccaccaaaatattatgatgttcgcatgttgccctgtttaccactattaatcaagacactccccctcctctcttttgttttcctggtgaacatcaatatattggtaaacaggctaaggttgtaattttctgtggtatgttggcaatgtaggaagtctgaatggtatatctgcaaggttgtccagatgtactgggctgtaggcaattctggcttgccagctgaaaatgtagaaggcttgatctaatatatgattttgtcctttgtactgtccttgcttgaaacttctaattcacatgccgattttctttacatgcaaactcaccctttcttaaaacttctaattcacatgctgattttctttacatgcaaactcatctttcttaaaactggactaattcacattctggttttacatgggcaatttgccttttttttttattccctgctgggaatttttccagcttagctattatcatgtattgcaagcatgtttaacaagtttgagaaaccatatctatatgtaacattgtcatatcaatcatgaacttgatgtgttgtatgatcacaatttatagtgtataattatcaaggtatatacgtgacgaacacttcatggactcttttggcactgagatctgtgcaaattgattcttaaagtcaagtatgattaactactggcgccactagtatgtgttatgatacctttagggtgcagggaaattatgcacgtgtcacgatattgatggcaacagtatcttccagagttcagttcttgctttaagtcctgtttgggtctcctggcgcagtttacaaatgaggaaactgtggttatggggtgccaacattttaactgtggtgttacgagatgctcttaatatgatttctataccattggcatcttgctgtcagagaaacaaagatatggggaaaatcgaatgttggcagtgcagtcatggactagtgagaatgggctggggaaccttcattttaagcctttatgtcccccatgaataatttactggaacacattttgtctacaattgctccaaatgtttggaatgcatcttttcaagccaatgtctgtatgactgacgtggtttcaaccattctgccctgcaataggccagaaggaagttgcaccatcaagctgaccaccaattctgtggggaaaaggaaatcctaattcgatgactacatgttctcaatcgcgagatgcaaaatgcttcttgttttgcgaaattcacatttggcctgtagtggagtagactcgattcttcatattttgtaactcgaggagtcattacttgttagactatccacctggaatttggtgacttaactttctgtattggctgtttttaattcctg

SEQ ID NO: 50828 - DNA, 1039 bp, Oryza sativa
  unsure (1)..(1039): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacaatgtctcaattaaatcagcacataaaatctggtgattcggaggtggatggctcagaggttgagcgccgtggctttggagggcatccaatgtgtgagttttgcaaaagcccattttatggtgataatgaattatacacccatatgacaagagaacatttttcctgccatatatgtcaaaggtattctgcaagactgcagtcattatcttatttggtgaggcaacagcataatgctgactttgtgattgttaacaggcaacattctggacaatatgactactttaggaactatgatgacttagaggtatgctatatatatatcaagctggcatacttgtatgaaatcaagtactgtcttaaattcaatccggacatggacacagaccctgtgaatttcaaatccaacatcaacattacattagagaaaaacaggatgagatgaaatgttgcatgaaaagtgactggtccataaccatatccaaataagtcatacttgaattatgttaatgtgttccatctaataagttgaattatggccatcttatgctactaagtttaatgctcacttgtatttgatttgaggttacaatttagcattgtgcttgtctgtattcagatgcatttccagagagaccattttctctgtgaggataaagggtgcttggagaagaagtttgttgtctttgaaagtgaagcagagctcaaggcaagtgaatacagttgtgcacatcacttgctggaaatgtcaccattctactttttgagtgtctatgcttagttgatctttcattcaattctcttattccatccagaggcataatggtgtggaacacgggaagcacatgcctggtgctgttgacag

SEQ ID NO: 50829 - DNA, 12394 bp, Oryza sativa
agacaaagctgtgcgagaaatcgggtacttcagcaagcatgtgttcctcctctttcccgtcaggaggtccatgatgctagagtaggttctgtccttcaagaagcttcattcccttccctaccagcacaatcaaggaaggcaccagcacatagtcagagctcaaggactgcagcaaggattggggaccagcagtttcgtcctttatcagttactagtaacaggaatgttgctttagcacagcagggtacaagaacattacctgaaaacacccatgtatctgggcttgcacaatacagcaagagaactgagaacatgcaccaagctgttcagcctcagttcctaaaaaataattctttgatcccttctggctcaacaagccgccctgtgcatgtccccagttctgctggaaatgaaaggcaagacacattcagcaacagccaggtgttatccagtgtggaggacattcttgcagcaaataaagccctggttgagaaaatgcgggctgcattaggaatggatcaggatatgttcaacgcatttaaagagatcgctggggaatatcggcaaggtgttatcaattcttcagagtacctttcatatgtaaagcagtttggtctcttgcaccttgttcctgaaatggccaggttattgcctgatgctcagaagcagaaggagcttgcagatgcctactatgccaatttgcgccttacaagcctccaagaaaatggtgggggtggaaccgataactcgaaacaaggcaatcagaataagaaggggaaggggggagttcctgacgccataggaaccagtaatgctgcaacagatccgctgaaagataagttgctgaatactgccatcaagttccagtcaaattacatgccccaggaagggtgttgtggcgtgcagcgaaaagaagggagaacaacagatggatcttctcagggtctgcctttgaagggtgcttggcaaagccgtgggggccagagactcttcatgagcaaagcaaagaagtgacgaattggttttgcaggtcaagttagttagacctgccatttgagccgctacgaaatgtcaaggtttgtgtctatctggtgtgtgtctgatagttgagtacatgagtgcagcaatcatgtgtgatgcgtttgcattttgatttttttttcttttttgtctatcatgtgtggtgcgtttgcattttgatttttttttctttttgtctattttttgtgtggtgcgtgcgtttggtagaccatggaacttgagactagaacggtccacaccatactgcatagtggagttttgcaacttcacatgagtgaatttgggctatagacggttctgttgctgtcaactcaaaactccttttaatacgaagttatggtcaaaatcgtaccttgatagagataaaagataatgtcaaactcatatgttctgtaaatacttttgccgaggaagtgctaattactactcaaattagtgcaagccatgtcggtcgttcactgctttgccgacaagtcagagtttgatttgcatctttgccatataaatacatttcattgatcgatcatccatagccagccagaagacaccgacgaggcgtgaccggaccgccaccgccatcacctccgcatggagcggcttggcggcgtgccactagtggttcccctacgtggagcacctgttgggcgacggcgacgtacgagcagctagctgttcccagtgccgatgacgtcgaggccgggcacctacaactacaagcgtgcggcggccggccccttgcctttttgtttggttccctcccaaacattaccaaacctccttgctaaacctagccaaatatgtggctttatttggcttataaattgatggccacaccttatgcaaggtttggcttaaaagatgggtgtataacatgtgggtctttgaattaaaaaactgtagcaaagtgtggcaaagtttggtaaaacgagggaatgaaccaaacagcctctagccctagccttgccttaagagtaagtctattttacctccctcatctcttgcccctggttaatttgcctccctgaattgcaaaaccggatatagcacctcccttatttttaaaaaccggtgtaaatcgactcctttgatggttttggaggtggttttgtcctacatggcgcatgtgggacccacatgtcagtaagaaaaaaaaaataaaaattttacacccggtacgtgtcagtcatccttttattttttttcgtcacctctctttcccattctctctctctccctggcggagtcgtcgtctccggcgagcccttcccaatcgcccgcaacccagtcatgaacaccgcggcgtacctgttcgacatggcgggggtcctcgccggggtctcctggccacggccccagctcgggtcagccccgtttggtgaccagatggatcagcccattggcctacccggtgttgtacagcaccctctcctccgcaccgacggccttgccgacgcatcgccacggctcgacgacgacgaacgccgtgccgcgatgtccctctctactgctgggtttgtctccatggcgtcatcgcgcgcggggaggatgagctcccacatgatgggccggggctgctagtgctgcgaggtggcagggtggccttctcctcctcctcatcgtcgttctcgcccgatgccgagctcctccaggatgatgaaactcgagcatcgccggggaaggcagcgggcggcgtcaagctggacccctcccccgtagtcgccggcatggccatgcagctggacacctgagcaccgacgacgactcctacttcttcagcaccccttacgccatgtcgttcagatatagctccatcattaagaagcaagcaggcaggcaggcaggcaagcaatcaattgaacaacgcaaaccaaaaaccgctgtagcagctgctagctagctctggtcacaactcgctagagccaaccgcaatcgatctcaacaacgaatgcttgaattggatttcgtggcgtgcgcagggaggagctcgccgaccactacgccggagaaagagagagaacgggagagaggatgactgagatgtgggatttttttttattattttttttaactagcaatagggtcccatgagcgccacgtaagatgaaatcgcttctgaaaccacttaaagagtcgatttgcaccagtttccaagaatggaggaggccttgtaaccggttttgcgattgagggaggtacagtagacttattccccttgcctaattaccccttcggccttcaaaaagatgtcgatgtccctcacgaaggaagaagctgtcgtcgctcctccgccaaaacttgtcggctagctcaaggacaagccgaggcagtactcttttagctcgatatgctaaccaagccatgaaccaatcccaagctcggcttggcttgtttccatccctaggtctaggtgtgccaactcctgccagacagtggggtggctcgaaatcgagctcgcctgctttatattcacgatggtcgccattgccaacaccatgggcgctgggaggaagaagctaaagtagtccaagggcacttctatccaggatggcattgtaattgtaccatctacgccacgcagtggtgaacaagaataaaaattattgaaaatcctatacatatcaattagcaaattattaactactatactaattaatatgatataaattagctagaattgagtaatttacctgtggtcctgtgaccctggtaagcactacgtaggttcgcccattgacaccgcgctagttgtcagtggtaatttattaaatcccatttaaacggtggtgtttcaataaaaccatttttttgcaatggcgtgatctcaaacttctccgtgtcagcgtacgtacggaaatatggaattattgttctcaacttgttttttaacccttatatatggtcatggactagtactccttgtacgttatggaggagtatttattttctctggtcttcccagctgtgttgttcaaggagtacatggttgcatctgattggagtagtcatcagctttatttttatcttctctagaccgtgtagagtgactgtagagtgtagacgtaggatacagtactacacaggaaaggcgttcataaatgcgaaaacgataataactgtaccacctatagaacagtgaatttacttccttctgacccagaagtaaatgtctgtgcaatagcatgtggtaaattaaagtcttgcatctgcctcaacattactgctaggttttagtacctttttttctctttttcttttttaaaatactgtgatatgttcatgtctgtcccatgattagtataaaaagctcttaagttcaatcttcagtgtagtactagtagtttgtagggttgatttgcatgcatggcatgttgttttatattaattaacttgcttctaaattccaattgatatagtaaatgagagcttcctggctagcttcctctctctcatacacacaagagacaccatcataagaatgtcttgcaggtatgtcacttctccaagggacagtgtagaacctcaactctgaccatattcaaacacataaaatgctgagcacgatcagtaattacttctacctctgtttcagaatataagcatttctccacatttctaaaatttatctgaaacggagagatgtgatgtgacacaccagaaatgcttatgttttgaagcagagatagtaatatatatagccatcaccatacaataacacaataatgatcacatttagcattattcatgcctcgagctcgaaacagtggtagtactactacatgatcacgaacttaattaaaacacaaaatataagaagggacctaattaaaacaaacaaacacaaccaaccaacaaacagatagaataatcctcctccaaatgcatgtaaagaaaagagatagaagagacactactcataatagaacgctagctagacacagtgcaagctaactgcacatatgaagatataacgcgcgcgcgtcatatagccatccatattgcatgcaacgccgtgcgctacatagagcacattacccgcgcagcagcggcgacgccgccggcgacggcgaggtctctcatggcttcttggcctgcttgtcggcggcggcgggggagccgggcatgccgccgccgaggccaggtgagccgccgccgaggccgccgaacatgggcatgctgccgaagccgccgaggccgccgggggtggagccgctgctgccggggaggctgaaccccgggatgctgctgccgggcatgccgccgaacgccggcaccgcgctcccgaagcggtcgaacggcgggaacgtcgtcggctgcaccaccgtgtccttgctctccgccgccgccgccgccgccgccttgatgttcctcgcctccgccgcgccgaccaccgcgagcaccagcaccgccgccaccgccatcatcttgctcgacttctccatctctagctcgatctctcttgcaaaagctaagctaagctcgagtgtgcaagctgctgctgctgctgatcgatgtggagttggaggaggagggagagaggaggggagaggatttatagcggaggagaagctcatcgtcatcgatcggcagagaagacggtaggtgggaggcgtaactgcggatgttaaaggagggggtacctgctgctgttactgcaatcctgtgatccccattaatacttttgctcttacagatcatcaatataaatgtagtacacatgtaggagtaatatgatatggagtagtatggctctcaatgactttggatgaattggcacaacggaaaggaggaggaggagagaggagagaaatgaacaaaccctagctagatctgtggttgtggttgggagctagtagtggcattcaaaatgttgtgaaacccttttaattagacagcttgcattgcatgtaaggggggttagtgtactaagaccaagtataatagcaggctataagccaactatatgcttatgtggaggaaagagaatttaaaaaatgcagaggattggctctcatacaagagctagctattcacatacttcaagacaaatacattaaatatataggtaagagatagagagaggaggagaaaaaaagaaataaccttatagctcatttactatacatgtttactccaatataaattataagcttatagttagctctattattaaacttgctctaatgaactagttatggattggtgtgcctgatgatgatatcatatggcacttggtaggcaatggaaaacaagagagatggcatattaatggcattgcctttttttttgtgtgtccaactgtgattaaatgtgggatactactaatgaaggacttagcatctattactgatattaatttaacataaagaaaaactttattgatctcagataattaattgcatcaatgtgatattattaatcgatctaagagacaacctgtcaacctctgcatatagctaggatatggatgccctaggatatgcagagagcctgagattattaaaaaggaaaaagtacgaattacccccccaaatctatcgcgctcgtccgaattacccccctaaaccacaaaaccggacattcttcacccccaactatgcaaaccagacaaattaccccccctcgacccaatccgcggtggttttggcctatgtggcgtacacgtggcaatccagtcagcattttattttatttttaatggtgggacccacatgtcagacccctctttctctcttcctccctctctctttctctctcttcatcggttagcggcagcggcgcacacgtcggtggccggcacgcatggcgcggcgcgaggaagggcgatgggcggcggcgcgggggcgggccggcggtcggcgcgcacgcggcgcaccgggaggtggaggggatgggggagaggcgggcgtcggcggccatggccggaagcgtcggggggaggacgggggacggcggacggaggcgcacgttgggagctggagcggtgtcgggaggaggacggggaggaggagcaagagaggcggaagagggaggaagcagcggcggaggaggaggccgttcccgcgaccaaatccgtcggcgccacacggggggacgaccgtcgtcggatccgcacgggcgacggccaccgcacctccccactaccgtcagatccacacggttgcgcaatccaccttgccgggagaggagaggggagaggaggagtgggggagaagaggagaagaaggccgttcccgctcgtcgggtcagggcggggcagcagctgcggcggcggtggcaactgcggtggaggcggcgcatgaggtcctgtgggcgcacggctacgcatcgacggcggggcggcaactgcggtggacggcggcgcgcggggaaggggcggccgccgtagtgccggcgtgtccgagctccacgccaccgcgacggtatgggcatgaacattatgccgctacaaaactataacacgcataagattaataccaaaatccgagatgatttgaagttttgaacccaaacccacagagaactctaggcagctctcggacaaccgacgtataaacgtacccgtttgttctccatttaactaattaaaaggaggacatttttgaaccaggagaaaaagaaagaaaatctgtttagattttagagcgattaatcggttgaagctagacagggagatcaaagaactgtttggccatgactttctataagcatggatacgtacgatagagaatctagttgatcgtgacacttaacactaggaaagaactcgtgtatgcgtgtgagtgataattaatgtgtatcatcctggcaattataacaattaatcattatatatcgccgctcgattgattcatttcatcgttggtatacattatatatttatatggttgtgtgttactaccacgctaatgaaaacggaccatatatatgttcttgagtgttcttcaactttcacggggttaattattaatcaatttattaccacggtcagatcataacctcatcgctgcctgctagtcttgtgcgtactagcagcacaaatccagtactggtttgacaaaaaatggtaggatcaaatatgtcagacattacagcttgcgtgcatgtggtgtagtagctcttctgttctttactccagttcagagagaatcaaattcgctagctggagtactatttccgtaacttggatggagcttcaacttcgctagatagtaacaatgggaggttaaatttctacttgactaatttaatttagtgactatagcaaatgataactattactgttgttttgtttgttataatttgcctttagcggctgaggaataaacacaacttggaactaccagtttatactttgcatacatctgctgttaattgcatgcacctgcagatcgatctactcccataagcagatttatagctcttggaactttggaagaatggtagttgggtgacataatgctactagatgcatgggcacggccaacatgccctgatcagggatatggccggggtcttttggctcatagcatcatactattacacctagctagagattcctagttagctagaaaatgacaagttgattattcgtgtggtccttttatatatctctgctacttaaaaatatggttgttctcttttcaaaccatcgcgtgtaatgtcagaaaaccccgtagaaaaaactgaatcggcccacctcccatcatacacaatttttccccagctaaaaattaactagctagaaaaactcgatagaaaaaataaaccctatataaaactattattccttgaaatcccattgcaacgcatgggcatagcgctagtgagtttggaaaattggtgagattttcctattgccatcatatcttgaaacgactcttcaaattaataaaataataaaatggcgtcactgttaatgttatatgtgcataaattccttttgctcttaatttgattttaattgtggcatttctctaatgtcctagttaaaccattttttccaaaaaagaaaaaaaaacctaagccctcatttcttccgtgcgatctaaatagttataagagatccttcaaaaaattagaaaaataaatattgtattgggtgtcttagcctataaaaacatgcataatcaaactcgtctatatgtacggacgaactaaaacaacaatccaactactttggtgccattggaattgttattttgtttctgcgtgtgtggattaaatttgaatttacatgttagtacatggatgtatatgacatgattatgtatttcaattcatttttaaatttatttggaccatgtatatgtgaaagcgtaagattaggaagctttgtaataaagttgagggaatgtccacaatacctaaatttagacagatccaatttaaaagattttataggttcattaattaagacttggcagaagaactaataagtttctctaacagttaaagacccttaagatcacaaaattaatttcatttcaaaattatttgcaaaaggatatcaatttgtaatacatgaagccatacatcgttataagcaataattaaggacgaccttataagatatatatataattctccatagtgtggtagtacgtactgcatcagaatatatgctagctatgtacactactagcctagtttacacgcagtacatgtacgtatacgcccgttgtgaattgatcacggtgtgacgactttgagccatggatagctgtatatataacgatccacggatcggagtcacgcgccagccatcgctagctaagctgtgtagccccacagaggcaatactaacccgtttgggatagaatttttactggattattactatttactatcaatttcattataaaggtaaaaaatattataaacatatatataaattttacagataactcagaacaattggtctaagcaatacagtagattttctaaaggcattcatattttttaaaaaatatgggaaacgtgtagtgtaaaacaaataatcggtgtcactgattcgatgaagtatatgaaaacaacatggcccactgtaaattagggggtgtgtacgtgaatggtttagacgacgcgatgaggcttacaatcttgtaaatggccaaaaattcagaaattttaggggtcaccaaaattttttaaaaatattaaaattatttaaattttaaataaattatgtctgaattctaatatattttggtcagctcataaaaacttgaagaacaaaaataaaataaaaaattcagatgggatagtttcttttttagataatggattagattaaaaccggcctatacaaatttgtggggcgagacagtttcatgcccagaggatatgtgaaactaccgaaatttccatcctagcacgatcgatcaagggattggaaacctctgacgaacgtggtgcctgacatgtggaccctacctctcgcgggcccacctatcaatgaccacgtcaggggaagttcacgtcagatggtccctttcctcgatcgatcgagttgatcgattggtggcaagtggagagcgccggcatgcatgctgcgtcacgtacgtcggtgacatcgatcgtcgttgcccatggatgcatgtctgattagctctaagctgcggcgcccatggatgagtgagcgagttagtgaccacaagtccacaactgatggacccagcagctagcttagctgatggagaattaacgagacgagacgagctagatcgacgtgtgagatgacatgagacccgtgcaaagacagaggaaggcaggcacagcaaattagctggaaagaatgagagagaaaaggaggtatctagccggccagttaaccccccaaaaccgaccggtacgtagtgcacacgctgccagcttaaattcctcaccggacaccggacaccggccaaccagcaggcccctgccctcctccgtgctccctagagctatcgcatttaggcctggtttagttcttaacttttttttcgaacttttaattttttcatcacattaaaacttttctatatacataaacttgtaactttttcatcacatcgttccaatttcaatcaaactttcaattttaacgtgaactaaacacacccttagctaattatccaagtaggtacatgggggctttgatttcttgtttccttttcctttcccctttccccgatgattcttgctcagccaaagtgtcaaagtgatatatactctgtgatttatttcccgtgaaactaatcgatccatcgagctaaatcgctctctagcacattggatcctgctggtatatattctaccattctggtgcgctcgctcgcaggtgaccacaattccgctaaaatcaatcaaaatgcactaacctatagccagcgcgccctcctggtccctggggagtagtgcactgtggtggtggagtagtactccttaaatttgaacatagtttatatttagattaaaatttaaaagtgaaattcttttgggaccgagggtgtacgtagctgactagctggtggcgttgccatatgcgtacgtatctggttttgcttagctcaacgcagtaaatgagagctacgacgacagctgagcagggagcaaaggagggaacagagagattcagagatgcaggtgtatggccctgtcctgccctggatccgtcaatcgacagccgatgttgcctggcaaatgtcacatttctttgcaagttactactccctccgtttcacaacgtaagtcatcctaacatttctcatatttaaattgatgctaatgaatctagacatatatatctatctagattcattaacaccaatatgaatatgagaaatgctagagtgacttacattgtgaaacgaaggaagtagtacagtaattaggatgggaagagtacgcacaggagtgtgtttagttcctgaaaaacgttagaagtttgaagaaagttaggagtttgaaaaaaaaagttaaaagtttatgtgtgtaaaaaagtttttgatgtgatatgatgtgatggaaagttaggaatagggggaaactagacacggccatacatatcgagaattctcgagatgtttcattcattcattaacttgggctgtagtttttacttgctgtccattagccatttgctgcatgctggtgtactcatcacatcggttttccgcctcgcctggacgacagccggctaatccccatgcgcgattctccagccggtgacagctccgtgaatttcgaccccgtgtacttaacaatacttacccctgtttgcttttattattaaacttctgatacctaaaaatattatgcacatatgaacacgccttcgttttcaatcaaaaatttaggtaagagagatttgttg

SEQ ID NO: 50830 - DNA, 6110 bp, Oryza sativa
  unsure (1)..(6110): unsure at all n locations
tgcacattattaagaatgtttttgaaataaaattattggacaagttttgaaactatcaagaaattgaaataaatattagacattttttttacatatgttcctttagaaaaagtatttctattttccatgtccactcacataatctaaaatttctacaataaattagataggtaactaagctaactaattcgctatacgcaagtttgttgttattctactgtaatagttgtactgaaataatgaataccttgagaaagtaagactatatctttctagagggaaaaaaatgatgctaattttgatgagaaattggtaataagagatgtttggattgacgccggcaaaagataagtatgtgggtgatgtcaagatatttggtaagataattttttttcacgtagtgtttgattcgctatcatacacacatactgacaaaaacaaaaactgcaatattgactgaagtttccgctaacgattttgccaaagcatcgtggcccatgcaccagctgcctatcggcccactaactaaactaattctgaccgaagatgccggcccgctatctcaatgttttaaatggctttttggcgctttcgttgcacagaaaatctatctaaattgagaagcacaacaggagttcacttggccattgcttcggttcgaaaggaaaacgtcgtattgtgcagttagtgagtaagcgtctttgtgaaaagagctccaaggtacagtctatctgggaaatagttatgttaattatttagtacacttaaaaaggctaggatttttgcggcgcgtaaacgaaacaagctattgttatagttaattaagtattaattactgtaaacataaaaataaacttatttgatttttcttaaaaaagaaacgtatgtataaaagacttttacataaatacattgctgggtagtttgagaatgtgttcgcatgatatagcgaagcactggctcggtcgaaccgccaaagacagggcattaattaggtggtcaatacaagtactccttccataaaaaaaaaacctaacctcattctaaaatgtgcagcgaattaaacatactctatgtccagatttattatactataattgtcacatcttagtattaggttgtcttttttttaaggatggatggagtagagcaatagcaatagtcccagtacactaagtacactcatcgatcaaagctcttattttcctcattttttttcttaattatagtcggtgcattgcataagcataataacgctcaacagtatctgccgcctaaccgcgtgcgttaatcatacgtacacagacccagtttggtttgatcctctatcaaaatttccgtagtgtcaattattgggtaagtttgacgcaatcaaataaaaattagttggtggagttgataagatgtgtcgaaaatatttcgagaggatagaacttaggctagctaaaaattatcaaatataaatgcatgacaattacattgtactctttcagttttaggttataaaatattttgactttagtagtcaaaattaaactgattcaagtttgacaaagtttataaacaaaattagtaatatttttaacccaagataaatttattataaaaataaaattaattattaatttaataaaactaatttgttaatgtaaatattactgcatttgtctataaaattagttaaatttaaagtagtttgactttgaccaaaatcaaagcatcttataacctgaaacggagagagtaatttgcactacaatgcaatttgtatgtagttttcaaaactcctatgataacacgctattttcgtgaagcgaaggctgtgagatagaatctcctcacctgtacgcgcactatgattgttttcttctcccaacatgcacaaatcttgaagtaaatgtaatgatttgaaattatgcagaagttacgtccaagttacaatataattatattgcaattgtactatatttgtatttaatacttttaaataaatttatcgataaatatatagagaggaaatagcaaaactatattttgatactgtagaaaaataaactgaccagtggcagtagtgacaagaaaaaaaccgtggcccattttctaaaccaatttctggccgaagatgccggcccactgtctcaatcgggcccttctcatgtaggccttctcctccgccatgaacagggccccgtcaaggcccatgtggccacagacgaaatagcaaaagtctcctcgcaaagatggccggagacgacgaccaaccacggcggcggtggcggcgcagggccgggattccgggaggggacgctcctcgaaccggacagagagagagaccgtacagggcgtttattcggtcggtcgccgtggggtgggggcgccacggccacatgcccgacgatgggcgatggccacgctgcgttgatagctacgtcacggagctcgccacgacggcatcccatgatgattcacgaccgccatgcacatatgctttgccccagcgtatggcgacgaagacgcgattgcgatgatggtcctggtcctggttatggttatggttatggttatggttactagtactcacgttagataggccaagagcggcgccatgattatgcatgtgtcgatcgatcaatcaggaggtgtgtagtacatgtgtacttcttggatgcaaatccactgctgtactgtacctgcagtacgtttcacctgacgtgtgggtcccacctattccgggcccacatgtcagtggcacttactgcacatgtattacaggagaggatcgtaactcgtacttcttcggttccagattaaagaaaatataatatctagatctataatagtaatgtttatttgttttgggacaaagaaaatacatggtaccatctccattctaaaataattgtatttctatcatttaaattttatcttaagaaaatatatttcttatatcatacaatataaaggattttgattggatatgacatattctaatactacgaatctgaagtacagatttgtagtactaagatatattctatctaactaaaatctcttatattttagtatgaattgagtatttctactaagcaacaaattagtatttaggtaaagatataatccctatatttctacgcacatcacctttctttaattaagtttacatataaaatatgtgcatgtctagtggtcattaaatagggttattactattatttttacggctgtttctaatcctctagtatcttagaaattaattattctgaaatgggggtggtactagtatgtacagtatgtatcatgttcgccacatccgtatactctactctattattccgccgatcaggaggcaggacgtatagtactccacgagagtatcgactggtatagataaaattattactccctccgtctcaaaatataaattttttagactttgacgcagtttttgagatgctaatttgatcaacaataactataaaagtaaaatattttagataaaaagagttacatattatgataaattgtataatgataatctagtaatgtcaattttacatgattgcgcttttttattttcttgctattgatagtcaaagttaaaaagtttgatttgatactatgttaaaaatacttatttttaagatggagagagtaatagtgtatgtatatgtgatacaagtacaacggcatgatctaccccagtctgagggcctgtttggtacagttccaactcctaaatttaacttcaggagttaagtctggagtagagttgtggagctgtctctaattaattttgtgagagagctccatccagctctactttcagttttggtggagctgaaattgtttgtcagctctagaagggatggagctgtgaggcccaagagtcccagagacccagatctactccggtaaccaaactagataatgcgtgtcgttacgagaagtaattaaccgggaaacaaatcatgggttgttatgtggactacagcctcgacgacgcagctttgctagcgccaccggcgccggcggcgagcggccggngnacagtgnccannncgatnnagnncnctgtccccaaatccacggccaccgcaccggccagctcaatttttttcctttctcctttcccttttctttctccttctctttttcgtcgccatggtccctgcctctggctctgcaggcagtagaagtgagctcctgctgcacaactagggaagtgatgaaactgcaacgctaatcacggttgaccggcctcgaaatccgtgcctgtcgactgtattaactctcgctatcttcgtcaggagcctcaacctgcagcatctggacatctggatctcagttaaatttacgaacgggtcctttctcaagtccagttccctactgagagcactctataataatagagttaacttcctaatattaatcaatcttaaaaccaacacatataatagattagctataaggttggatataattttcttctcctctctctatctctcacttatatattaattgtatttgtcttgaagcttatgttaagctagctcttgcatgagagccaacacccttaactttttgttacatctctcctccacataagtttataataggcttatagctaactattttacttgctctgagcttagctatagataggagtagcacgcagtagctactggagtactcctccgtaaaaaaataagacaaactctatatttccgtgtccaacgtttaattgtccgtcttatttgaaaaaattaaaaagataagtcacgcataaagtattaatcatgttttatcctctaacaacaataaaaatactaattataaaaaaatgtcatataaaacggacagtcaaatattggatacgtagactcaggttttttttttttaaggagtactcaagtttagtgggaggatttaagcaggaggcgccatcatgagctgcggtgatgattgggtaggtggctggctaattagggcttaattaatcgggccggggctcacacctcgcctcacatggggaggtggtcttatccgtataggagtactagtgtgcaacgcgcctacgaggacgccacggtatacccgcgcgatttgcatctcatgtgatttcgatttttcttcggttgggtcattggcgagtaagagaaactagaccgaaggttcaggtccttttgaattacattaatggaaaaacaaagcaataggtaaaccataaacttctgatagaaatataagtgtaaaataaaagattagaaaataaaaaaaatataggaattaccgtttgattggagcatagaaaaaacgtaggaatcatatgaaagatagattcaaagggattttccaataggttgatctcttgcaacttttctttaaaatttctatacaattacccataccatagaaatttgaaagtataagatatgattcaatccttcgttttaaaggcttctatatgaattgaatcatccaaattttctacacttttcctacaaattaggccctaagccagaatttgaaatattgtaatttattttatagtattggttttttaatagttaacaacatgtatgtaaaaattttactcatagattgttattttaattactaataaacaatataaataagcacatgccgatggacacgtttatttatacatcctcaactcataagccattacagggtttcactcatgtatcttttcactttggtaaattttgctacaagacatcacgacttcgtgtttttagctccaggacaccgcacaaagttactttttgggaaaaacactcttaaaatatggttatttgctagcggacaccacgccattaaaataataatttccggttgaagaggagagagaaatcgcgtgaaatgtcaaaagtatccttgggcccacatgtcagctctcttatctctgtctacgaggcgaggcggggcgcggtgccaccaacagccggagcggcgtctacgaggcaaggcgaggcgaggcagggtaacaagtttgcgtttcactttttatattctgggagtaacaagttacaaatagacttcatgctatatactccatccgtccctaaatatttgacgccgttgacttt

SEQ ID NO: 50831 - DNA, 4970 bp, Oryza sativa
taacaatgaatcaaatgataggaaaagaattaataattacttaaattttttgaataagacgaattgtcaaacatgtttaaaaaagtcaacggcatcaaatatttagggacggatggagtatatctctactattataaaaatttttgccggtactttttgtacgtcatccgtgtatgagtcggttttgaagttcgttcgctttttttaaatacatgagaagttgtataagaaatctctttaaaaaaaacttacatgctaacttaagatgatccgacttctaattgcagctcatgatttcctaaaagaatatatatatatatatatatatatatatatatccaagtgaattctcacagtgaatttcatcttaactaaatagtataacaataataaaattaaaatagcctttaccgtcgcaacgcacggactttttttttctttttttttaaaagtgcatcatgttttatatacttcacttatttcatgccagagaagaggttttttatttattgagctttgctatttcgggcatgttcatcaaaatcattaggaacactaaattttgacattggcaatttttagaggtgtttgatgtgtttgatttttgagctttaccaagttaagtgtttttatgagaggaactctaagactaccattttggtagagtagcaacgataataacatgtttaatttctgaaactactctgatttggtaatgcgaaaatttgttatggtcgaaagtgacaacaaattaaacatgccatctcatgtgagttttgtcttttattaagactttttttaaaaaaactcaaactttattagttgtgcgcatcctaaatacagaggtcacggatgtattcatcttccttatctttaaaaaaattgccgtgagtgtatccggagattattttctatatggtgaagctttaattcgttgagaacaatttcacttatggtcatgaataagaataggattcgtctgtgaaaccgaactaaattttttgaaaaatcaatcgaaattgtaactttggattacagaaggtcaatccaaatcacttaacatctcatgtataaaatccatccttactcccaattattgctaccacatcacaagtataaattccacccttcagcctagcctgctcacttcgaaacaagcctataacatgaagatagttagtacggagttcatcacaagccttccataatagaaccattaattttatatacaactgcaaagagagctacagtgatccatgcattccgttggatcaaacatgaatgcgcgagaccaacctctatattaatccacaataaaccccccaaaaaaataatctagcggtatatttcattgtttctacaataataacccctaactagcctgccggcactaaaccactggatcccatcagaacttcaaagttaagcgtagaggctgtatacacccccgttaatatagaagccggattttataaatttccattatctaaaaaaattagcctgccggtggcgcatcactgcacctttttcctccttagtttctgagcacttatgaatcacatatataagaggttgtttccaggaatgaacaggcaaacctgaacaaaccgatacattgttgtgtgcaagaagcctgtctctaggcagaaataatcaaacacgacgacaagatacaagatagttgtatcagcttggaagccgattttctcccttcttcaatttgtaaacatgtaactgtataacgatgcgacgctatcatcgtccaaacagataacgtgtaactttttttctttgctaatggaagatttaagtggggaagctctcccctagatgattactcaaaaaataaaaaatccgtccttagcccttaatttatacctcctccataaaaaaaacaaactagaagaggatttttttttggacggagggagtaattgttacccgtttggtttaggtactaccttgccttcaacatcaatgatgaggtcctctagctttaatttccacaataatgcatgaatcttcatgcacaatagccataaatttgattgctcagggaaaaaatatgtacaaaacccctaaaagcattcaagcacgtcatcttctgattccaaatataaggtcggtctacataatgtctgtactatatagaagtacatacattggtgatagtgaatctaccgttacttagagtggccatattcaaagataaatatatctttgtgtgtgtggcttggtttttttttttatgtttgtttgctatattttttcggacacaattatcatttctaagttaagaaacttaagattttttttttgaaatccattgcaagtcacaattattttgctagtttagagtaaaacctcttatcaaagctagcacaaaatgtctaaacgaagaaataatacaatggttagatcacgagtataaagcataaacactaaacaccccgaaacctcctagactaatagcgctgtgccaacactttctattcagttctcatccactccatgaccatgcaacggtgggcggccacacatgttttgcatgagacatgaaacaagctagcactgatagtgatatgtaacacaactctctcagtcataaaatatgttcatttttcaccatcttacacataaaatacaaaacaaaaatattaaaaacattcttattttatcaaatttcaatgtagtcatttctctgattatctatccccaatgtatgttttgcatgagacataaaacaagcttagcactgatagtgatatgtaacacaactctctcagacataaaatatgttcatttttcacccatcttacacataaaaatacaaaaccaaaaatattaaaaacattcttattttatcaaatttcaatgtaatcatttctctgattatctatccccaatacatttttaccttacttttataaactccgattcaataaccgctaaatataaatttattttaagataaataggaagagcagaaagctagctcggtcagcgctctcgtcgtcccttcctcccttccttccttccccttcctgcgtgctacggcagcatgaaaaaaacggccgccggcgctggcacgtgttaaacgaggctacgaccgtgccgtaacactggcgtatgcgccaacctggtagtactaatactcctacatcatacgagtggatttggtttgaactttgaaggagcctcgatttttatatctacgtcaacattatagttagtaataatagacatatctcatattttcgatgggtggctgctgggggtggagaaaaaaaagagtaaattaatattggtgggagctttgcaatttgttgggctctgtgattgtgtaggaatgatatggttttttttgacaaatcaccatatgtatgcagataattttcagggcaacctattggctccggttttaggcataactacaaaggtgtgatgaagacggtgagcttttaaaagctgcatgtcgtaagcttaagacgacggttatgcaactttttgtcaattatggatggagattcacaaatagacttcaataatgtgttctgatcttgttttggttaaatttacctttgtgtggtcatttcttctatcatttctgaactacactcgttttagagtgctagattataataataggctgtagctctctttgagcaaaggccgggatgactattccattatcttaaaaaaagtaataataaacacagattgatgttaatagccattttcttggaacaagtcaaaacccaaatgatgaaatgagtagcactccaatttataagctttcgaaccatttgacccaaaatgtttagccgtgctatcgttttcggtggagagaactaactaaattaaacctgcgtgcttcgcttccatctcattttaagggtgcagcttgctcagtgtaccgttaattaattatacagtgaaaatggtcaaacctttgtctagcttgtctttacccagacggaaaggaaaacacgcggtcaaaattattgaggatgtgggtgaaacaaccacctcgaactctatagtgagaactggagtactccgtatatgtgaaaacttgttgacattgtgtttgtgtggatatgttcaactcgagtggtacttcagaaatttgactgccgccgtattactctttctttctttcatggttttctcaagacggtttttttcacggcacgtttaaatcattattggatttgtagtttgtatacagcttacgatcgaattacgatgagggataggtggtaaacgaacaaggaatagagaagagataaaatgagaaagaaagaagatgggagcagtcaatgcatgatggccttgtttagttcgtgtgccattttttttaagtatacgaacacgcatttaaaatatcaaacataaaataataacaaaacaaattacatattccgtttgtaaactgtgagacaaatttattaagcctaattaatctgtcattagcaaatgtttattgtaacatcacattgtcaaatcatggtgtaattaagctcaaaagattcgtctcgcaatttacatgcaaactgtgcaattggttttttcatccacatttaatgctccatgcatgtgtccaaacatttgatgtgatgaaatttttggaagtttgaatgaaacactggtggagaaaccatctttgctcggttagcaaaaatacacaatagttccggttacaataaaaaccgggattaaagattatctttagtccggttcaaaagtttagagctgctttttaatctttagtcccggttgatgttaccaaccgagactaaagatctatttttaatcccggttgataacaccaaccggaaaaaaagatgcctactatctttagtcatggttggtgttaccaaccaggactaaagatctatttttagtcccggttggtaataccaaccggaacaaaaaattgtggaagaaagtacgaggcatctgccatc

SEQ ID NO: 50832 - DNA, 20861 bp, Oryza sativa
aatatgtgatgtatttgtgatgaattttgtagaagttgtgatgtaattttgttttaagattttgtgatctatttgaatatggccgatttggggatttgaggattggggataatttatttgggattttgggatggggatagagtaaaatcaatatattaaaaacacaatgaagaaaagaaaataataatagagcaaccagatctagctagctaggctagctctatctttagtcccggttggtgaaaggctctttttagtcccggttggtaacaccaaccgggactaaagatgtatttttactcccggttttttcacctgggactaaagatcgtcccggattggtagtcccggtttgaaaaccgggactacagggggttatgaaccgggagtaaagcccctttctccaccagtggaactaaacactgccaatatgtggagctcatgaatctttttaccctgttctgtaaaaggaagtgaatggtttccgaacccatccgttttgcggcatatttgcaaaagaaaagtaatttgtaaataaaacttttatatgtgtgtttttagtgatctaaaagcaaaggctggaaaataaacttcgatgaaaaaacccccaaatcaactctacatttaaggctaaaaatttaaattttggctgataagtataagtataagcgaaaagacgaggcttttcattagtttgggggcaggggtatatcaatttaataaatgtattttagatgaataagttaggaagctaacatgaacttgttttcttaacatacgtgtagtaagtttttacatgaatgtgatccatctgtcgacgattgaagtagacagacaaccatggtaaatgcccatggctagcaaaaaagagatttgggcatgcttatggcatgctaaaatgtggacaccctacgcaagatcttttaggattttctgtcgaccactttacaacgcgatgctctaaggagtggccttcttcaccatgtagacttgcatctagcgcagaggaaagccgttgccttttagggcaaggcttagataactaacgtggaggaaagttattgctttgtagggtaaggcctagatagccaacatagaatggagcgtttatctcgtatggtgttaaggtgccttctgcaagacacgaatgcagaactagatacttcatgtgcaccaacaccgatcaaaaaatagaatataatgcatatacctttgttgaccgaaaactctaaacaacttgacgacaccagatttgaggttcacaacgttgaattgaaggtgtgcaagaatcttgatgttgcctaggggtgaacgtgtttaaatttttcgcaatagataagtctcaaaactaggagcgcgtagatgcacttttaaggtcgtcgacaacctagagatagaggagccgacgggaggagagagagaaagagcatatggatggtgctagttgggtctaaggcaatgacactaagtccagtcagctttggagccaccgacagtgagatggatattagcgactcaggtgagaacaacgacgctatgactcttgatgaggaggagagatacatgagaaacaatgtgacgatagagtaacgtagggagaaaatgggttgttatgtaatttgttccttttctattggcctttatccgtaattttttggcctaaacaatatgaagaaaaatatattacattgatttatatcatttgaagccaccacgtattatgccgaagaaatttcttaagagcacgacttcgatacagtaggtagcacagtactgtatcacactttttctcccagatacaatataagagcatctccaacaacctccttatccccctctctaagttaaattttagcaattttggctcaatttcatcctccaacagactggctatcgagctggccaaagtcctccttccactagccaaatttggccagctaaaatagcctagccaattgtgggccccacgccgacagcatccctctcccctttctctctccgccaactgtcgtcgtcaagatgccatcgctggtgctgtcgaggttgtcgttgccggacgccgccgtcgcccgccgtcgtcgcgccggcgccagatccactattgccggacgccgccgtcgtcgtgccattgccagatccgagaggtcgtcgttgcgccgtcgccagccgtcgtcggcgctgttgtcaaccgtcgtctccgaggtcgtcgttgcccgacgccgcgccgtcgctagccgtcgtcgacgccgtcgccagattcgtcgccagccgaggtcatcgtcgcctgtcgtcgtcatcgccatgccccggcggattcggccggtgcggcatatggtagaggacgccgtcatctcgctcctgccgtcgtgttcgccgcccgtgccaattggccaccccgcgtccatgcgagctcggcccgagcggcggcggcggcggatggcgatggggcggcggcagcggcggcggatggctctcggtggcggcggcggatggcgatggggcggcggcggcggcacctgttgcgagctaagcagagtgcgtttgaggaaaaggggggagagatgaggaagaagaaagggttgtagagactgacacgtgggtcccactgtcataggcaaataatagagaggatgaatggataggctgttggagtaaataagagtttgactggctaaattagatggagagttggccaaatagacatttggagagttagatttggagagactgttggagatgctctaacaaaatcacaatccccattgtaattatccacggagtaccgctaggacctgtttgacatagctctaattgctaagtttaactctaagagctgggtctgtagtggagttgttgatcagactaaacccgctccacctatgtggtttattttgtgatagcacttcaacctgctccgtctcctattttaaaatggagttgaaattgtttggttggacttcgggcctgtttggatccagggactaagtccttgccacatcgaatgttgggatactaattagaagtattaaacgtaaactaatgacaatacccatttcataactttgaactaattcgcgagatgaatctattgagcctaattaatccatgattagtctatatgatgctacagtaaacatgtgctaattatggattaattaggtttaaaaaaattgtcttgcgaattagctttcatttataagattagttttgtaagtagtctatgtttaatactttaaattagtgtcaaatattaaaagagagtttagtcttccgattcaaacaccatcagcttcaatagctgtgaaaataattttcttggattcttacatggatgacgatcctgtaccgagcaccgtagcactagcacgttccaagggcgaccaaaaaggtactacacggttttgccctttccatcctgtacagcctccgagtttcatcagcattcgaaacgattttgaatcaagcgtgtactactactacccatggtcctggaattttcacccgcatctgccctgacccatcccacctccaccaccaccacctgcgccgcaagcatcagcccacccccgcagacgctggtcctccccttcctcctcccctgccgccggtgaccgttcctcctgtgcacacgcctcgagttcaaaactcaaaccccagatcagatctaaccccgacccaaccccaaccaggggcagattcgtcattctccccccacacctttattcgaatcttgcgtcctttgatgcggtaaaaaaaaaacaaacaagtcacgcacaccaacaccaacaataatgacccttctcccacacccccactgacgcgtgggccatcgcggagtatgggccccactcgacagcgacacggacgggggctgcaccgcgacgcagtccccggtccgggcgatttgaccggtcaaaaggcgtggccacgaaccaaaccccaaggcggcagcaggtgggccccacctgtctgtgggcgtgggccccgcgtcctgtggtggtggtgggtgctttgactgcacccctcccctccctcaggcggaaatcatttcggtttcggagagagagagagaggatttttttttccttcggcttatgtagtattgcgctgcgtcccgacaagcaaaagcaagaggaggaggccgcggctagcgagcgagcgagagagaggggagaagaagaggtgggacagccgggagatccatccctgtggagaggagggagggaggaaggaggcgttggaggaggagaggtgcgttgcggtttgttcgttcttgctgcttcgatttggtttgcttcttcttcttcttcttcttcttcttcttcttcttcttcttcttcttcttcttcttcttgtttgtggtttgaggcgattacaacgcgagttcgccgttctgcgagggcggtggctgatccgtctgctgggatctacgttttcttcgcggtttcggtggattttgcgggggtttcggggattcttgagacgtcggtgtgttgcggttgtgttcaaacctcccaagcgcgtggattctttttggggggtctctaatttgtgtcggcgattagtcaacgtggagcaattatacggatttccgagggattttctggtatttattgctgcaaatcgggcaagttcttggcttcggatggggcttggagtaaagatagatcatttacgccatagattcgtacccaaatgctcagttttttttattggtttgcactttccccttcgttagaggctcgtatgctcgcgcctgcctcatagcagatgcggatgagttcaaactcaagaatagatgcagaagagagcctgaatcaggaggagttcgtcaagaaacgtgaacagggtgcagggatccctattttggcttgattgaaggcggttttggagggggaaagttgcttagctgaacaacatttttgcgcatagcagcaaactgttgcttgtgttggagccgacggcaatgaaagaatgccttttttgtagctggttttggacataaagagtattttttatggttgctttcttgctaaaaatatggtgttttagtgcaagtcattcagtgtaaatctccaagcattcttatatacttgttccttttcctcctcctggatgagtcttggatgagtgcatttctctctgttcatctctttgctcttcacctgatgattgtttcatggtggatgcgtgttagatgcactgagttgcttagcatggtgaatcagtgctttgtgaactgcgtggttccactttttaactgatgtttgttattgacgatctcgcaggttgaccgatagatccattgcggagttgagtgttgatgcaaagctgattcgccatcgtttagctttttataagagatgggttcagtaggggttgcgccgtctgggttaaagaacagcagtagcaccagcatgggtgctgagaagttgcctgatcagatgcatgatctgaagataagggacgataaggtaagtctatcatgatgagaagtttaatttcttccatgtgccatgtaaatttgactttgttgtaacatgtcgaactgaatggtaaatccaggaagttgaagcgactattattaacggcaagggaacagaaaccggccacataattgtcacaactactggtggcagaaatggtcagccgaaacaggtgatttcctgataccatgttgtgatttcagaacaaatgccatctgactgtcgcgatctgaaattgttcatcgattataaagcaatcttcatttctaattgatattcttggataatcttgcagacagttagctacatggctgagcgtattgtagggcaaggttcatttgggattgtcttccaggttagttgcaacatctttgggttttcatatatttcaccaatcaccaggaagctaagtagctaacttaacatcattaactctactagcaccactttttttgtatgtagcaaattgttgatacacgataaccttctcttgttaagatgtcctaaatgttcttcatgtctgtaatagtgatatcattttgaccattttcaggcaaaatgtctggagacaggtgagacagttgctatcaagaaggttcttcaggataagcgctacaagaaccgtgagcttcagaccatgcgccttcttgaccacccaaatgttgtagctctgaagcactgtttcttctctacaactgagaaggatgaactgtatctaaacttggttcttgagtatgtgcctgaaactgttcatcgtgttgtgaagcattacaacaagatgaaccagcgtatgccacttatctatgtgaagctgtatatgtaccaggtaatattctgttatgtacctttttggatactttgttcttttgacttatgttgtgtagcaggctatattcagacaaactagccagtagcataccgagatgactttgaatttagtttgaaatttgttgacagatttgtagggcattagcttacatccataatagcatcggagtttgccacagagatatcaagccacagaatcttctggtatgcttgaatgttgttacccattcatctcaaataccaccctcttatttctgtaactttataattgatgtttgaacttctaatcaggtaaacccacatacccatcaactcaagctatgtgactttgggagtgcaaaagttctggtaagacaattaagaaatccacaacttgttatattataagcagttacagtctggtcttatcctccctatgtactaatttgtaggtcaagggagaaccgaacatatcgtacatttgctcccgatactatagggctccggagctcatatttggtgccaccgaatacactacagctattgacatctggtctgctggatgtgttcttgctgaacttatgttagggcaggtaagcggctggattttctttgcacattttggggaagtttgttgtttaccaccctggactctattgtcgaagtcggtatgccttacaattgttttctgttcgacagcctctgtttcctggtgaaagtggtgtagaccaacttgtggaaatcatcaaggttagtgccaattctggtgtttagttggccttgcgagttgttcggaggtgcagaagtttgtaacattaaaactgatcacacatcgcaggtccttggaacacctacaagggaggaaattaaatgcatgaatccaaactataccgagttcaagtttccacagattaaagcacacccatggcacaaggtgcaaagtctatctatttctgttgttatactttcagcaatcgtccagtatcaggtgattaaccatatatgtaaaatatttaggtattccataaaaggttgcctccagaagctgttgatcttgtctctaggctgctccagtactcacccaacctaagatgcactgctgtaagtatatatttaatggttgaagtacagataaattagtattatggcacttagttcctgagataattgtgcagacattcatttcataaatattttctgttacctttgaccaggtggaagcacttgttcacccattctttgatgagcttcgagaccctaatgctcgccttccgaatggccgctttttgcctcctctcttcaacttcaagcctcatggtaagttgtgaaacatgatcacatttatccttgttgatattaccagttaaagtttgttcaagcaggcacttcaattgttctggttatttccgttgtaaacttacaatttgggagctgcaagtcataactttctgatatgatcagctacttacgttgcccctttcttgtttcttgcagaactgaaaggaatcccatcagatattatggcgaaattgatcccagaacatgtgaagaagcaatgctcctatgcaggagtatgagacagcttccgcacgacccccctggaaatttccatgacaagtgcccatttcctcccccctggacgacgatggatcgtcagcatatgcgtgcatgatggttggtgaagatgtgaagttacgttgttgttgtatgaccaccttgttgaccagtgtagttgagtagcagtatgttgcgatggcgaaactttgacatgtaaccggtgcacccacaccatccctcccctactaaccctcacccacctgagaattgagaattcccatagctgatgatctgtaatatgttctagagcagtttaagaatgtatttattatggtgtagttgatccatatgttgggatcctcctcgtcgattttcttggttctttgtgccctagactgctacctggtttttagactgttctgaaaatgctgctagtaccttctatctactgtacttgtttgctccttggtgctattgctccagcctcagctatgaggatgctctggcatatgaacgtatggacaagttcgtcgatgacctgaccttggtagttttacctgtgttcgagttgtgctggtccaggtgtttggctgcgttgcaaggtgtgcaagtttggttcgtccgcagaggtcatctaaatgctgttaggagtctgctaacactacttgctcttggaaagttgtaggggctcattttggacgtagaaatttcacaagattttagcacgaatcagttcagttcagttacggaattcgtctaaaattaattgatttctacagatttcgcttgaaatttcgttcgttccaaaaggaggcgttccgtttcttgcagaaattaacttctctaaaatctagcgttcctttgctactccgtagtttccgtcgaataatgtaaaatataatcgaaatgtaaaattcaaatgtactgttgttcatgaacactttgtactcttcagtctcttttcgcccaacagcagaaactgctggagggagaagatcagaattcagaagagttgtcgagagagagaagagaagccgcggaagggggaaaaaagggaggcggcggaaggggatcggagatgccgctgggcaagtactactgcgactactgcgagaagcagttccaggacacccccgccgcccgcaagcgccacctcgacggcgcccagcaccaccgcgcccgcgccctctggtacgacgccgtccgccgccaaggttgcccccccactcctcctcctcctcctccccttcgctcttctcgctccgacaccttctgacccttctcccccctcccgcagagcttcacggcggcggcggcggcgctcctcccctcctccaccagcccggcgccgccgccatcggcgtctgccaacacttcgtccgtacggtgtgtacttgcgattctgccgatcttattacatctgttactactcaacgaggatgactaacatttctgcaattgaccccattttttggtgtttttttaggggacgtgcaagtttggggattcatgtagatacttccacccgaagccacctcctgctaatccaggaccagctccttctggtgactgtacttcttgtgctctgttttgtttttaaatttttgagtaaattttagaaaactgcaactatagtgacaaaactatcagtttgctgcaataatagcgttggaaataatcacaaaactacagcttttacgtgatatgctgctatagttgttacctatgtgtaccgtagcagtatatcatgtaaaagttggagttttgagataatttcctacgctattatttctgcaaactgaaatatatcagtaatgttgcagcaaactgatagttttgtcactatagttgcagttttctgaaatttactctaaagtttttggtatatttccgcaaaggtgatttttagtaagattcttcagtgaaagtctgcttgatgttgggatataattgttcgttatattctacaactcattggattgcctttgcccccattgggtgttgatctgaactatatagacttcattacgtactggcgcggtactgccattaggtcttcacagattcatatacagttgaattcatcttgatgttggcgcgcaaagcgaagacgctagcttgatgttaacttggtgcatcgaattgccgtgcaacttagttattttagaggatcatctgtattttgcccttgtttcggaattctaccaatacctttttcttcctccagttttatctaagatgaagtaattagctgcctgtaagcttgtaaccaagtctgttggattatatttttgcaccattgtagagcactgctcaattctctcagccccgtgtagtgtacacaaaacaaagcagggtagtatatttgtatgtgtgtgcaattgtgaattgcaaatacacaaatgcaactttcatgaaattagtagcctatagtactatccgcatatttgagtttccttatcagttgttactactattatgagtgcacgacaaatttacgacaatcactgttcctatttctataagataattcttagaacacgttgttctaaattagattaaaaactgtggataggacttaagttctgacttgcccttttattatccaggccctgtctctggaccaatggcgcagcagtctaatattcaaggaagtcaacccaattttgttggatatcaggcagcagatggaagttctttctcaggtgatctgattatggcacactcagcaaaaaataatattgttacagctagctggagtagtgcagaaaattgaatggctctcactgcttcctcccaactgatgattggattttattccaacacaacttctcgttttctgttctaattaatttaggatctggtttttagttcttacataactttctccattcagcttggattaaatcaatgaatggagacatttggtagttattatatgttagtcaagcacatcattattaaaatatgaacttaatgtcttgactctcgaccatagctgccgcaacgagtcgtaaaatggactctatatattacctttactctcgccttttttttgttgcaatatagtaaggtccaacgtgcattcatagcatattttaggtaggttgcttttgtagcatgccatgccacagctattggacctgtgaaacattattgtatagataatgtaaaatggggatagaagtgaatgaaaaaaatggttttctctatttattcagcatgttttccatccagtcacctgtcatgccatgaataggacactttgcacctgccaggttgccatgcaatcattggatgtactcctttatccatgtaggtccaatggttggtgctactaatgtggtgcgatgtttctaggcaatttgattgcatctctgtctgtcggttggtctcttttattgatgaatgaggggctagatactatgacatttaaatagtttggcttaccctagaatctgtggtcaaactactgaattcatgagaagcgtgctcaaaagccttgccctaagcaatgaattctgatgctctgggatgcaaaagctgcaagggtagcatatgttttagggtgtgtttagttcacaccaaaattggaagtttgattgaaattggaacgacgtgacagaaaagttagaagtttgtatgtgtaggaaagttttgatgtgatgaaaaagttggaagtttgaagaaaaaatttggaactaaactcggccttagtatattttgaagtatttataccagatctcactctagcgagtttcttgttgatagtaatatctaattgatttctttctctcttttttttctacagggaacattctagggggtcacacctcatggggcaacttgcctccatcactgcggccacctcctgaaggcggctatcctccatttccttttgtagactggggttgaattgcttgttaatctgaaggtgccatatgttgaaacttcatgccggctatgcaatagttcaaacacacaatgaattttactattgctctctacaaatgggtttatattagctgtgagaatgctctcatatgcagtggaacctgtacctctagtgaactgggagcctggttttcacttaaaatgctcctattaggaagtgatccctctttgtagttaaaattgtgttgtccgaagggagaagactaaaggatgtagctcccctgatctacgtggcctccaagaaaaagaacagcacgctacaacagacctcagccacagaccagtggctgctcgatctagaccttcctccagcctcaagctggacaacggagctggtcagccagctaatcaatgtctggagtgcagtgcacaacgtgcatttcacagagaatgaggaggacaagatagtgtggaagctcactagccacggtgaatataaggcgacgtcggcctacaaagcgcagctcctaggtactactgccaccaactttaacatcctaatatggaagccgtgggcaccgcgcaagtgcaagacctttgcctggttgatcatccaaaatagagtttggacctccgacagactggcaaccaggggttggcagaacaactctttctgccccttatgcagacacacccaagaaactgctctccacctcctcgcagaatgcagatacaccaggaaaatttgggcggcgttatctgattggactaggtgtggtcaactgaaccctggacaatggcaaccagctcaatcggtgttagagtggtgggaggccaccgccaacttgaaggaagtcccaaagaaagcactccgcacgttaacacttctggtcaactgggaaatctggaacgagagaaatcgtagaattttccagcacaaagagctatctacaggaagtctgttggccaaaattaaagaggaggccaaaacatggtctcgggcgggggcgaggcatcttggtagctggcttgctttttatttttagctcagtaggaccgaaggtcctgggcctggtttttcttactcgtaaagtttactccttctctattcaatgaaattggcagcttgccgattcgttcaaaaaaaaaattgtgttgtccagcctccttttggcactgtcaggtctgtaattgaatgggctggaaacctggatgggcagggattctagcccatcaacattatgcttccataagatatgttacacttaaacctagttactgaggtttcaattttggtctccatttaccaaccaacttttttaaatttgtagaaggcgtgttctataatctgggattttggccaattcacagtgccaattgtgcgtcagcaatcaggaagattgcatcactcatcagcctgacaaattttgcctacaataagggactaggctcatctgacgtaaagtcagagggacatggccactgacgtatgggcccatgaaggtgggccccacatgtcagggacccacgtccctctgattttacgtaagaggagctcggtcctacaataaggggcaatagccttatgctttctcttgatcttagaagcaacataccgagcttacaatttgcactgaccatacggaaaataatcaaagtttttttttcacacagaattacattaatagggaaggtccagcaaatctccattcgataggcaagcacacggctatatatattatcctgaaaaatatgcttgtctggataagtttgatcagatcgtttgcatccaagctgcctggcgatcgactccaggccaccgcaggcatgagaccagccaccgttcttcctccacatcgttgtcggagaagaagccgcatcgccggggcatcgccggatgcttcgaacaagacctctccgcctcctccgccgcctccctcgcgccgctgacgagctgcctctcctcgacgtcgacgccgatgacgattgctcgcagcagcagcaggagggaagccattggctactactggctcgtcagctcccaatggcggtttggaatgatgctcaaggaggagctacttatagtgagcttttaagttgtttgtttagaggtttcaggtaaatctggatttcttgcaaggaatttgcactgttcttgcaaggatatttttgctggtgggtcacagaaaggttgtgacaagggtttggttgttctggggctctgctagtgtggactctaggtgaacagaatcattaggcgaatgctgtaaatcgaaatatctgctagttcttcagtttgttcatccaacattctagttgtgcttttaggtgaaaaggatagccctttatgcatgcacaatgttctgtccttctctgtctgaatttttctctcggtttagcacatagttttgcactgcatgatttggtacagtgttacctaactgaataactgaattctattctcaattcgttcaattcgtgcactgcattagcaggtgaagtatacgccatgaccaagctctttgttggtcataccaactgctgatccaggcccagtacagctcgttttcttctacaaatggcacaaaaatgactgcaatgtttgctctctctgcatctcgttgatacatataacaattagcaagatatattatcagtcgtgtcaataccagttagtctgacaaactaaataaaacccttcagaatatgacacttgtgctcattctcatatgataatacgcctttctgtatttcttgtatgttctaaggcaaaatttgctacaggacaccgaaagattggaccctttattgtgagatacccgaagatcgtgtatttgctcgtggtcacttaaaaaatgtggtaattagctggcggacattggccgcattattttattattttcggtggaaacggagagagaaactttggttaaagacaagtttgcctatggtcaatctctctttctctattcttcttcttcctctctttctgtgtgtcgttggaccctcagctccccagccccggcggcgagcgacatgcatgcgtcgggcggagcgaacagccgctgaatccaggcaccacgatgggcagcggagagggcagcgacgggctggatcacgggctgcttgcttcttgcttgaagatgagaaaccaaaattctgctgcttgaggacgaaccaaacgacaaggagggcttgctgctgctaacaggtggcgtgagttggatggaattgccgcgccggcggcgggtagagcgatgacgacgagccgcggcgaggcctgacgggcagaccgcgatggacggcgtggacggccgactggatctgacgacctccgcacggatcgggccactctcgttgaacgcttgaactcgccgttgcggatccgacggggatggcgacggcggtgtcgaagtcagtggctaagccgcatcccaggttgcccaccaccgcgcagccgctgccatgaccgactgccgcctcccgccagccgatctcctcctccgttgctccccttcctattccctttcaccataggctttgcctcaccgaggagagtccgttttcccctttcccctctccctccacctctgagccagaccaccaccgccaccaccatagccagccggagctgagctctttgtgttgctgttccggctatctccttctcccctttgcttgacaccaccctccccggatgcgcgtcgctcaagaacatcatccgccaccaacgtagccgatccccggccaccggagcaccaacgccctactctctccctctcctctgttactcggctggaagcgggaagaagaacagtgtttaggggcattttgttacttacacaacgctttctctctctattttaaccggaaataataaaataataggagaaatgtgcagcagctaattaccactatttatagtacccatgaaaagatcacgatcttcaggtgtctcatagcaaagtctgcaatctttcggtgtcctgtagtaaattttgccatgttctatgagctcccaaataaacggattccaaaaaaaaatgagaaaattgactgttttgcttgctcagtagtcagtagcggagtcgaaataagaaacacaaaaaaatcactactgatggagaggctgaatatagttgcattatttctttttttttttaaaaaaaaaacttaaattcatactaactcaaggcttgttcagttcattgaaaaaaaaaaaaccttaccatttgttggtgtagacaaaatttagcaagattaagggcctgttcactttgatgccattttcaaccttaccaaattttgataaagttgctaaaaaagtggctacatttagtttgttgccaaattttggtaactatataagaaatcctgccaaaattttggcaagttgccaaaatggtaatgccaaaatttggtaaggttttttttatatcaatgtaaacaggccctaatatatgaaggtggtctttagtttgatacattacaaaattttggcatagttttgtgagtagaagtttctagaattaccaaatgttggtagcaatagtgaaagttgtgatggtaaaatcttgtttagtttgttgtcttatcaaaatttggcaatatcaatttttttagagaatggcaatataaaaatttggtatggttgattttggtaacaaactgaacgccctcaagtgcatttttcaaacggtgtcggggctagccctctggattgagatcaagcacattgccataactttggggtattttcagccctccgatctacagcgaacgaacgagagtaatcgctacagtatactacagtatatcgtgaatagtaccctggtacaatacatttgtctacagtaaacaactgcatatcactattgcatactgtaacatcagactcattttactgtgcgtctctaccatttgctcctaaggtcagaggagccggatcctagtcctccggcctccctccacaccttgctgtccaagctataaatgatatggcatcattgacgattgatcttaagaaaatgacactagattcagatattagaattatataatgaacacaatcagtactaatttctgaatatggaatatgtcatggtaacaatctgtgcaatcgcaaattaaccagcaagttatctcaaaggagagatatacagtttcaacaaaagaaacaaaatcagaaaattggcaattgagcagccacgttggttatctgcaagaatgacatttgaaaactaggtcagcatgccaataacacaacagcaaaacaaaagaaaggggaaaattatgagaaattggcaaaacaaagtttaatcaaaatcaagttccttttcctgatcattagtctcagcagctctcttttctaatgattctgtatcttcctagacagattttcatagctcatgaccctaggcctgcttttgccaagaaatattgagaagttgtagttgtacaaatttaattggcacacaagatgcctcaccttaagagattaaaaattatactcatttcatttcgtttcaggttataaaatgttttgactttggtcaaagtcaaactgtttcaaatttaactaagtttatagacaaatatagtaatatttacattaccaaattaattttattaaattaataattaaatataattttataataaatttatcttggataaaaaatattactattttttctataattttgatcaaacttgaagcggtttgacttcaaagggagggagtagcagtcatcgtccttgcaactgtattaggacacctggcccaagatcctacggacgaaagagtgaaagatcagagcccaaaaatagagaaaatctatcctacagtattccgtctcttcccttctttctgtgtctcttcccctccactcactctctctctctatcttcccctccactcgatccctctctctgtgactaccacccatgagcacggaggcggcgacgacggcggcggcaacgacggcaacggtgacgacggcggcggtgacgacggcggcggtgacgacagcggcgaagacggcggcggcggcaacgacggcgatgacaacgacgacggtgcaatcaccatcggcccccgcggacgacctggacgacagccggcggagctcctgaccatcacgggcgacgaccgccgttgagaagcctccccatcaagctcctcaaggcgctcctcctcttcgtcgttcttgtcggtagcttcctggccgatgccgccctcctcctcctcggcggcgctggcgcctcctacggtcggggagcggtggacgcggtcaccgggggcgagcgcttggcacaacatgagcgatgaggagctgctctaggcggcgtcgatggagccacgggttcggcggtttggagcgaggcacaacgacgagcgacggaatggcacaaggtaggcaccagatctatcgccttctcttcctcttcctccgccgccgccccgctgctcgacttccctgacccacgactcctcctcctcctcctcctctctcttgggatatcacgctgatacccaagtaccaaggcctgatacctagttatcagtcgatactcaggtaccaaggcctgatacctaggtatcagcttgacacccagggtaccaggtatcagtcgatacccaggtaccaaggcctgatacttagtattagctcgatacccagggtaccaggtatcagtcgatagtcgataccagggtaccagttgataccaatgtaccaggtaccacctcggtaccttacccaagatacgaggattggatatggtggaatcgcaggatagcgtgggcctccacacgaaattgatgaagcttattaaatctctcgggattttagttatcccgtgactgctaggagcaacggaataccgtggggtagcagccctccaaaaatatgcgcatgtgaagtagcaaaaccgaaaaaaaaaattggcaccatatttttttagcaaaactgtaccggagctgagcaccgttggatccaaatcaaccgtgggcagatgtactgctttacaacgggtggcactggtaaagccccacaggataacacacccgatgcgcgccaagctcgccgtgccggtcccctcgccggcgccgccgcggccgccctccgtcacgttccgctgcctccgccccagaacaccacccacccgtgcgcccgccacacccgcgcgcgcccttgggaacggcggcggcggcggcggtggcggtagccccctgggacgcgcatggccgggcgtcgccgccgcgctcttcggcgccgggttcgtcctcggcccgctcctcgacggcatccactcccgcgtcggcctccagctctaccacaacggcgccgtcgatgtcggccccctccacacgcacatcctggtgatgaccggcgacgcgttcacatcctccatccattaacgattctttgcatctttgctctgctcttcgccggagttgctgaaccgtggtcgccgtgccggcgcaggtgccgccgctgctcggagcgttctactccaccgtcgggatgctccagctgttcttggacgagagggtgtcgccgccggcggcggcggcgggcggatcgaaggccaccgggagcccgcagaagacggcggcgtcgctagtgttcgtccatgtccatgctgtgtgcacatcttcgccaccactgatgattcgtttctctggtgactaatgatctccgatcgccgccgccgccggtgcaggttcctggcggtgttcatcgaggcgagcgcggagatgtacagggcgggggtgcccagcaacgtggaggcgtacgtgctgttcgccggcgccgagctcgcgtggctgctcctcgacggcacctggctgggcttcgccgtcgcgtgcctcgtcggcaccgcctgccccctcgccgagatcccactgatcaagtacacatatatagctactagccacctcccacattcttgattctctcttccccccatcaatggcgtcgcgtcgagctcgcgcctagcttgattgattgatctcaccaacgattgcccgccgcatcgtgcgcaggttgttcgactgctggagctaccccaacgccgacgtccagcttcttggcgaggtaaagaacacccgcatcttctcactccctgaagcggccgccattggtgggagctgagctgagcatggttgcgtgcaggggatcgtgagctggacgacgacgtgctacttcgtgtacacgccgttcttggcgaacctggcgagatgggtcaaggcggagctggcggtggacgacgcagctcggtgacggtgaaagcgagcaagatcacaccaccagccatggtgtccaactgatgtgttcattctctgctcggatcagccgctgcccacactggacaacacgcacctgcaggactgagacaattgcagtggaaatcacgcagatcaatgtagagagagatagttgctgaatctcttggggatctgaacatttgacctgaagctaaggtgggattaagtttcatggcccagaattgatctctctcaagtctcaagtaatcgacgttccccatccgtacttctcgatttaactctgtcctaaatcaaatacttttaactttaccatcaatttataaaaagtgatatagtttgacagcatgtggattatatatcatggttactaaaaacataaatcttacctcctccgtttcaaaatatggcaacctaagagaggattagacgcaacctagtataatgtatctatatttgggacggaaggagtctagtgttaaactatataaatttttagaaccgacgataaagttaactatgtgacttactacaaagctgaaacaataagtgatttgaacatagcaagtataatttaaataagattggggggaggggggtaattagcaactgtaatcgatgaactatccatcatcggcacctctgttaatttggaccccatttgtcatttggcaaccacacacgctactactccctctattccaaaatgtttgacgtcgttgacttttttaaacatgtttgaccgttcgtcttattcaaaaaatttaagtaattattaattattttcctatcatttgattcattgtgaaatatacttgtatgtatac

SEQ ID NO: 50833 - DNA, 1652 bp, Oryza sativa
caaacatttagggaaggagggagtataattgatccgctcagtcaaagcccgctgcctccgctcccaagtctggcggtggcagatccgatcctcctgaggccaccgccgccagatctgacaatggagaaggagaggcgaagggaggtcagccgttcccgagtctggcggtggcggatctcccaaggccgtcaccgccagatggacgacagagagggagagacaagggaggccggccgatctcaagtccagtggcggtgtatccacacaacccgtggtcgccgccgctggatcaacaatgaagaggaagaagtgagggaggttggctgctccgaggccgacgaaggcgaatccacccctcccatcgctggcagtggcagatccaccgccggtggccgtccccgttgccgacatcgatgtgtgccacactatcggacctgcctccgcacaccgaactatcatcgatgctgagcttctgccgagaaagagagagggaggaggacgaggatgaggtgatggagataaggtggagaggaagtggaggagaggtggagtggagaggatgaggggagagagagagagggggaactgaaatatttaaaggatgagctcaacctgatgatgggtttgtggcatgcaggcctctcaactgacccgtctgcgaaatatgtttattttcacaaacgattcttgaaccgtcaggatggttcttatctggagaaatcaattatgtagcagtgcgatacatacaaattttgaagtcctaaaaaaatcatctatttagaacggacgtagtactttttttctacgaacttctgtacgcaagatcattgaaatgccgtctcatgagtcatgatccaacgtcatgcatgtatgtaagtacaccacatactccctccttccctaaatatttaacaccattaatttttctaaacatgcttgaccattcgtcttattaaaatttttttgtgaatattattcaaaaacttaagtagtgtatatttaacaatgaatcaaatgaagaattaaaatttacttaaattttttgaataagacgaatgatcaaacatgtgtaaaaaagtcaatggcgtcaaatatttagtgacggatagattacacacaattaaaagatgccattactttacacgctgaaaatgatcggcgtctatataagaaggtaatctaacacggacagccaacgactacgagacgcgaggttgaagacaagtaagtactcctacatgcaacacccagacagagactagggcaacgcacgctagctctcgatcgagcaccatgccgaccaatctctcctcctcctactcctcactcttcgagccactcctcgccctctcctccctcctcctccgccgcctctccgccgccgtccgccaccaccgcggccggaacacgccgccggcaagcagcgacgtccctcctcctcctcctccgtcgtcgtcgccgctcgagctcgacaggctgtacggacggacggtggtggtggacgtggacgcgtggctgctgctgccggccgtggacgcgttcaccttcttcatggtcgtcgccgtcgaggccggcgggttcctccgcggcctcctgcttctgctcgtctacccgcttctgtgcctcctcctcggcgacggcgatggcggcgg

SEQ ID NO: 50834 - DNA, 10522 bp, Oryza sativa
ggcggagggcgcggaggcggtgagggcggcgcggcggtcggtcgccgtgagcgcgacgctcccgcgggtgatggtggaggcgttcctgcgggagcacgtcggcgtggacgccgtcgtggggccagagctgaggtcggtcgccggcgtcgtcgccgggatcatggatgacgccgacgcggcccgggtggcggcgaggaggctccgggcgctgctcggcgacgagatggatcagggcgaggccgacggtgccggcgccgccgtggggctcgtcggagaggggaggagtggtggcacggtgcactacctcttctcgcgttactactgcaaggtgagccgagctagttacgttgagcttttcctttttactgctctctccatacttaaaaaaaaactccatttttcagtttttggatataacatttcgcagcacatcttatttattaaaaaaaattatgattagtatttttatttttattagattatgaaatatgaatagtactttctatgcaactattttttctaactttttgcataatttttcaaataagacggccagtcactatatctagaaataaagtttttatgggatagatggagtactctttctgtttattttacttttgtacgaagccgtcatatattttaggacaaagggtgtaattagtttcaaattaaatggagataagagaaagttgcatttgcaccattgtgcatctcaaccgaactctacatttttcatttattcatctcgagatatctgctttggtgtttataccaattaggtagtacaacttatagggatagcgttgtgatgtcatcttcttgtcttctttttgtttttctttcaaaaattcattttgatatccatgtgtatgccagcaccttaattattttgtattcgtcgtgtgctcacgtggattttgtatcatgaaataggtgcagatggacgtgagaaaaaaaaaagtcgatctgtgtcttttggtatttttccttgtagacatcacatggtattttccctaaacactgtagtaccaaaataggagtaagtgacaaattaagcagcaagcgacacatgccgacctcattaatttgcttaaaagatgagtagatgacctccacgattggctactctctgtttttcttttccaatttggtgaacatccttttcgcactatccaattataaagtactgttaactgatgtccctagcaaagaaaagggccaacgaatgtccctagaaaaataattaaatctaattaatgtcccagggataaaaaagctaattaatatgtccccagaaaagaaagctactaattaatatcatttgcgaaacaatgcataagtagttaatgtgaattagtgattaaagaatgaatactctttcctttctatatatacatgctcctaataataatttaaagagttttttctttgattcgatattgttgcaatcaactactgttacttagttaacaccgttgttatcacagagcgtgacgtgtacacaattaatgtcaattaattaacgtgcatgtgtccaatccttgcaggaaaccttcactgcgactgaggctgacaagcggcggtggcggccgctgccgccgggcggcgagtgcggcggcgtcaagccgctcgtcttccacgacggccgcctcgccttcccgccgacgccgtccgccgcgctcgccatgtacgcctacctccccttcggcgtcgcgctcgccgtgtcgcgcatcatcgcgctgtccctcctcccctacggccgcgccacgttcctcgtcggcgcgctcaccggcgtgcactaccgcctcgtcggcgccggccacgacgccgccgccggcggcggcggggggaggctctacgtgtgcaaccaccgcacgctgctcgacccgatcgtggtggcggcggcgctggggaagccggtgaccgcggtgacgtacagcctgagccgggtgtcggagatgatcgcgccgatccggacggcgaggctgacgcgcgaccgggaggaggatcgccggagcatggcggcgctgctggcgcgcggcgacctggtggtgtgccccgaggggacgacgtgccgggagggttacctgctccggttcagcccgctgttcgccgagctcggcgccgacgtgaaccccgtcgcgctcgacgcccgcgtcgacatgttccacggcacgtcgacgacgccggcggccaagtggatggaccccttctacttcatgatgaacccgaagccgtcgtaccgcgtcgagttcctgccccgcgcggcgccggcgccggcggcggaggacggcggcgacagcatccgcgtcgcgaaccgggtgcagcgacagatcggcgaggcgctcgggttcgagctcaccgggatgaccaggaaggacaagtacatgatgctcgccggcaacgaaggcgtcgtggccgccgccgcggcggcggcggcgaccatcaaagccagtcgttgaacaggtgttcgatccggtcgtcgtcgccggcgatgtatcgcacatgcatacactgcaaactcagttaccataacaacagctaggaagaacttgcttcacacagttcttatgatactcataatcgtgtaattaaatatataaacacgaaaatagtttattaaagactttatatagctcattttggtccggactctggggttttgatttgaagaaaatttctaaaaaataattaatagtactcttaattatctattgataaaattaaagaaaatgcctatgaccatgcgctggattgcaagataaaacaaaaatcagacgccatcacgagtcatgactcatgagcaatgcattcactaaactctgtttttatttatcgatatctgcaagtccgcaagcatacatgcatgtaacaaggagagggtccaaataagtgagtttaatgatttttcttctcctaacctatttatatggtacgtgataagattacactaatgtatttaaacaagatctcatattatattttaataacaaaaatatatatgtttcaaccaataaaatttgatgtttcatagcgagagcgaaatgttccgatagagattatattgtatttcacatttttaatttttaatctatttttatgttttagtaatcagaattcaatgtttcttcatacatgtgagcaacatgtttctgatttggatttagctgtgctttacttttttttaattcatttttatgttgcttcccttataaagatgttcaatccgtgtatttataattgtttcattcgcggtgatttctcacatattttgtttcgaatgttttaacaactaaactttttttcttcaaaatgtataacttaatattttgatcaccttgttttgaggctcaggtcgggtgtttgacccctagtcttgtccataaaattaatttaaacttagtcgggtatataacttaattttcgctaacattagcttgttgctcggaacaaagcttatcatgggtttcaatttaagtaaacaaaactgttctcggtcctccaaagattccaaaccacgttcaataagaatacatacttccttttgtttacaaaaaccaacctaaatttagatttattcagattggttgtcctataagaagtcacatattattctaggttagtttttttttttgacgaatggagtatataagtaaggttaggatttacctactagcctccgtcccattgaacatactgtcttaagtgatgtgtgcgcatgcgtcttctatataataaaaaaaatacacatagttaattacttttgcatgacattgtactagagcatcgctttcaagtccgttaaatagcactatatatgtggttagtctgttacttgggagcaatattaattatttcaaaaatggcatcactgataaagtcaaacattatttagtcagcatcaacattgttgaggcctattccatgtggtccatgagatacccacatgcagatgtagtcatcagatatccgcacaacactctattcaaattgtactaatgaagatttgtgtaatcatttaattaacaattagcatcaacatctcctttccctcccaaaattaagcatcatgttattttcaataagcacgtcaagacatatgttatggatcgtactctgtgtaaatataaaatatcatggggttatcacacgtaacaggcagcattgccaatggcattaaacagaacaaacgatttagctcaaaggcagtcatggggttatcacacgtaacagcagatggcaatatggcatatgcttgggagcttgcgcatgttgttaaccaagcaattggctccaggcagggtttaccgcggggaacagtaatataaatacaatagtaaccttcttaaatttaaataaatttaaaaaataatttaaatttttgataaattttgtacgattttttacggttaccacggttaccgcgcggtaaccgtgcttaccaccgggacgcggtttggaaaaccctggcttggtaagcttttttttttttcttcccctttctttccgtgtgtttggggtattggggtgggggagggggattgcactcgtacacctgattttatctccaattgtaattctactatttcttcttcaactgtgtgattttgtcctcattttttaaaaacttattatgccctcgttctttttaagaggactaaacgatgttaaaatttatgtatgccctaacagatttggccctacttgtatgaggactttaattatgattttacctctgttttgacatcaaaattttaacatgaactttttacttattcagctaaaaaaaaagagtgcacacatgcttgacatgaattttaaaaccgttgaatcttcctctcgcggaatagggcaaacacaagattctgttaaggaaaatggggacagtaggaaaagtagggcaaaatcataattgatgttaaaacaaagataagaatacaaacgctgcttttttaaggcaaactcaaaagcgagtgcatcacacctatgaatgcatattttactcacatacctattttaatatacccttacataagtacttgtttaactagatgcaaagtgaatcaaggttcgctctacctagcgaagggtgcaatttactttttttaaaaaaaacactctgttagtgttaaatcatgcacagcgcgcgctataatgtactattagtacattatagcgcaatttatttaatttagcagtatgcgctgtaatgtactacaacacacaaatatttttttctcccaattcacactggatggtacagtagttctacactcagtaaacgataactaagggtaaacccgtgcgctttttgaactttctacagaagggcacccgtgtgtatatcatgtaaatgtggctatgcaaccaatttgcaggagcgttcggctcggcacaaatttaatgatttcgtttccaatttgtctagttgatggaagttcagcaggatgaagcaacaggcataaaagaataaaaaaggtagataaacagatacgagcagaaggatatcccgaaatcgaaattattgcgacacgaacacagcacgacaaagattgcgatgcatttctccaaggacgactacgtccaacggcatgcgtgcatccggagtgtcgagttcatgttcatctccagctaatactttggataagtgttcagatctagcttttttttttaaaaaaaagaaaaaggtccatatcaaagtagttcagataagtacccttcacgttttaagtacaaaaggagagtgctcaagattgtcaatccatcgctacatgcatgcatatatgggtattttcaagatgagcaaattgcatatattggtccatgttttttaaccatggtttcacattggaccaccattaactgaatgctttcactttacaccagattttattaccaaaatatatcactttggaccagtggcccacttgccagtgtggctgaggggaaaaaaaaaggaaacttctcggttgggaaggaaccagcgagtccgctgactcatctcctaccacaccgtcgatctctttccaacttcacccaaccatctcatggcggtgtgggcagagatcacgctaaagccttgggggcaacatggggagcttgggactggaaagactcgtgtggaggtcgatgttaggcgacgtcagcaaagaggagctcgtgcacgtccaggtacagcaaaagtcgagtcacggaggcgacggtggtggagaggagcttgagctccgggatggcgcgcgggcatcggagtagccgtggagatcgaggttgagccgggacggcagagaggagcttgagcccaagtatgacgtgctagtgctactgaatattgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccgcgtaggtcaagctggggtggtggataggagctcgagctcaaggacagcgtgtggatgctgctgcctgctggtgcctggaggtcgacgtcgagcggggggagacacggcagaggtcaaggccgagggtggcacgccagcatgggactatgggagagttcgaggtcaagacggggcatgacgatagcggagattgaaatcgagactgggaaatgcatgcatgcgggaacaggcggaagtcgaggtcgagccagcggacgacatcggcggagattgaaatcaagccagggaatggcgtgcgagtgtgggcggaagtcgagatcaagccaccggacatcgagcttgattttaatcaccggccggcacgacgggaacaaaagtcgagctagcgtgacgccgtgttggcgggaggttgaccccgtgctggctagactacgagcttgagatgcgcgggcgtcagctctgttatatatgctcgagctctcttaggcgtcgtagtcttcgtggtctacagccatcgatgaaaacagttggagatgatcagatagtgatgagagattggctctgagagactgactatgggccatacgcccaaagtgaaaggttttggtataaaatttggcctaaggtgaaaacattatattaaggatagcccaaagtgaaaccatggtaaaaaaatatcaaacatgtaatttactctttcaagattgacaattcgacatgcttacaacccaaagaacgatgaaaaagaaacaaggagaaaactcgcgagaacaaacaggaattaatataccccctccaaagttataatcaaaggaaagaaaactgtcacgcatgagaaaacgtgatttttttttaacaaagacgccctagcatagcattaccagtacagaaaagaccatgccaaaaaaaagaaaatttcaatcaaatttgataaagccttcctttcacggatatattttatattttgagtgttttttaatttttaattttcaaaataaacgttcctagacttatttttaagataggaaccttttggtcacaccgatctgactgacgtggcaacattgttctaccacgccaccctgactggcatggtaggataaataacaaaactatcacgcccgccgcaggtggcatgactgtttggcgtggccaaaagattcagattttagaataaattttagaaaggtttattttgaaattaaaaaacagaagttcaaaaaatactaaaaattccatccatcacaaaacaagaattgagaagacaacaatactgcctgccatttgacaatgtttcactaaactttgtacatcaatggataagtaaattttagggccgccgagggaccgacatgatctccaaaatacaaagttaaacattgttttcaatcgtaatatattcacaaaacatctttcaaactaatattgttgaggtactcctgaggagacatacataaatggtttcttctaggttcaacctcattagatatttgtgttatctgatgagtttaaaagggttcaattgcttgtaacccaacacagaactctgttgtgattgcacggagtaattaagatatgccctagaaaatcaagttggatacttgtagagtttgattggatttaaactaactaaattgcacaagctagtgtcctacaagtaaaaagtagttggggaatgcgaataccttgcatgaataccgaaccatctagaaactacagtagaaaagtaagaaaagtacaactcaatagatccctttttctcaaaaaagaaagaaaaatatcaactcaacaggtctgaatgccaatttccttataagattagctaacacgacatgagtatatttctagaaatcaaccgggaaaaaacaatctagcagaaaagaaaaaccataccaatctagctgaagaatgttcaacaggagaaaaaggggaaagctgtaactaacattattttaacacttacaacattcataacatcaaccgtttcatcgaccacatagataaagacatacattatctaaatccattttgacagttccaagtcccattgtgatggtactgcaaaagaatgagcaactggaacacatatcactgctaatataccaaatttcttaccttctgaaactacatgacagaaaataggcgctaagctgctaagacagtaccacaccattgactcagattcctcacataggtgccctgaaaatccgggaaccgctctttaggtactaaaaaatgtaacataacattccatcaacatctcttagtaagatggatgctaccaagtccgtatctgttataagtagcgattcgcaattcattaactactttgccactcttacctggaacaggacctcaaggacttacctttgtgtcagtcagtttctcaaaccgtaaaagaggctctctctaaatgcatttaaactgcacaacttatggtgaaaagctaaaacgaatgttgaactcaccactaggcaaaagctaataccgcccataggtcctcccaaagtcatcatgtctctcatgctcaaactcgctgtatgcagcatgaggccttggggctgaatagctatcagtaatatacggatattcactcttcgagtcatttggtggaccagtagcagcaaattgtgtagctctctgatcatagtctggataagaagtttgggcataagaagtcggatgagcttgctggtgccttttaaagctttgttcaagaaattcatcccacttccttgaatgcatactcctcatggctgttactctcttcatgtggttttctctcatttctctcaatgactacattgaaaataataatgacatcaggaaatactgaagggttacttggtagacattttcaacataaaaaggaagttgttagaaagcaaccacgctgcaattatgaaattgaagccacaacacccttttgtgaatacatctaatttcaaaacataagccacagctaacaaaattatccgaatatgaaaaggttgcctgccgcagtcaatacaactcaattaaatcaatgacagaaatgttagtatgttataacatagaacaaccaaaaggaataactaatcatgacaagtgttttaggttgtgttgttctgaagtaacctccaacgtttcatacacacaaattaagttgctggaaattctgcaaatgatgatgggaatcaatggagtgcactcaacaattttaaaaataaaagacacaatggaccctcaaatattatgtggaatgtggattgatgtactccagatttcacttcacatattaatcatgcagttataaaaacaaaaaatgttgaaaaaataaattgaacagagtaagagtttggaagttcagctgtttccaactgaaaggctggaagtggaagggcaaaaatatactacatgccaaatttaagcaatcattgggtaaactaaagaacattcttatttgcaatgagccaatgacagaaacactgaaacatatagttctaatactattcatgctgtggctacacaaaatagaccctgaaattatcggttttcttataaaagaaagtaaagaatacatgtgttgcaaactcttcttatcatggacagatcaaaccaccatgttaataaaaaataacaagaactctcaatcagataccaccagtgaccattttatattgaaaataagttacctaacagagaaatgatgagctattcaatatgccaataagaatttacctcacgatgcttgtagttctcttcatcctcctctttgtcacgggctatagctaactccatagcttctcttttgaactccatttcaagctcttccaaagtttgaggataggaaggcaggtcaaacttaaggcttaatcgggaatcggttccacgcgtctcagtgctccaggtatttggcacatatgtagctgcatattggttattcccatcatttgatctaagggaatcatcaatatatgagggttgacatggagattttgattgggctggacggcctttagctccatagttggcagaagcttcagcaaaaggaagaac

SEQ ID NO: 50835 - DNA, 53811 bp, Oryza sativa
  unsure (1)..(53811): unsure at all n locations
gaacttacctctagctgcaaaaggaaccaaacaaattaccatagatggtggtaaccaacaaaaagggatcagaggcattttctttatctcaaatcgtctaaaatgcctggctcctaatatttgccgatacaacaatgataagacgagtgtgcttgagcgccctaccttgtggagattctttcgaaaacttaggcatatcatcatgtgaacggccatctagaggcctttcgttataatatcctttactttgagagcgcggagcacttcttggactatgtgaccatctagaatcagtgtgccttgggcgaatatcactggtagttcgcacaggggatctcaaacgatcccgttttggactgcttgaagtatttttacctttaccctcctgaatgattttatgaacagcatcgacacctttcgctagtattaacctatctttaccactgacaaacaggaacttctcatccatttttattttacaccccacatccttctcaatctgacttattgtcctctcagtgaatagatccctgacttgtttatctcttgctggaactctttcaaaaaaatctgcatttctcctatttgctcccagcgtggatggacaaccctgttccaaagggaaaaaattgtaagctgaaatacaaattttgaggccctatttctttcagcttgggattattataatctagattattgagtcagattactataagatagattgttataatctgtagtagaataagcggttagttgtttctttcctagattattagagcctagattatttggtttgcaagtctaaagagggagtggggtggtatggtgggtaatttttcacccaataatctggaaaaagctcacctaaatgagcttatcagattataataggctgggctctagattataataagttatttcaataagttgtctgtttctctcagcttactcccaataatctggattataataatcccaagctgaaagaaacagggcctataagtatgcacaaacaatgcacataaaacactacagtgtctctaaactgtaatcaatgtcaagatgtatagaggcaactccctgaggtgctttaaagagactcaatgaatttaaggtatccagtgcacgaatgtttggttgagcaatcagattagcatataaattatgaaagataggagaatgaatgaacttgtggatgtactactgaacatgtttcttttgtattaaagtttttaagtccaaattcaccattgagagtaatgaaaaaggagaaaggtctgaaaaatgataaataaagatgaaaggaaaaaggaaaagaaaatgacaaataatagtagtcacagaatttatttttgttataatatactttttagattcaagataaaaaataaaggttgatacaacactacagcagactaatctttttacagagcaatctccattttgaatatgctaactgttaaattcagtatcatattgagtgtaactcgttactgacttactgcagagttgaaaatactgcaagtggataaacaaagtctagtaatgcattatgtgtctatctcaatcaacaagcatgccagttgtaatttattcagagaaaagactacctgagtaaaatgacctgattctccacatattttacaaatcatttcttcctcctttctcttcttccagttcctttctgagctttagctttagcctcccagactttggcttctctgctagtgaagtcagtagggacagcattgggatctggggggccatcttcctcatctgacttttcacgttcgaggggcctcttctcatcattcactctaggcgtcacattgttagtagttgttgcaactggaccactgtatgccttcccataaacttcattgaatagttcatcatcaatttcaggacttggttcccttgccattggcagataataatctattcaagctagtctttgctatgaaaagctgaggaaatagaaggaagaagttgtttagtgaaggcaaaagaaatatttcaagtctgcagtgatgtttgcttatcaatgtaaataaatagaagctgttgcacataaaagtaaacatagttcctagagggcattttttgtcattggttgaaccatagggcttgttcatttcagctgcctgtcgctgtgctgcagcagctagccagcttctcccgcaacagctgattgatgcaatggctgtggccttttggagatgcagccaagcggctgcgctgtgccgctgcagccccaaaagccacagcaatcgctcccaagcaggcccataattgctttctcccttagttcatataagctactaggatgcacgtactagtcgatatcatacaggacatgttcaattcgatcaaaaaaattggctccagacctacatttccctaaaagccacaaactgaaacatgcttctcatgaagttcataaaagcagccaatgaatatctctttcacgatgatattgaactcatgcgcatttcaataatatatatatacagttctgaattacaagtggcatatacgactaaagattttcttttctttcatgcttcatggcatttctaatgtagaaaattctaaaatttcacagagagcgaaaaagcagcaaatcgattccgaaccctaccactaccagcgtccgcataagcaatccctagccatctcataaatcctcgcgtctatcagtttaaccttggacaaatatacgcagtgccccccaactcagaagggcgcggaacactatccatccccgctatttctatgagcgagggaaaaaaaacaaaagaacagatgcgcgaacaaatcgagccaatccgcctcgccctaccccctctctacccctaagagccgcatccgcgccgcgcgcgaccgacggctctaggccggcattggttcccaccgggtgcggccaccccacgcgtccacagatacgcaggtacacgacgcccaccaccaccaccaccaccaccacccccaaactgacctgctgatgatggaggcgcgcctcttcggccttcgggagaggaggagggggcggcgggtgagccccgccaggccagtggtagggggcctccgacgacgagggccctcgccgtggccgccggcgccgtacgcggcgggcgggaggggggaggggagggttcgggagtgggaagcggcgaggcggcgacctaaacgggtgaactgtggttcgggtccgtccggctcgggaatcacgatggtttggttggggtgggctaggagtagaggattgggatcctctggtttcattgatacgtggggccgggacaaatgaaacatacttcttctcttaataaaaatatataaataaatctaatatatttttatcgtgtaaaatacataaaataataaataatagttacttcctccattttacaatgtgaatcattctaccatttcccatattcatatggatgttaatgaatctagaaagatatatatgtctagattcgttaacatcaatattaatatggaaaatgttataatgacttacattgtgaaacggagggagtacattattaaaacatgctcatatttttttccctctcttctacaactaaaatgagaaacgtgattagcatataactaattaattattaaaaagataaaattataaagcaatttgtatacagaaagttttcactccgtttaatagtttgaaaaactaacatgctcttaatgaacatacattaaggatactccccctgatcaacccatcatcttttttttctggagaattgaaaccattatttattcgttacagagcaatagaatacttgtggttgggttctgtcaaggtttaccaaaccgtttagggtggggttaccattaacccgcggtttgattgttattgcggtaacctcgcgagatataccgtggttcaaaaactaaaaaggctaccgcacatgataaccatgataaccatacggtttggtaaaccctgatcctgctactccctccatcctaatttagaagatgtttgtagttcaacaaaacaacaaaaacatccaccaaagattaaagagaaaccaaccaaaacaaaagataaggagaacacatttatcgaagtctatttgttaatctccatctataattggtaaagagttgcataaccgccgtctcaagcttccgacatgctacttgtatgaactcaccatcttcttcagatctttgtagttgagctcagagctgaagccaatatgttaccctaaaaattacctgcatatatgtaatagatggtgatttgtcaaaaaccgcattattcctgcacaactacaaagcccaacgtatagcagaagctcctacaagaatatgtgttatgcttgctctctttcttgtccaccccaaaagccaaccatcaaaaatatgtgttttgctactagggagatataaacttatagaagatgtttaatagtagagttaactagctataaacttatatttgagttaacatatatactccctccatttcaaaatataaaggattttgaatgtaggatatgtcacatttatccaaaatttaacttcaacaagttgcaatgaaatttgttttttcattatagtttgtataagttgaattttaaccagcatgtttgtgaaatatattaatttagattaatctatctagtcattttttttaaaattttttataatcatttagatggcatgcaaataatgaggggatgtttttaaaatccgctcccggtcgaggcggagttgaaatccgctcccggtcgaggcggagttaatcgtttgggttagcttcgttgcaagttgaacacacgttacatgggtgactggaaatttataatggtataattcggagagtttttttccaaatgttgcttaagatagaggaagaaaattcggagaggtttcggaattggacttgggatgaactcgatttaggtctcggaaacgaatgaatctggtccggaatagggatataaaccaaaaaccgagatttagcattaattaacacaaaagaaaaactcggaactaatcaaactttggcattaattagaactaatttcctcgaaagaaataaaaaaaaagtcggaactaattaaactttggatctatgtgcatggttcacttgtggtagtgccgtagtggtgtcactgtcaccggccggtgggctggacgagctgcgagaaggtggcgcgctccgcgacgacgtcgtcgggctccaagacaacgtcgacgcacggctcgtgcgggtgcgacgtggacgacgtggccagcgtgttgatgctggccgtgctcccgtcgtcgaggtggctgctgctgccggcggcggcgtcgagcgcggggacggggcggccggcggcggcgtcgaacgcgtcctggaagtgcatcgcgctctcgaggttccagagcacgtcgcccatggtggggcgctcggtgccgttctcggagaggcacttctccgccgtgtcggcgaacttggcgaggcactcgggcgcgatctggtccctgatcgccgggtcgacgacgtccggcagcgcgccgccgcgcttgcaggcgagcgcgtagtcggcgaggctgacctggtcgcgcggcagcgccgggtcgagcgccgggcgcgccatgagcacctcgaacagcacgacgccgaaggagtagacgtcggacttgtcggtgagctgctgccggcggtagtactccgggtcgaggtagccgaagctgcccttgacgacggtgctgacgtgcgactggttgagcgtggtggggccggacttggagaggccgaagtcggagaccttggcgacccagttgtcgtcgacgaggatgttggtggtcttgacgtcgcggtggatgatggtgtacttggcgccggtgtggaggtagtggaggccgcgggcggcgccgatgcagatgtcgaggcggtggcgccacgacagcgtgggcttgccgccgttgtggtagaggtgctcgcgcagggtgccgtgctccatgtagtcgtagacgagcaccatctcgccgtcctcctcgcagaagccgatgagggagacgaggtggcggtggcggagcttggagagcatctccacctccgtctggaactcggttatgccttgctccgacgacgggttggaccgcttcaccgccaccttcacgtcgccgtccaccacgccgcggtacaccacgccgaacccgcccacgccgatggccaggtcgttggagaagttcttggtcgccgccttgatctccgcgaacgagaagtggcggcacatgccggcgatgttcgccgtgatgtgccccgacgacttgccgctggtgtgggagtggtacagcggcagccacgcggaggtgtgcgagtcggcgccgccgccgcccagcttcttgctcctcttgttgctgtacaccaccacgcagatggccgccacgatcccggccgccgccgcgccgcccgccgtgccgcccatcaccgacgccatgttggccgggttgtcggtggagaactccggcggcccgccccagccgagctccttctccgcgagcagcttgtacgggacggggtccggcgacgccaggctgccgccggtgttgttcaccttgaacacctcgaggccgttgaggatggcgtcgtagaactgcgggcggagcatcaccgaggggtgcaccgccacccacagatgctcgtcggcggtgtcgttgctcagcctcaccgcgtagtccttgtacaccggcacgccgcgctccgtcgccatctccagcacgtccacgtccgtctgcgccgtccggttgttgatgtagatgtcgaacacccgctggttgccgtggatgagctggagctcgcagaaatggaggcgcacgacgtaggtgaagttgcactccacgtggaggctccaggtgaggttggagttctggttgaggcgctggtccctgcccatggagcggccgccgaggtacacctccggcggcgcggcgtactcggcggcgtcgctggggtacttgatgtggaagtgcgggccggcgttgtagacgaggccgcgcagggggccctggacgaacggcgtgtcgtcgtaccacggccgcgtgaggccggagtcgttggacggcgggatgtaggcgccgccgacgttgaggcggtacatggtctggaacgcggcggcggagacgtcggcggtctggtcggcgaagccgaccatggtggccgggttgttgaacatgtccggcatggagatcacctcgatgccgttgacgaaggcgtaggtgacgttcatcatgggcgacggcgagaaggtgacgccgaagtggccctccgggacacgcggcagcgagtactccctgatgaggtacgcctgggtgagcgccttggtggtgagtagacgctgaagttgtggaacagcgtgtatcccgtggtggtgaagacggagaaccggaagtcctggggctccagcccgttgtacgacgacgggtagaagtggagccggatccagtggcggtcgcgcgggttccccgtgaagttgtacaccgtgtccatggtaaacacccgcgccgtcatgtaggggatggacgacggcagcatcgtctccagctcgtcggcggccgccatgatcgaagacttgccggagtccgtcagccacgtgtcgttcgtcgcgtccgccacccacctgcgcccctccgcgtccagcccgtccgtcgtcgacccgcagttcaccaggatcctgtccgccgggctgtacagcttcgccgtcgccgcggccgcggccgccgccgccacgacgagcgccagcgccaccgccggcgagcaccgaaccctaccagccatgagcagagggagagggaggagacaaacagagggtagggagaagacagtgtgaggcgcacacagcaatcgagatgacgaggggagaggagcaaaacgaggaggctgagggaaacagtattagcggggtgacacgtgtcagcgactgggagcgcttgccgggtccacgagaggagaggggcactcgccatgggcatgacacgtgtagggtcaccagcgcagctctctgctgttcaatcaggacacgagctacagtaccacaatttgtcactgaagaatacaaccacatcacctaattaaatgtctatgatccatacagtaaatgagacaggagctataggagcaaaaaagaacttggaacaaaatcatttccatcatacaaagccaccgaatgttcttgtaacaatttggtctttcgcaggtggtgaataaaaatggaatttacaggatttacctcccaataaaactggttaggtcacttgcaccaccagccttcaaatgggtggtcagagactctgaggctctacccaaaacagcttcacaaaccaccactgttaccgcccttcgtgaagatcttcagagaaagccgttctcgatatgttctcagtctcaaaggggctgaggcctgaaaagggtccagaagagaacatggatgaagtgccatcagattcataggtggttgaggactgcctaacattgggtcgtgctggaggtgttggtatggattcctggaactcagagcgttggaccatcttcagtgactgcaccacctcgcccattgttggcctttggcttgcctccggtgaaacacaggcggctgcaattgtgcatactcgcacaaaatcatcttttggatactggccaccaagcttgggatcagctagttcttctagcgtatctttatctcgtaaaattggtcgtgcctgcgtagtcaaaattgagcaaataagtatctctacacctatgcagggataagaatttggtactgtctacaagaaatacgttgacgtttgagagttggctttcaaaaacctaatgaacaaacctgacaaattggccagcaaaggttgatgtgacacaaggcttttagtggaaagatcaggaaacatttgtgtaagctcataaacataggcacaaaaagaaacaaacagatagatggcgctttggcacaacaggcataaaaaaatgttgaagtgtaaatttactcacacataaatctgctttccacccaaggatgtacacaatgcatatgaatagagaggaacataaaaaatgtctctcttttttcgaaaaaggaaacagattagtagtaatattgctctaagtccatttgtttgtttgccttgtcgagatatatcgataaatatctaacatgcatggctagtgaacttcagatgacaattatcatactaaaggatccatgttcagatataaaaaggtaatacaataacagctgaagataagagcagaaagaaatctaacccatgtcactagattttcctggccagaaggttgtgacatatccacaggcctcctcccagtaagtagttcaagtagaacaactccatagctatatacatcgctttttacaagcaagtgtcctgtcattgcatactctggtgctacatacctgaaagcacgacagctatatgaagcaaaagcagagcagaaacatctggggagtacttcaaggtggtcaacctgcttacccgaatgttcccataacacgtgttgagagataatttgtgcaaccttccggtgcctgtttggccaaaccaaaatcagacactttagcatgaaagtcatcctcaagcaatatattagaagccttgaaatccctgtggattacgcaaggctgagaatcctcatgaaggtatgccaatcccctggcagcatctagtgctatcctcattctagtgtcccagtccaaggggcggctagctcccaatgtacctgaaaaaaatgtaagtagtcagagactcaagagtcaaggtgtatcatgattacatgatcaccactaattaattaaacaatgaaggaccacattcaactgcaactgagtggaacttatgcagcaatttcagaaggagaaatagttgactcaattggccataccatgaagccaagcctctaggcttccattaggaacaagctcatagcacagtaggtctgtgatgactcacggttactatagtaaccaatgagtttcacaaggtttcggtggtgcaacctgctcagcatctcccttcaactagaaattccttatctccttgctgccctccactagtaagcttctttatagcaacggcagtgccatcagttagtacccctttaaagacagggccaaaacctccttctccaagcatacttgacggatcaaagttgttggttgcttctttcagttcatcatatgcaaggaaccttgtacttgttgggcgaggaagtgagtccactgcagaaaccgcatctggtgttctttgcttggctgcacaggagaactgatattattaatgctcctaaaagaatgctccaacatgcataatgaaccagaaaataagcataattcatttaaatttggttaagaaaccaaaaatattatggggagctatggacatggtatatctaacttcactatcaattattagagatctcatgaagtataacaaatctatagttttcaaggaatgtagctgagaatagataactctgcacgtacgtgtctcaactggaggaaccttccttttccctttccttaatttgcagaagcaaataaacatggcaatcaccaagacagcaattagagcaccaataaatatgcaaatgatagtaatcaagctcatgtgtttttcattgctggtatccgcactgtgtcttggtactgtagatgcttgagatggagagggtttaggtgatattgtgaatgttggagctgaaatagaaatgaaagatcacaatattaggaaaggagatttgttaaaagaaaaaccatagctggacagcatacagggctgtaaatataaagaaataatgtttatatcattcataggaagtatcatattgatatcaccaaacatccttttctgtcacatcatcaacaaaggaagcacagccaagttcaccaaagaaaatagcacattaactgtataaccaagttgatacaccaagaattaatgaccggaatatgtataagaaactgtgtagtgtgtacaaagtttgcactagagtactagatcaaccagtgctaaactcaaagcatatgtagtataagatatatgtatctcagtagaactggatgcaaattaaaagatgcactctatgtatgcatgaagggtatagaggagcagaacaaaaacagaataagaaatgtaaggaactgaatattgtaattttatcttacttttcttttctgttttttctttggcatatagttgctaattgattctatagaatggaatatgccaacccacagtgatttttttataatcatctgcttatttgataatcacaaacatatgagcagtattaccacatactatatatattcttcagtttctctagtacagtagacaatagagattaaagaagcaaaaaaaaactgaagtagtcttacagtgttctctaccttaacactaaaataaactgcggcattgtaatatatagagcaaagtcaagatcagttagcattaccaggagctagaaccagtggcctgaaccaggttaaattaagaagattgtagtcaccaactagtacagggttgatctgaactgtatgctgactaagtgaataattcattgcggtaacttggtcggctgagaaactaattcctgtatggggagctatatacattgtgatgtttagcccagaagccccaacaacatagaaatttacaatctcaaactgagtaaccctcagactgagttgagaagcaagttcccccagaaattcatcgctccaatttgacgtcagtgaaacatttcggagaaaaagctcaactcttactgggtaaacacaatggcaatcttggctccctctcttttgtaccatgttatgtgacaacatgctggtaaaacagaaggtaaattataatgtgagtaacagcatatgtatagctgttagagaatactacaaatcaataatggttaacaacaaatctgtgactaaaatatttggatcaaataggccaaaaccaaggacatgagaaaattccaaatgcaaaataaatggggaaaacagtaaggttaaatctcactgagctatcttagagagctggaaataactgagagagaaaagatgccatattgtagcataaacgtttcttaggcagacagcacaacaataatgtgtacttcagtattactaagggatgaagaaaactaagctgaagtcccacaatatttgggggccatgttcaataagcaagtcagaataaactgcaaataggataacaacagaatactatcatgtttcaaataaaacagattattgtagaagatattatccatactataatttcatataacactcttcacataattcattaattattttacacaagataacaacaaaaataccaatgtttacttaccacatgtattttgtatcttattgtttaatgtgagcataaaaaagggttgtggttaggccacataagctggacatactatagagttctcaagtgatcaggcagataagccaaaattaggagcagtaaaagttaagatcaatgagagtaagcttaatcacagaagccagttgttcaagtcaatagcaatagctcacatgacaggaaaaagcagagtgacaaatagcacaagcgagacctagcttataaattggcttagaccgcatacatggactttgcaaagttccatgtgctcgctgcaagcctttattgaaagctggtacaatgccaaccaaacaggttacaaaacaaccagccagtttcacatctgacaccagtattcagagaattggatttggccaaaaggatcgcaggcactgagcatttcagtatgcttcaagtatgcagtgatacgcgcacgatggtgatggtgttgcagcggctgtcagagcagtgaatgctcgagtggatgattttggagggggtaggggcgaaactcgcgatcatcctctggcgggaggcagggctcttcccccgagagcgagaggctctaaacatgcctaaacttgattagattaatcttacttaattattccttacacccggatacccttttctagatcaagggatttgacacgcctaacaaacttggagataaatggctaacaatcttgagatagtgaactaaagatgacgactaacttaaaagataatgaccaacaaaacttaagcaagataatgatggagctttatcccctcagcttaattctggttctttgcgcgttttctgttgccggcgtttgcgatcatagaaacatccaaagcattgatctccaaaatgttgatccgaatcatcaaggtgcaccatgataccacacagatctaagtaaaagctttgtacattccaatgtgaatgtggatatgcacaatagagttaacatttctaattaactattaataagcaaattgcaattgaataatttatgttgatatcacttggttgattggtaaaagaattgcacaatttactcaaatgcctacggttgaggtgcaatcaaagaacaaattcttggaaaggcaaatcagaaataaccacacaggcatcattttgtgtatctactcgaataaccagatggccctttacgcattgtatttacaccatataatttcaagtcatgcttgaataatgaaaatcatataaattagatgattccaaggctctaacaatcaaacataccattgtgaggagatactggaggttgtactaatccagaaggagctgcactagtatttgaggctgcatcaggaggcgcagcatctacatgagtagaaatttctgcttctgagcgtctgttatgctgcaccaaattatctgacatgtctgaagaataaaaggagagatcagaatcaccagaaatggagctatagcttggcgctgacattggagggtgcacagatagagtagctggtgatgaatatagcttctttcgtctttgttcgctgactgaaatactaatgtcaactttagcttttgacaacatggagcgaactggtctccaactttgagatggagatatagcaggggcaaccacatttagagctgatgtttgggcaatcaaattgattctggtaatcaattccagagtaaataccacagccaaaaaatttaagaaggttttccttcgagcatcttccaaaagccctgccaagaaacagtacaatgaagaatcaacaagtcaacgccttaaagaatatgtatgtacattgacactggtcaggtgcaactaatgaatatgaacactcaaaagatgtacagaatcacctttcaagatagtcactctaacacataaatcaaatattccctccaattccaaatataagtcgctttagcattctcaactctttcctaaatgtaagaagttatggaacttctaggcactttctgcagttattcttcccaatttgcccttgctaaataaatgatacccctctcacaaataaatggctcatcttttccaatgaagtcaactaagtcatttgagctgttttcttactttgtgtccacaagtctaaagcgacttataattggaatcaaagggagtagttgaacaaaagttcacaagcatatatttatatgcattcacagatgtttccaagtataagtaaagatagtgtaaatcaatagcaaagaggatttcataagacctcatggcatgtgtagttaaagattttacagaccatgtaaatatttcgataaaccaccattatttagctataaagaaccagaaatagtatgacagctattttcaaagtgtttatctccagttgataaactcagcagagacagtgatggtatatgttcaacctataatgatgtttattaccctgcatgaaagcataatctaattaacatggctatggtggtggattaaacatttttttgacttgagctaattagttctagaaagacaagttattgcaagaaaacgaaagagcttccttccataagaagccataaacacaaattaaaacttataataactttcccagaaaaggccaaacatggtaaacatgatgttgcctattttctctgcataaagtagatactttccgcaaacccagcaatgcaggaattctcatcattccagtaacaagagttcagtaatgaccattttcttgtaaaggaggatccattggcctgaatttgataatcaatatcacaaatccatttgtagtgactcaaacttagatcagaggctacaacaaatacagactaatgtcaattttgactattttaaaacccaatgtatgctgaactagggacatccagctgctcatcgtatatttttggtcgatacaaatcctagatgaactagactaaaaagtacttgttctgtatagcaatggttgttatctccgaactggtgcaatttgacatggaaggtccagaaaatgtatagtgcttctgtggtagaaaaccgccttacagctttaagtaatcaacatagaaaagctcaatacaagagaaccaagagctatccaaggcatggatttgtataattgataacctaagctaagccccacttcttcgatcagattccagatatccagtatcgccacggcagcagagagcactgaatcctacatagtagtatgaccaccattcccgcgacaccaaacccaaattctcacggcctgagagttgagctaccgaacaagcggcgacgactaagatcctggaacaaacccgccaacccccccaccgccaccacagtagttgattagccgacatcacgcaccttctcccctcaagcccaacccctcgccgcatcacctcgccgcacaggcacgagccgccgccgccgtgccgcgaaagctaaaccctcggattgctctctacgcttagctatagcgcgaacaccgagaccacacgacaccacctagctaaagccagcagcaaagcaagcgcgggagggagagctcagctcagatcgggccacactaacctcgtccggagctcgcgcgccgtatccgcgccatcgttggatgcccctcgtcggcgacggggcgggccccccgctcctgtctactactggcgccgacgcggacgccccatgagggcgcgcggcggggtgggggatggggctagggtttcccgggacgccgctgggtttctcgcggcggcggcggcgaaggcggcgagaggtagcagctgcggaattttttttttttcctttcctcttcttcttcccctttcgccgtgccgtggtggtggtggtggtggtggcctcgagctgggctgcggtggtagcttgctttttgcgcctgcgcccccctctcctctctcctctcgctgctgcttttttccgcctgctgacttttttgcccttttccgttgcactgctcgaagctggcactgccactgacaggtgaaaccaaccagtaaaaaaaaaacaccacgaattcaccacgagcagacacatggtacaagtatgaactaaaaaaaactttaaaatttaaataaaaagagaacttatgagtttttttatatttgttctcataatctattcttcagttactaatgtctataagttacttcctacatccagattcgtagtaataaggtgtgtcctaatcaatccatattgcttatattttaagatcgagggagtaccaacttctattcttttgttttctacgtgcatgcttcctgaagtgttaaacattgttttttaataaaaaagatatatgggaaagttgttgtacaaaatcatattaatatatttttaagtttttaatataatacttaattaaccatatgttaataagtaaccacgttttccgtgtatggggagaggttgctaacctctcctcccgagcacaaccttggcatttaaactactcatattagatatgtaaaaattttagccataaatatttttttaatattttgttggtttttctacatgttgccaacagtggctcaactgatcgtagcctaatgttgaaattatttctatcttgaatttcaaactttgaatcagtcgtgcttgtaatcaaaggatattctactccggttaggcttcctactgaaatggaagaagaaaaaaacagtgatagctcacactaaactaatctactactaggttagcgtaaactaatcaaatttctaatagtactactaattattttaatcactcaaaggacgatgccatgtagggtggtacagtagtgagagccatagatgcgtatcatatcccggtagacgtagaccacatgtgtgtgccatcatgcgtattctttgcctgccctgtgcccaatgnaccctccccccccccccccctcccccctaccaaactgataatgacactttacctcttccataatcaatcgacgacagcaaacgaatcatcatcaagagcctaacacatcagtttaattccttggctaattaattactccctttgtttcaggttacaaaacgttttaaattttgtcaaagtcaaactgctttaagtttgaacaagtttgtagaaaaaagtagtaacgtttttaacccaatacaaatttattataaaaatatattcaattattgatttgatgaaactaatttagtattataaacattactatatttatatataaatttagtcaaacttgaaatagtttgactttgaccaaggtcaaaacgtcttataacctgaaacggagggagtagtaaactgatgaccgtttcagggagtagtaaactgatgaccgtaattaattaattactaactgatgtgtaaggctcatttttatccatgatcgtatttaattaattactaattctttgggttatgtcattttcttcctctgaagaatgagacagagacgttaatctcgtccaggacggcgctttcccgtggttgatttcggttgccagctttgacctggcgggaggaagccatgaccttgtattggtttgcttgacttttgctggcccgtatacaggtagaggtcaaaatcctttacaagtgaggttttcagtaggaggacaaaccatggacctaacgaatggatcataaagttggtgtggtgaaataactaacttaggcagatgcttaactgcgaaacaatcgaagttaattatggcggatttgaccagcctaattaaactgcagttgataaaaaacattggaattaagttgtttcttttatgcagttttttttgctcgattaaatgaataaaagctactagttggaaatcataacaacttgcttgttagttgttactccctccattccataatataatacaactttttttctagatgtttcataatataaggtgtgcatgcatataattaattagcacatcttcttcactaaattattatttttctaaatcctccactctcaagatctttaattctattggtctattgagtgcatgcactatattattagggtgatccagattagaaagtgaaaatatttgtttcttgaactttgggttaagggtgattgttacttatattttggaacggagggactactcacttggtcgtctttaagaaaataaaaaaagttttggtgaaggatatgacagtgatattaacttatgacttaaatccgggtgggtaaaagagttatgcgaccttcgtcgtgccgaaccatttcactttccgtgtatgtttattcatgtgttagagatcaagagaacgacctaggcgttttatgggtcgcaaccacaaattacctcaccatgtcataatttaagatgagcaggtctgattaagttatatatatgtttagtttctgccatacttatagaaaatatttatttattattagatggatcgtatatgccattggcacgtaaaggtgtaataagggttgtcttcttctagctcaagtgtggttttaattttagtcggcatgtaccgcccatactaagacatactttgcattactttaggtgaatagccagattggttctccaagtttcactcatgtctcagtttggtccttaaaattccgatatgtctatcctactactcttttaagtttttatattttagttcaaactctttcttttgaacttacttagtccttgtttggtttgaaaaagattagttcacacctattttatagtgtgaaattacttccctcaattccctctaatccatctctcttagatattaactgaacatgttcttagaaaagctacatagctgggtaaacctaaccaactactgctgtataatcgctttccctctaacccctctctcttagatattaactgaacatgttcttacaaagctacatggatggttgatcaacgacccttataccccttatatatatatatatatacacacacacacacacattgcaattcatgtggtgaaaatgtatgatgagacacccatataactaagttcatgtcagcggtacatccaagtatccaacaataattatagagttaattggatccatgctactataaatatgtcattctagataaatgttactattgtttatgatatcggctacgtgccactaaaatttggggaaattggaaccgtgccccactccatcacgttttctattaaaaatctctattagaatcaactatacgtgaggaagaaagaagagggaggatggatgaagatggaaccgacatgtgggtttcacgtctagggatatgacgggaaacttgacagagtgacacgatttcaattttcccaaattccagtggcatgtagctgatatgtgaataatagtgtcatttatctaaaaggtatatttgtaatagcatggatccaattaacccatcattatatgatgttttttattgaattttgcgtacaatactttcttattggttttatctaaaaaggaaatatttatgtacttccatgtgcatactacaatcatttaaaactcaaccctcgtgtgcacgtgctaaaacaataggaagtacgtgtacaactctattttttttctcttatttagtgtatgcagattaagggcaaaaacgttttctaacagaaatattgattaggattaaccatgtgacacatccagtgagtcccacgatgtttttaagccaacactatacctactagaagactgatgtgaataaacggaaacctcaaataccaaactgaccctttgatggctagattggcaataaatatttggcatttagaataatacgtcatacgttggttaagcttttgaaattccaaccattaatttcttaagtccttcaattgatttgccttaaaaacttgtaggattttacatattcatcttgatacaaaattaattatcaaaattttaaaaagtttgtctaaatttgattgtaaacatcaaatatttatgacctgatcgagtataaaaaaacatgtatactatagcttgattaattagacaacaatttttgtggcgcggtaggaattcagacttttcggttaggtctgtttgaccacagcaaaggaccgtgatccccatcatccatggacagctggcgtgatcacaaatgtacactttaatcccttggcttgcagatgcatggtgcaatctaggcattgttgtacttgtatgtacagattttctgcaaaattgcagataaaatatattcccagtatttagttatttacttttgctaccaagttaaaaccatgcatgtgttaatttggcaagaaatgcaaaatgtttccaaaaaagaagttttactgcaatctttgtgttccaacggctccgcgggttccatgcaaaaatagaaagcttggcattttagcaaacaccaaacgagcggctcgaagcagctggccagccggaggccacccgccatttttgccgcttccctcaccacaccgccccacggcggatcagcctcgcgagtatttatctccctctcgcccctgtctccggccaacctcaatcgatcccgcaacgacaacgttggcgttgggaaccgagtggagactagctagtgaagaccagaggcagacatggcgagatcactggcgcacgcgacgctgctcctcgtcgttgccgtcgtggcggcggcggcctgctggaccacggcggccggcgagaacgaggaggtggcggagatatgcaagaagacgtcgtacccggaggtgtgcattgccacagcggggaagcaggcgtccaagtacggcgccgccgtggacccgctggcggtgctcaacatgcaggtggacgcgttcgcgctgcgcacggaggcggcgcggaagcacctgacggaggcggtgaagacggcgacgccgaaggcggcgaaggcgctggacctgtgcgacagcctgtacctggacgtcgaggacaacctcggcgcggcgcggcgcgccatcgggttcaaggacgccgtcaccatccgcgccatgatgggcatggcggcgcaggacatgcagggctgcgacgagcagttcaggaaggtcggcgagaagaaccccatggaccacttcaaccggtccctcctcgagatgtccgagatctgccgctccctctccaacatgatctgatcgatcgctctcgccgcccgccaccgtgccggcgcgcgcaccgcgcacgcgtgccgccggccggcgaccctttgcgtgagagcgagcaagcgcgctccagcagcgctggtgattgaagcttctctttttaatttgttttctttcgcttctttttttttaacgatcttgttttcttagtgaaaaatgtgttaacttgtaattgttggtctcgggaaagagaaggcacattcaagagggtcttctaattttgaatggaaatgttgttgattcttttttgttgtaatttatccttgatgtcaaaatgtgcatgagcagtatattgaagtgtaacagcgactaaattaaatgtatacttttgtagcaccattatatataaataaagatttttgtatatttgcaattccagagcctaaatttaatttcgattttaaaatcaactgcagcttaggagacattgaaaatgcatgcatttctagctaattccccccagaactgaattccggttgaatttggaggatgcgcacatgaaacagtttatcccccttgcccccccccccccttcgtagaaaggtgtatttcttcgaaaatttgaaattagcttcagctcataagaccttgaaaatgcaataatttcttgctaacattttattttcaaagcattgaatttctggctgactttgaaggatttgtgcaataaaaataagtttatttgcccctcactaaaaatttttctactactcccttcgtcccaaaatataacaacttataactctcaagatttgtctcaaaatataacaacttattcaccaacactgtcttctcaaccaatcacaacccttcaccattcaattttttcacttacctccacttcacaaccaatcacaaccttcacacatttaattctacatattttcttaatacccgtgctcaaacctaaaaattcttatattctaagagggagagagtagcaaacaacactactaccaccgtcctaaaatattactacctaacacaccattgaataattcctaagagcaagtttaatagtgtagccaactactagctccaattcatctatagccaatctaatagctcattcatacaatagttacatactacactattaatacatggtcccacctgtcatatataaactgcgtcttagagtccgtgctacagctggctacaaatctttagcccgctacccttatctctccttatttatctctttaaaatatatttgcagctagcttatagcctgctattgtacctgctctaatacttcaacagatctgtacagctaaatttgaaggatgtaagaaacgagtttttttttttaaaaaatgaaaattgaccgagactatgtacagatgggccgggctcaatcatcggtgggcccaacacgcgtttccttctcgaaactcaacacgacgaagccgcggcccgcggaagaggtcattgtggcagactctgcagattaaaaaaaaagaaaaagaaaataaatcgcagagaatatttggatcgtggtgtgtgagctttaactccccccctttccccgcggccactagggtttctcctcctctttcctctcctcctccgccccgacgcctcgctagggtttttgcctctccctccgccgccgccgctgccgcgaggagaggagggggggagagcacccagccggcgagccagccatgtcgctgcgcccgagcgagcgggtggaggtgcggcggaaccgctacaaggtggcggtggacgccgaggaggggaggcggcggcgcgaggacaacatggtggagatccgcaagagccgccgcgaggagagcctcctcaagaagcgccgcgaggggctccaggcccaggcccccgtccccgcctccgccgcaaccggcgtcgataagaaggtgagtagtatactcctcgattcccccccgctcccctcccctcccctcccctgcctccgatgacgctatcccatcgtgtcctggatcccatattttaggtaggtgttggattggattgcactttttgagagggtttttgattcgtctgcggcatatttgtttaagtttgttattatacccgcatgtctactagcgtgcgggtgagggtaggttcctgctagatgtaggcaacacttagcaccacgtttcgatgcctcgattagtcacttgatttctgattctccttctgttgacaatattacaagtactgttagttggcacggttgcgaactcctagcgtttgaaatgtttccaggtacatgcctgctagctccagtgatctagttttagttttaggacatgtagattgtggtcttaggatcaaatcttccacggattcactgcggataattagttaggtgaccaggaactgtaataatgattgatcttcctgataatttttagtgtacatcttgctgttgtttcatcttatgttttgatagaagcatacaaatgagctgatgccatattatatctttatagctattttttgtgctatcttgaaattgagggtccagtgcaactttccttatgactgaaccttgtctttagtacatggaagcacataaatcatatagtagtgtttctggtcatgtttctagagacgtcctacattgataacgcatacatttatgttactgttaaactacctctggtttctgttctttgcaccacccctaaaagagaaggaaactgcttttaaaccctttttggggtttaatacgggaagttgagtatttgatatctctgttgaatgttgtagctcgaaagccttcctgctatgattggtggagtttattcggacgataacaaccttcagcttgaggccacaacacagttccgcaagttgctttctataggtacaaacctcttaaatgttttgggctgttaccttgtgaaaataatagttgaacaaaagttaattactaattacacccattacaatttttaattagagaggagccctccaattgaagaggttattcaatcaggcgttgttcctagattcgtgcagtttcttaccagagaggatttcccccagctacaggtgtgtgccaacacaatattattttcattatctggtaggttcaaataaaaatggatttattactgtggtgcttttgaattaaattttgtagttcgaagctgcgtgggcacttacaaacattgcatctggcacttcggagaatacaaaggttgtcattgatcatggggctgtaccaatatttgtgaagcttcttggttcttctagtgatgatgttcgtgagcaggtatccgatcatctcctgacttgtctttgtgctttctgtacttccttgatattattttgattgagtgcattgttggagttattaatgtttttacctcttgaaaaaaaattgaaggctgtatgggcattgggcaatgttgctggtgattcccctaagtgccgtgaccttgttcttgccaatggtgcattgctgcctctgctagcacagttgaatgagcacactaaactctctatgctaaggaatgcaacttggactttatcgaacttctgcagaggaaaaccacagccatcatttgaacaggtttggacaaagtttctttgtactctactgtagttagtagggaaagacagttccttaacatgatgtttattgggtgtcaatagactaggcctgctcttccagcactggcacggcttattcactccaatgatgaggaagttctcactgatgcgtgctgggctctttcatatttatctgatggcactaatgacaagatccaagccgtgattgaagctggtgtttgcccccgtcttgtggagcttctcctgtaagtgacaacattgcattacaattttctgccattttcctttagattcttatttgctactctcattataccctttttaatattttatactgtttacaacatgaagccatccatcaccttcagtgcttatacccgcactacgaactgttggaaatattgtaactggagatgacgcgcaaactcaggtattgtgttgattttttgcatctctatatctgacagattttgtatcaattgatatcaactactaagactcatgaatcttgagcttaatatttagaggttgtgttcatcacagttgatattaaattttaggcttgtggaaaatgtttaatatcatagttgatattaaatctagaggttgcatctaatgtggaaaatgttttgtaaaaactattgaaaaataaatgcacatatttgtcatatgtagatgcacatgtttggcaatttgacctactctttacgcccatcaattaaagatttgtctagtttgtgtcacttaaatacttgagatttgtcctctcacagtatcacttagatctatactctatactactttaaaaggtagtagtggtggtggcagtgaatctgccagcactacctctatcactaatgtatgggccctccatgttgggtgaaacccacatgctcaataaatttaaacgtcctccaaaagataatgtccatattgtttggtaagatctacagggaaggaatccataaaggggttgaaaagagccagtctacatattcttcaaatgatgagcatgcagtgtgcacagcatgatttttttttcattgcaacgcataggcaatttgctagtttgcctaaaaattcattgcctgctttgcagcaagtcatagctgctgtacttgtttcagccaaacttggcttttcttattgtattcttattattgtttgagttttaggagagctgagaatttttctgctatgctaaagctggtgttcatataatatgaaatatctactgtagatcacagcatgaaagttaattgcttttttgacatccatattgccatctcatcatctccccccaccccctttttttgtacagtgcatcattgatcatcaagccctcccttgcctcctaagtctgttgacacaaaatctcaagaaaagcatcaagaaagaggcttgctggactatttcaaatattactgctggtaacaaagatcagatacaggtatgtgtacagacttaaaaaatactgacatgctcatcattctactaagtcatgaaggatttgtgtagtgcatacttagtagttttaattgtgttccctctccaaaccataaacaccacacaatgttcatattccatgcaagctttcaggtcaacttttcctttcatgatgattacacttgttagcagactcatccttgttgtacaaagactgagaacatggtagtaacttaaagaaacccttatgtatgatttgctcgcaaagtatcaatggcagcctaatcactagtccaaatgttgctgctgggacctggggtcctagaaggggaggggatgggagcatatggatgattgattcatttacacggttgggaacttgtgcacttagctgcaatctttcgtccttaacctataatagcctatagctatagatcttgttgattgtgcatgttctgaaatgttcaacaatttgctgcattgactaccataggctgtcataaatgctggcattattggtcctctggtgaatctgctccaaacggcagagttcgatatcaagaaggaagctgcatgggccatctcaaatgctacttcaggcggtagccatgatcaaatcaagtatgtttactcaccttgcaccagttctattcagctttatgaaatgcaaatataaccgctttcatagtttcatgttaagcttcatttggatttgatattgtatggtttgttaaaataggtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataaatacaggtactctcaatcctcaacatggtttgtgtttattgtgggttgtttccactcttaccataaatcctttctgttctggtatcattcacttgaggcaacaagtaatgatttcaaatttcctcgacagatttgaccagaggtggtaaattgtggccactgtgcggggtactgaattgttctggtggttcaataagctaaaggtttcaagggggccagtgttacattatttccctactggtcacggatatcatatcactacgtctgtaacagggattaaagctttgaagtctgcgtttttcatcaggctactactatgtagtgtttgcatcttttagtatggtgtgcaacattttgctacttgtatagcctgagtcgaagcttctgcaaagccgtcacaacacattcctgaacccgtctggttttgagtttcgtcaggagtgtgctgagttgcagtttgtccggacatgtaaaccattatgccttttaaattatatattgctagggtttgttcggttctactattctagtgatctctttgcatctgcgtttttagttaataccactgagtagggtttgcaaaaccgaaccactcttactgcaggggtacggtgaaaggaaaaccatggtaatctccttaaattcaaataaattttaaaaataatttgaaattttgataaatttcacggtaacctccttaaattcaaataaaatttaaaaataatttgaaattttgataaattttacatggtcgtacggtttactgcggttactgcgtgataaccgtgcttaccaccaaggagctgtaactccggtctacctgtttgtgatggatgctgcacgtatttccgaatagatgatacagcggaggctaatagaccaagtaaattaaattgaaacttgttgagatgtaatcacgaatcaagtgctttacaattcaaatcatgtttgtgctaaaaacaaatggtgtgacatacaagcaaataactcaaatcaaatgctctaatatagcaaatcacgaaagaacatgttacgcggaaaagagtagatgccttttaaacatcaccgtctctgcttaatctccaaattcttctactcgtttcaaactgcatcagcgcactgcttggtgacgcacgccgctcggcttggctggacctggcaagcggccggcgtgatctccggcgcgcttggcgctgtcgccgccgctgccggcggcggcggctggtgtgggtgcgggtgcgggccgtacggcatcggcggcggcggcatgcccgggtgtggggcgccgtggccgacgtagtagccgccgacggggtgctgcgcccgcagcttgttcgtctgcagggccgtgacgtagacgacgaagccgacgacgacggtgatgagtcccaggattcccgccgccgcgaacacccccgggcgcacccggtggcacaccgcccgcggcttcctccagtcgctgacgtggccggactccaccgcgatgccgaccatgagcatcacctccgcgagcccgaagcagatcctgcgccgcagcagcgacgatcgagcgttagttcgaaaccccaatcatggcgtcatcaatggcggtagactagtcattgacgtaccaggtgacgaagaagaggcagcaggtctgccaggtgagcctggcggggtcggaggggacgcgcgggtgtccctcggcgacggcgagccccgccgcggacgagtccggcgcggcgacggcgagcagcatgtaggcgtgctcggcgaacatggcgacggcgagcatcaggaacgccccgatggcgaacgccagcggcgcccggccgctggagttgtagaagcagacgtccacctgcccgttgttcgccgccgcgttggcgccgccgccgccgacggtcatgaggtagtgcgacgcctcggagcgcgacccctcggcggcgaggcagaggatgaagccgacgatgccgcagagcaccgagagcgacaccagcgccaccgccgcccgcccgctcgaccgcgccgcccgcctctcctgcgccttccgcagcgacaggtcgtcgtgcgtcaccgccgccggcatcgccgcctgcatcgatgctagttactcaccccgacgagctcaaccacaccaacgaatataatcaaaaggatttcgcctgcggatcgcttcgcttttgccggcgtatataaggtgttcgacgtggtgcccggaggagaataatggtgggttgcagcggtgggaagggaaggaatccacgccgggcgagggtttccgtgcggtggaggtggagggcgacattcggattcggtttgctttcagcgaggctgtgcatgccttgctttttggcggggaaagcgatcgatcgatttgattcgctttggagaggcgagagcgccttccggtgccaacgaggcagcgaatcgagagggcttgtaaaggttgggtttggctacgagttgctgatgaatcagctcacactcccaactgatcctgcacctcaattcttcaacagaagagtgtggacatgtgatgtagccatgttatacaaagttgttcttttttcttttatcttgctttgataatgctgaattacttttccccagtagtcatttgcagattttttttaagttaatggattttcattaatccaatctttacatccacgaaggatatatataaccaaaagtatagctcacacctcaacaaagagaagaacacacaacaacaacaacaacaaagaagaagaaaaagaagaagaagaagaagcaagaaaaacctacgacctcggtacaaccctgcctctcgacatcctctcttgaaacggctagatttggcaagtggtagtcgactagtcgccgctgcccaattgtgccatagttgcgaaccttcgctgatgccatcttcatccgcttgaagtgagctgacgccatacaccaccgcttagcccaccttcattcatcatcatctagttagaattagccgaccaaacgcaagttgataggattcgcttccactttgctggattcctatgcctctgtcatccatagggccgtaaccgttgacggaatcctcctccgcctcctggactcccagcccgccaccactgcctagggaccacgtccaccggatccaccttttccctgccgaggactgaccatcaacgcttaggctgccaccatccttcgccacacccgccgttgcccaaagggacgccgctactgtagcctcaccgctacccgccgccctcctgaccacttccgttcccgacaccaacccacgtggctaggcgtgggcccgcccatcgtcgctatgcctccgctgcccacctccctgccgtctcctgtgctactgccaaatctgtggacgggaaccccagactcgacagccccacttcgtcgcaacataggatgcaaggtccttgccgagtaacaaccccgccaccgccttcctagcagccgctcgactggccagtgacctactcgggcggcggcaaggcaacggagagaggatacgagggtttagatctgtcttcgaagaggatttatatccattaaggagaatatatgtgagcaagcgcttagcaacaatttagctgcagaagccttggtagtgtgagttctgttgtatatgtagtactttcttttttctttttactaaactctcactagcaccaattatcgtgctaacttgtaagtatgtctaaattttagattttccgtaattttcatctagttaaatcaaaacaattatgtttattattcgtaagaatcctataaagatattttttaagtatatgtagtagaagtacttatacaatgtaatggaccatgctcatataattagggatagtctaggatgatgattgatgataaagcattgtattgttactcacgtggagtgtgcaaacatgcgcacgaacggaatggcagatggcgactctgcttttatagtactagagagaatggcgactctgcttttatagtaccagagagaatggcctttgcatcaaacaagaaacataacgatattggtgtagttgtactcagggttcaccaaactattttggttgaggtaaccgtggatcagttatcgtggtaactatgtgattttcgtgagatttaccatggtttcaaaagttgaaaagttttgataaccgcacggtttttatgaactctggttgtaccctttgtaatgttgctctttcatccaacgcctactaaaaccgccgcctagagtaaaagaaaaaagaaacaaaaatgagatcggcgattcgtcggatacggttgtatcccatacaaaatcgaaatgatctgttcgtatcaatggtgtccattcaaaatggaccgctataggaatcacgcttcaaaatccagcagcaacagctgtcggcggttttcgctgacgagtggactgccagcataaatctcgcagataatttacaggccccactttttcggttatacttatacttatcggccaaaatttaaattttcaaacttaaatttgaagctgatttctaagtttttatcatcgaagtttatttttcaccatttacttttaggtcgctaaggacacacatataaaagttttatttaaaaattacttatcatttgcaaatatatcatttggcttattttatttaaaagttacttctcgtttgcaaatatgtcatttggcttattcaatggttacctagaccgtacaaactgaaaaggcctcgtcaggctaacggccctaatccaaacccaaaacaactacttgggctgagaggagatgattgggccattttgttccaatactcacgtacaacatcatcttgctacacaagctcatgttcccgataaaaaaaaagggattttttttttgcaaaaaaacataaataaaacgtattaccttaaacaagagagtacccagatcgacgaggactgaactataattaacacatcgttcgagaaagactttgaacaagtcgaaaaatccttatcgcccatcactttcttccattccttttgcaatttgctacgtgaaggcgagttgctagctgcaagtgatcatcctgcctctgacccagacccatgctactactcgttccaagtcgattgatgtttgattagcttggagaggacgtgcacatctgcttcagcagtaggtcgcaaccatttctaatcctcatcatcaccaacaaccagcatctcattcacaatttattaaacctcccaaaattaatacacataaacaacattgcaaaataaaacgaattaatctcgcagaaaaaaaaatgcagcaagaagaagccaacaacaactagtagtagtagatagtactatctcttatatttgagaagaaatattgcagagggaaaaatgttaagctgagtgatttatatatcgattgaggacaaaccgatcatctaaaggggtttacatttgttcccttgtcgcttgcagattagcagataattgtatctgatgttcaacagccgaccactaaacatgctgtcctaattgccattaagccgacaggcttcgaaatcatcgaccgatcgtctcgctcaatccaaatatgtggccttttttggacttgcaatccaaggattactttgatagtttagttagggtgtctcgatatctctcggagaaaaagcgaaaggaggcctacaactttatttatgcttgtagagaaaaatgtgacctgaactcacgccacgcgcgtctgtcatcgttccaggacatacatgtggatcagggctagaagaaatcctaacagttccatctcaatttgcttctagttttttttttctcatttacataaaagacacacacaactatacttacacatgctttaataaagttgttgatgtatcaaaatgaacttgtgttatgtgtgaaatcaagatcaaaacggcactgcacaccgtacctaatattcgtaatgtacacgctggttcacgtaaactacaacataaatttatatactcccttcatttctgattacttatcatgtatcctaatataattaagtcaaatatttctaactttatccattaattcctaaaaaatatataatttaacatgtaaataatatgatatgaaaatatttcttatgatgaatctaaaaccataaatattatttacattaatttattaattgatggtgaaagccaataaattttacttaggaaaaaaataaaataaaaagtaatttgaaactaccactacatgcatgtacacacgttcaaatagacggacatcagtgacacatcctcattgaaaatcaatttacatgtacgtgtaatatttgtgagtattgggattaatttaaaccgtgatagttgaagtcatgaatctacgattttaccatcatatcactggtgtattttgtgctttttattttaataactaacatgtagcttttgcgaaggagcggtttgccaaaactttggcacccacgtacgttccaccactacaaattaatctacgattcactcctatatagtactgatatacactcgatctagatatattatagccgcttctcccataaaattaaatgtgcccgtagattactcgcaaatacacttctcctattctttttttctctgtgagagagctagatatactccgtattatattgctcgtcaccacctgtactatacatctatcatgggcgctacgtgttgttgctgttgacgttggttgtttaattcctctcacttttctccactgtctcgaccgtgttcgtgtttgtatttttcgcactaattaagtaaataattattctcgtttgtgtttccctcaaaaaaaaaaaattctcgtttgtgcgtgccagcctgcatatgtgcatgcaggtgctcgccacgttcatcgaagcctgcatataaagaattgttgaccccgccgaatttaaggtagtatataaagattgattagtagtaattaattagttataaactacacgcgcaattaagccgttgagaaaggctcagcactaagctcttatgtgtgtgtcacactgtcactacacagctcgaatgctagattgcactcgttttgaaatattggaactgatcaaacattagtttgttgcttaacattttggaatagatcaagtatgatgcatggcgacgtgtgctttagtattagctcatttagtgtacaaaaggcatacgaaggtttcgatgatacaacctaaatttaccaattaatccaaatataactattcacactcgatctcatcatttctcgcaactcctctcacaacaattcaagaacaatcttgatactaaggaatacactttgccataccacagttttagctaccacagtttgttagccagccatttgattgtgacttgccatattttttcaatagcatatcccacatgtcgtaaactagattttcttgtcaactttgctacactttgtggttagcaatttattcaccacacttttgtgactgtcacaatttatctaatgttagttatagtaaattgtggccagtaaccaatcacaccctatatcttcacctttctttcgttcggcctaaattatgatttgttttttctttcggtctaaactttagaaatttctttcggtctatactttagaaatttcgaaataaatacgaaatagaaatgatcatttatttacctaaatgccacgggccccacgtagtagcgcgagtctgggcccacgatcgagactcgcgcgcgcacagttacaaatacctcccccccggccgctaaccactccgcttacccacgtctccttcaaaatctcgcctcgccttcccttcccttcactccgccgccgccgccgatgctgagccacgcccacgccgccgccgggagccccgccgccacggcgccgtcaagccccacgcgccgccgctgcgccgggaaggacgacgtcgacgacgctgacgatgacggcggcggcagcgagcagttcttcttcttcagcgccccggccagccccgtgcactacatcctccgctcgccgccgtcctccacgacgacgacgacggcggcggcggcgcactatgctccgggcgtggacggtgaccacggatgcggcggcggcggcggcggggacttcgagttcgccgcgcgccagcatggtgcagggaatggcgccgcggcgatgagctcggccgaggagctgttcgtcgcggggcgcatccgcgtcgggtgcctctcgcccatacgccaggaggaggcgggcttcggggagcaggaggaaggttgcgtcgacgagggggagagcggccgccaccgcgctgctgctcccgcggccagatcggcgtcgccgccgcggacctcgatctagcctagatcgccgagccctcggactccttcgcgtcgtcgtcgtcttcctccacctccacctcctcctcctcctcctcctcgtcctccgccaagagcactcgccggcggatatcgctgcgtgacctcctcctcggcagcacggcgaacagcgatctccgccaccgccgccgccgccgccgagaggtcatcgggcttttggcccccgtccatctggccgtcgtcgcggtccaagaagacagcaacgctagcgttgccctgcccgtgcccgtgcccgccgtcgctgcagccggcgcggcggtccacctcgtcggagaggtcgtcggcgccgccgccgcggcggcgcgcgacgtcgctgccgtaccggcagggcctcgtcctcggatgcctcgggttcggggcccggagctacgggcttgccaagtcaatgcatccgctttcctctgggtaaaagcgtaaacgcgaaaacccgccttcaaagggaaaactaccaaatcgccacattttgaagttcaaatagcactttacgtaatcttgcgagggcttgcatgaaaaaagaaaaggaaaacaaaggatgtaaattaaaattttgctctgtttgtttctatctttttgtggcaatgctacattgatccatcacttcagatgtgcattagtacaactgtacaaatcactgtgatgcatttgactggctacattgatcttttggcctttggtttggtactttgatgggaacttaataccactaattcttgttattttctgcatgatctaataaagtgcttatttttagtgtgcgtgtggtgaaatatatcattcattaaaaaaaactcttataggtgatattcctcctcaattaatacagtgaaattgtcatgccttttgctttcaaaaacagattagcctgacaattgtcatcatcatcatcatcaccattgtgttttcaagtagttgttgatgcaagtagtctgtcggcgaagacactgaagtcggtagtagttaacaaacgcagtgagacacgaatgaggagcccaaacgaaaccttttccttttgtctctttgatttgttcatagcataaccaagataccatgtttctatggttaagtgaaaaaaagatgaggcctcgtaatcgctgtgataggtacgagagtgacacaataccaatccactcctatcaaggaagaagcattttgatcttgaatgcttgaaaagatttttgttccaagaagaggatgaatgattaatgttcagacttatcagtcacgaccttcattttaattgtttttttagaagtgagcatatatatgctgcaaacgacccaagtttgggtggatgcgtgcaaaattagtcggaaacaaccaccaaagcgccttataaacagaaaacaaatgaatcaaagtaatatgcttgcatcaggacaatgagcatgcagttaatttgaaactttgggttactatgttgatatgttgaaattcatcagaaagcatcatactagctcacttcatcaagatgcaccggagagcataacaagaaacacagctttcaaggatccaaatgcaagcgacagtaacaatgcagcacaacgctttggtttgctttgcttagaaggagcaaacaccacaagctcttcagcaacaaaagcacacgcttgtcctcacatagcttaaggttaatatgtcttaataagcaccaatactgaccctaagtagcttgattatactgagatgactgacaaaaacagttggacggatcttaaagctagagaaatcatgaacatgagacatgctttgttggcagaatgtcttgtatgtgatgccgacctctacaggaacaaatccttcatctggccattcgcaagcttgcacagtccattgaatggtgcaggatctgcagacaaacatgatagagagatcaatggtgtaatgagggtgtctaagataaaattcttgcagcaaatgtaaagatttagcaccacatactagttgtcctgtgtcagacgagaacaaaagaaacgttgattgagattattttattaattgatacaaagaaacgctgtaacattgggcatataagctaaaatagcttttcattcccagaagtatactcatgaacttcaagagctacattttcaacttagttgaagaatgtttttccacctgaaatctactctagatgatcaatcgcaaatcgctcattcccagaagttaagcccatgagcttcaaaagctacattttaccaaccagacaagagtgcatgtcatcctaaaatctactctatgatcaatcagacacaaatttgacacaaataggggtgagattgaagttcccatacaactaaagtcaaatttggctgtaggtaaaaaaagtccaacaattaaacaatcaatattagtttttgaatgcttctggatttgggaattcgtatagaacacaaacagctacacatttacaaaggcagaaatttgctcttgtaagcatgaatacgatgaaaaatgtaacaaaacgtacttatgaaagtatgatttttatgcgaactgtacatttttttgctcaagaaaatatagaacacaagaataacgaaccccaatcactatgtaacatgttaaaaaaccattggtgggggagcatcagaataggcaagatacaggcactgtctggatttatgtaaaagataacaaactgtacagactaacaattcatagtactatttactggaggaaaagaatgcgaggcgcaacaattctcaccgaagttttcaccaaaatctgtgcaaacttcagcccggatggcctgattgggttcagcgatcccaataatctccacatagtgcgacataggggcaccggaggcccctttgatggttagctgatgaccatcggtggactgcccgataagcaacccgccttcctcgcgctgggcttggaccaccgtgcgcactcttcggccgacgaacatcttcagaatctctccattgacgaatgctgcaggtcctgatgtatccatctctgcaaaacgcatggcttttcatattcatcaacacaattcagaattaccaatctgatgacacaggcaagcaatcaaattgggatcccacaaatctcctactcctgtagttctatcacgggatcatgcctagcaagcacatggtaaatccagcccacaagttcatttaactccttgattcatttaatccaagaagggcacaaccactcggactcgggttttcagtttgcgacaggaaaatcgatgtggttccctccttgatcaccactagttcccctcctaagaaaatccagccaaggaaatttgccgttctctccagccatacctgatactgataccctagtcctaaacaggaggacctagcgatcagatctactgcagagatggacctaagcgtgaggccatcgaataaacaggaggaagagggaagagttggaggtggcgtgtacctgcttcgcttcggggggaggcggcgtcggagatggggcggacggcgccggtggcgagggttgggaggactcctgatttggggacgcacgcagcaggagagggtctacggaattctgggagctcgcggaaaataaacaagttttattacgaaactgccacccactccctgaattagtggcgccaaggctccgcgccctctcgactcttttcgcgccaaaacaccaatactctttcctgccactaaccaacctcctgcgtttgagagcagcggactctcgttttgaattaaatttgaaaatataccgttcatatatttttttcctcagtaatattattgatgtattttttttttggcaaactgatgtgggagcggtctcgcatcgtgagggtgcgacagcgttttggaaatagactgatcagcgattaattaataataattagtgattaattatccaattaataattaattaattgctaatcaagataattaatcactaattaatcagtgattaacggcgaggctgtcggtctcgctaattaggtcccgctctcaccgtgcgagacgacagtatcaacggtatgtttgtgcgactaaaattacatccgaatattttgagagaaaaaaaataaacggtatattttcaatttgtttcccttttttccgaatgcacgcgttttttcaaaaaaaaattatatttaaatgttacctagacgaggcggcggcgccgtcaccggcgcaggggagaacgatggagatgtgttcgagcgacgacaatgtgcagcactggtacaccattactgacatcaatcagaagtcgacaactacgaaccgcagcttcgccgccaccgacagcggcggccgccgtcaccaccgtgggggagaacgacgaagatgcgttcgagcgatgacgacgacgaacagcactggtacgcacgccactcctgacatcaatcagaagtcgaccaactacgaaccgcagcttcgccgccaccgacagcggcggccgctgtcaccaccgtgggggagaacgacaaagatgcgttcaagcgacgacgacgacgaacagcactggtacgccactcctgacatcaatcagaagtcgaccaactatgcaccgcatcttcgccgccaccgacggcggtggccaccgccgtcaccgccgcgggggagaacgacgaagatgcgttcgagcgacgacgatgacgggcaacactggtacgccactcctgacatcaatcagaagttggctaactacgcaccgcagcttcgccgccaccgacggcggcggcgagaaagacggatagctgcgtttgttagctggtgtggagtgacaagcatatcgctagtagttgtcgcctgatcgaatgtgtaaagcctgggataatatatggtactgtaatgtacctaagaaagtgatgaaagcttttcaacaatttcattttgtattactagtaatatgcatgtgctaacgctacagatatattttataatataaatcaaacaacaaaagctttatatatttttggtaatcaagcatggtatagatagatctaaaattcatgaaaaaaaggaataatagagagaattattatatagttaattaaaaaaaatgtgcgtggataacgtaacatatcgaaactgtcagtttcttatgcgcttaatgaattttcgaataactacaggaatgttatctttagactcattttcatagtaattccacgtaaccacgaaaaacttagggattgttcaaacgtagggatcgggttttcatttatgctttttaaagtactaaactttatatataataattgattgaaaaatcaaataaatttatttttagatttttaaaattgcaagattaaatcaaattaatttctcaattaatcatactaatcatgttttttgttttgcgcgtggctaatagtctaaggtttattctcactccgtgcatacataactggagcgagtggggccaaatgcccctttgacacttttttgtttcctcagtctacctaagcggtagatccttagtctatctaagtggtagatccttagcacccgctcatgctattttctgcatccgcccttggacgaggcggtgccgccgtcgccgccgctggggagaacgacgaagatgcgttcaagcaacgacgacaacgagcagcactagtacgccactcctgacatcaatcagaaatcgaccaaccatgcaccgcagcttcgcaggtggcggcgagcaagatagatagccgcgcgtgttagctggtatggagtgacaagcatatcgctcatagttgtcgcctgataattatactcactacgttccaaatataaacatttttagctatgaaagtatgtgtccagatttataactaaaaattgttatattttggatgaagatagtattaatcaaaattttaaatttaaactaatttatatttaattaattatgtaccaatggctcaactcaacgttgaagtactaatttaaatactttaactcttagataataaaataaacaaaataaataacttcttttgttaaaaggacattggacactactctttcaatcgtaggaatggaaaaacagagaaataaaaatacataaaattatgatagaaatgaaaagtgtaaaatagtgaattgaaaacacggagaaacacacatcgttctattggatcgcaggaaaaacatatgaatcgaatgagagatataaacttaaaggaatttttctaagaggttggatcttttgctaagttttctctaaaatctacatgtaataagtcattcaattaaaatttcacaagatttgaaaaacttaaatcctttgaatcaaagagcaaatatttgtttatttttcacttaaacaaattcacagtggtccttggacattctacaaaatggacaaaaaaggctcacatacggttgactaactcgaagtacgtacacgccctggtaccgtagtgctgcagttaattaactctggtagagtacatactatactgtactgtctacatacatgtataatcaccagaaactagttctaatttccttaatcaccattgatcatccccacagaagcaccgcgacgacggcgcccagcagcagaggcgccggcgtggtcacgaggccgcgtggcccgccgccgtagtcgtagccgtcgcccccgaggcgccgcagcacgtcgaagtcgccccggaggccgcagccgcggtcgagcgcgaggcggacgtcgcggacggaggcgccgttgtagaagcggaagctgtccatgatgccgtcgacgcagccgagcaccagcctcgtctccgccaggcacggcccgccgcagaacgcctccgccgccgccgccggcacgcgcagcgcgccctccggccccagcctgtactgcccctggcacccgctgaagatctgcaagaaaacacatttctcgcagcacataatcagaaacagcgtgcattaattttcttctcgaattctttctctccttttcttttggtctgaaactgtgttaattactgttcaagcttgattacgagcagtcaatgtttgctaagaggatgtgcttacatatcgatcgctgaagcagatgatagctctggcgacgatgtcttcagtgctcctcttctgaccatggaaggctcctgctgctgcttcgtctgcatgcatcagaattcagaaaaacgcaaacaaaaatcgatttcagtttcagatatgacaccaaaagagcagcaacagcatagtgtaaacctgatttgcagcaagtgatcgaccagctgcagacgcacgccatcatgagcaagaagctcctgtgccaacaccaggtcatggagacccaagccattatcgttcttgtcaattacttttcacaacttctcatgctcgttcttatgtgccataggacaggaggaagaaatgcaagcgtagatagatagcaccagcctgattgtctgaaactctgaatatataatagcggggatcgatttcgcattcagaaaacatgctgcacgcttctctgtttttcatgtgtaacgtgtgtgactgggtggtagtacagaacacagtagccactaagcatcaatctccttaattctgctctgatttgagcataaatctattttttcccaaaagctggccaactaatcttgaccataatctaccgatctcctgatctcaattttcatggcgatgatctaatgctccgtgtttccgtacgtcgttcacccctgtttgctacacaaaattaatcatttttatttatgttatcattttcagaaatgacatgttgattacttgctactgaatttatgggcaagttttgaaaaatctggtgggttgagaaacctaccacgtacctgacgtgatgaaaactacggtatttattccccgagaaaatgtttcttttttactgattcgtgcaagtaatcaccaatctaagtacacggttacccatctgttcttcactaaccaagaaaatgtcaaacagcacagaggataattgcaagaagttattgtgtctctattgacagttgagcacacaggtcgtgttcttcagatggaaccattttattcagctattacgcttccctgtgtcctaaatggtaatatttttttagaaaactatttattacgaatttcttagaaaaatatcttaatgtatttttaactttgtaataattaattcgtttgtttgtactctcgaatagcttagaatggttaattctttcgtttgtagcctcgaatagttatcacaaaattagttattcaaccatgtatcgaaaagttcaatccaaaaacctaaattgatgggaaaagatgagcaattcattttatattccaacactccccttacacgaggctcgccaggcagcatacgaactcaaggcctatagctttgataccatgttaagttacatgtatcgatcagcttaatctaaaaatttaagctgatggtgggagatgggctattcaaggtcctcaaatgtgtgtgtccgaccatccaacggtagatggatctcaagcccattcgcacttgcacatggtacgcagcagcaaaagttaactcggcccatactccagtgatgggccggatctcgcaatgtggatttgtggtggctgtgggtggataaaaccgaggcccacgcctgcatggggcacgcaaggcctccacgtatacctcggagaagttctcatccgctgacgtgtcccggggcatgtgtcgctggacgacgcgtccacggaagtgactcctcctcctgatcttctgcggctcggcctaggtggcaaaaaacggatggagcctccgccgtgtcgctcgtatccgatacgctcgtacgcatacaacgttgtcctggcacgtggtaaacgtactaacatggcataccttcctctgaccaaaatgttcgttctacactccacatagtttttcttaaaaaataaaatactaattataacacggcaagaaaaacatataaaagtatgaaagtatttgtttaaaaatagtacagtatcaccacaccttatgcttacgtgtagtgttaataatgattgttatacgtaataaaatttcactcaccttaacatagtatatatattgacttttgaaataggcgtgagaatacagagtactcctaaaattacaataattccaaattcagacagtaaaactactgtgaatgcgtcaaatcagagggtgaaaggaacccaacaagatgccaaaacgagcctaccaaagatattagagcggagcaagcaacccggggacggacggatttttcttcacggtttctctctcctcccccacaaacaatcccacccctctctttcctctctcctacctccctcccatggcgttgccgtctccgcatatataggaggcctcctcctccctcccatcctctttctctcctccattgctgctcctctcctcgcaccaccacccgccgccgtcgatcgccggagtcgagagtgaacttggttggttggttggttgatctcgagtggtggagcacacggggatcatcgccgatttggctaaacttaaccccgctattgttaacggcaacctcgcggtcgcgagaggaggaggaggaagaggcggccatggaggccctgaggttcgtccgcggcatcagccccgccgcctccgcggctccgcagccgccaccgcctccggtggcgcagcggcaccaccagcagcagccgtcgcggggcgttctgcacgcgccgctgctccggctatggccgctcggtggcggcggcggcggcggaggaggaggaggaggaggaggaggaggggagagggtcggtgcggtcggtggtgcggttcgcggcgaggaggcgaggagccagcgcgcggcggaggcagaggcggacgagcggaagcaggggaactgggtgctgcagatgctgcgggtgcagccacagtgggcggaggcggcggacgccgaagccgcgggagtcaccggagccgctcgagaaggcggccaggaagcgctcacggcgggccgcgacggcgacgagtgctgcgcctcgtgcggtggaggtgacgacgaaggatgctgcggcgtcgaggaggacgacgagagcgacggcaaggtgttcgaccgcgcgaccttctcgaggctcctcaggaaagtgtcgctcggggaggccaaggagttctccaagatgtcctacctctgcaacatcgcctacatgatccccaagatcacggtaagatcgaaagcatcaatgcgagtgactgctattctacaattcaccgatgcggtaatcacagccaataattggtggattgtctacacgccaattcgattgctggtgatgaactgttcatggttgagtccttgtccatgctgtaaattcaagagaaatgcaggttgtggtgttactaagaattcttatttagtctgttttggcttctactacgtattgtctatgcatttcctttacagagatagtgaagaatttcctttactgttctgcaaaattatgcattatgccattatcgattattcgtcctggtcccctatgtgcttttggaccttatagtggggtcttcctgaaggatttgatggattagtgccaggtctgcttaatgcaattatactcttggagctatctgtgcctgagttgtatttgtctattgttgtctttcaattggttgcttcacttgagctgctgcttctggcatatggatacttatttggtgtggtaatcgtgatgttgttaattacacaattacctttctagtacctcataactagattatgattgcaatttgcaagtttcctttctgacattctgtgtgatattagtatttcattgcctgacttagcaactgtttgctttctcagccaaaattgctgcggaggtacaatttgcggtttgtgacttcatcagtacaagagaaagccaaaactggtgttgatcagaagcaggagctgaagactgaggaaggtgaatcttcagatcaagaatctgaagttgtagagaaccctgagccagggagcaataagaagaaagaaagtgggttgggggtaaaccccttcggcgcataccatgtcatgtcgtctgctgcctcttatttacattcacgggctatgggcgtcgttccctttggttccaggaatgatggcaagaacgatccaaccatcatggccattgtaaacggtgagagtggtgaaggtttaaccatggatgaagcttcatttgtggccactacaaattcagttacctccatggttgctgccaaggaagaaacaagacaagctgttgcagatgatctgaactcttcaagatcttgtccttgcgaatggttcatttgtgatgatgatcaaggcagcacaagatactttgtggttcaggtatgtcttctgcccaatatatcatgattcgtgtaattttcactttccctggttcatcttcatcaattttttattgttaattggcagggctcggagtcaatcgcttcttggcaggccaacctcctatttgaaccagttaaatttgaggtatcctactagtctgccatcctacatttctcagtttctcatgaatgatggatagaatcaatcttgccaatattcattcattgtgcaccagcagcttcattatttagatgtgcatcatggattgatcaagtgtattaaattgacacacaaacatttaatttgacatattagacgtaggaagggcttgacaaatttatgtaagctaagacatttgtgatgttttgcagggactcgatgtgctcgttcataggggaatatatgaagcagccaagggaatgtatcaccaaatgttgccatatgtcaaatctcacttgagaagttctggtaaatctgcaacgttacgcttcactggtcattctcttggtggtagtctggctttgcttgtgaatctaatgctactgatgagaggagcagcacctgcttcgtcgttgttgcctgtaataacatttggtgcaccatgcatcatgtgtggcggtgaccacttgcttcgtaaacttggattgccaaggaatcatgttcagtcagtcacgatgcatcgagatattgttcctcgagtcttttcgtgcaactaccctgaccatgttgctaatattctgaaactagccaatgggaatttccgcagtcacccatgcctcacaaatcaggtagattcatgaatccacttcagttgataaattagctcatttatgtggtaataacagtatatgttcctgaatttaatgacttaagactacaaagaaaatttatctgatgctttgacatggagaacaaataataaacccatcagttggttgaattatacagcgaactgtgccctgcaggttgaagatctagcatgatgtcctggctgtcacattttcagggactgaaaaacaacacttctttttaaaacaaaagtaaaagtagttaaaaaaaatattggcaaagaacacttggatctttactgagtactgcaatatgcagctcttatagtcatcacccatcaccacttagttttcttgtttgtaaaatgttcactttgtttgcatgttaccaaaattgaccaacaatggttgtaaccctctctgtggatttcactgcagaagctcttgtacgccccaatgggcgagatgttcatcctgcaacctgacaagaggctatccccgcaccacgacctcctcccgccggacagcggcatctaccacctgagcgactcgtcgtcgtcgtcgggcacctccctgcggcggctccggtccgccatgtccaccttcttcaactcgccgcacccgctcgagatcctcaaggacaagagcgcctacggccccaagggcgccgtgtaccgcgaccacgacgtgaactcctacctccgctccgtccgggccgtggtgcgcaaggaggtgcggcggcaccgggagacgcggcgggggcggtggcggcggctcctcctgtggtggccgctcggcgcgcacggcgcgctggccggcgccggcgtgctcctggacgccgccgtggagggcgggagggagacggcgaggcaggcgcgggcgcacgcccggctgctcgtcgtcctgctggtgccggcgaagctgctcgtgatcggagccttcctggtcgtcagattgatgtgattcgcggacgtggttagatcccatccatccgttcattcattttgttggtttacacaccacactgctgcagtgctgctgtatgctactgcagcaatgattctttcttcccagagtggaatgccatacaagtgtcacacccagatgctgattttctgttttgacactaaaaaaagaaggacctcagatagatgaagatcaaatgtcaattaattagactctaaactatattagaaatttattaattggactcaggacttggcactggtgtctgtctatattgcccatttgtgtctctaagctgcgtcatgaagcaagacatatatgtcaactggttggcagggtaggcaaccgtatcggaacacgtaatgaacattcaaacgtactgtacatagcttgcgtcgtcgactcctcgtcagtctcctgtgtaacaagcaagtgacaggcatccgatgcattgtactgtacgtatcaagtacgcgttgcttgccgagaaaccataccgtattttgtacgtattacgtggagacgtttatacgcgtacggtacacatcgcctcttttcttttgttggctggctggactggagcattgccagagctggaaatggaattggaagtaatgcatcctcaattgccgttgcccatcccgtttccgtctgcatcttgcacacttgcaccgttctgaaactgaaagtagccttctccacatgcgagccgtctaatagacagattgccgtttgatcagacgttcaaaactcgccaaaccttctaactaaagtttctcgctaaagtttctccggttttggtccaaaaaaaaagtttctccggttatacatgggggtagtcttcgttacccaaatcaaatatactaccatttagagcaccgaagaaatttgtggagaggatcttgtggagaccccttcgggcctctccaattagatttaccgtcttaggacaggttaattggggaaacaatctataaccaacacaattactcaattaaatcgttctttcgatattacatctactttcttgtctagtttttatcttggttcattcatcttcatcggtttgcgttgtaagccttcactcttcgccccgagtgtaaatcttgtttgtagatttgtctaaaaaaacttccatctaatccatgagacatgtttatcccaatttttctaaattggttttgctagctggttttaatctatgaactcatctcaattaggtcttgttcggtttgaagggggttgaaaggaattggaggggattgagggggaataattccacaccacaatcgctgacagggattaaccgaacatagccttaggagtttttcaaggttgaggtggttggtgactccaatcaataccacaaaatgtgttggtgatgtgacaaaaaagtcaacatgttcttctgtagttctacgaatggaaagctctataattaccgatttttagagcttgttcagtttagaggaaaaaacaagagatttggattccaaaagattaatttctataaacaccatttggtttgtagtaatatagggagcgtatatattggaggtgctggatggctaaccgcttgatccgatgagagctgctacatcccgacaactatgtcttctacgatcaagctgatgaatccattgatcatatcttgatccagcgtccagagtcacgttagctatggtgggcgatcctaagcgcgatcgacaggcgcattgcttccctgcaaactccacttccttcctttggtggtggtgtggtagcgaagcagatcaccaaagcacaacgacatggttacgacacgatctttagcctcatagtttggactgtgtacatccattgtggctgtagagaccggattttaatccattttctaaaaaaaatgcctcatagtttggacaatttaaaaggaacggaacaacgagtattcaataaccatgcgcgaagctaccgaggtagacgaagatgcgctatggcacttaacgagcatgcagctgtaggggcaatgagtgctatggtcgacaagtcgccaagctagatcgtgagaattagcactaagctattttgttttttttccctttcattgttccgattgttttgctctggtaaagtaactccccaagcgtaatataaaatatgcaaatcttatccatattcaaaataaaaggaatttctcgttcctacaagttgtggagagaaaacatagaaaattttccatccactcatgggatttgcttggctaatgggttagtgaaataatttcccacccaccaatcctaaccatccattatccctctcccgttcgaatctactgcaaggatgaagattaagtgcgcacgtaaaacgagataagtcattagcacatgattaattgagttttaattgtgaaaatcttaaaaaaatggatttattagagtttttatagcaacttttatgtagaaagttttcgtacgaaatacaccgtttagcagtttgaaaagcgtgctaatggaaaccgagaaaaaaaatctatatcttaatcagtttagaacatggcagatttaatcttcactcatttctctatcccaatcccgcttcttttatttatttcactatcaaaacaaacccaaacctcttgaaaagtttccacgaatcgatatgtgcatgcgtttctatttttattggttaaaatttcttccaaactaaacaagcccttcgtaatagggaaaaaaaaaagaaaatcgacggtgagttaggttttcttcagacttttcaccgaaatccagctggcatcaaacggcagaaatccgacacggcgacacgcagcaccctgccaggtcggaaacaggagcgaaagatcattcgtgccggcataaaattccaaagtcttcttttcctcctcctcctccagcttgcggtcgtcggcaacccacgaccacgagctcgcccgcgagtggcgacaagcgccgcgtcggcgtcgcgccaatccggccaccctggggctgacgcgactcgacgcgacggcagatatacacggcaatccgatccgatccaatccaagcggcgtcgtgttttctctctcgctgctggccggctgccgccgcggcgatcagagagagagagagagagagagagagagagagagagagaggagggggcgaaacgtgtggcgcacagccggcggtggcgaccggaggatgccggccggcgaccgatcgatcgacgaggaatgggtggccacaactggcctgtagatagatcaatcgatcgatctgctcctcctttttggcacttcaagctttcaaaccctacgtgtgtggagtcaaaatcccaagatttggtttttggtgtgcatttgatgtcaggttcttttcaaacaaagaaggaaaaaaaagatccttgtatttggaattgaaggtgtactccctccttccaaaaaagccaatctagtaggaccccttctaatctatccagattcataatagtaggagtcttaggttagtatttttgttgggatggagagggtaatgtacttgtaacttcgagcctactgtttggcttcgatcgggctagcatcggtgggaagaatgaagtcataaactcgatgcatcttaagtttaaactgtagcacggtttatactagcatgatagaacaatcttccaaccagcatgatagaacagttcttcccatgtgcaatcaaacgtgttgtaacatgtgcaatcaaatgttttgtaaaagtcaagaaaaagaaaatgacaataggtaatagtgttgttgggtaagaaagtacaatatatatgtactaaagcactgtgttccaccagaaagttacgtcgatgtttgttaggccccgtttagttccccaaaattttttctcaaaaacatcacatcgaatctttggacacatgcacaaaacattaaatatagataaatgaaaaaactaattgcacagttagggatgaaatcgcgagacaaatcttttgagcataattagtccatgattagccataaagtgctatagtaacccacatgtgctaatgacggattaattaggctcaaaagatccgtctcgcggtttccagacgagttatgaaaatatttttttttcattcgtgtccgaaaagcccttccgacatccggtcaaacatccaatgtgacactctaaatttttcttttctcgaactaaacaggcccttagtaatgcttctacgctctttcaaagtcgtactcccataatatcataaaattctactgttcaacacaatttcataatggacatcacagctagcatacccacccaagtccatatgaaaaaagtccacattttaaagaaaaacgtcattaccactaattgtagttaatactaattctcccttaagtcacatcgtctcaattatttctagtctttagatgattcatcaagagtgcaaattgtatctcttctccctgaaagacacaccatacaacttaagtatttataacgtttgaataatttatcaaagtataagcacatgaaagaaaatcatatagtaagaaaaaattacaactaatatatactaaggatgcgttcgttcgggttaggaacccatctcctccgcacggaaaacggagtggtccattagcacgtgattaagtattggttattttttttcaaaattagatcaatatgattttttaagtaactttcgtatataaatattttgtaaaaaacacaccgtttagtagtttgaaaagcgtgcgcatggaatacgaaggagaggagttgggaacacagagcaaataacacctaatttatcacacaattctccccgcaaaaaaattatcacgtaattctcacgcaccaatgcgca

SEQ ID NO: 50836 - DNA, 708 bp, Oryza sativa
ttcctgcagccccaactgaaaagaactccataggattcagattggcctcatttggaatggaaagaaatgtttttttttgttgagatgagactaaatccaacagaaatcctataaaattcatgaaatatcttttcgtgaataacagttggatgaatgtagcaacctaatacaaagattagacatcacctgtctaatattatactccagtttgctaatggagctctctgcttataacttttctgtgctatgatattccaacgcattatttctgtgaaggaggggctgcgctggccgaagatgcaatgatgcaggagtgcgattaagttgcgtcagcggcaagggattattatccctttctatatccggcggcggcgcgctcccggccggttggaggcggccatggacagcctgctacgccacgaaagcatcattatatctgcccagatgattcatacacatatatgatctcaaaaggcgatcgatgtgcgcacgtacatacaggtcacaactggtcatcctacgatagatatgccgtgcaacatgcgttgctcggagcacttcaattaagatagagggaacaaatgttataagaaagattttcatcggtagtcgactgttgagaaaagatgtgcattctatgtataaacacaagctactgaactgaaagccgagtgccaaaccggttattggtattattcatgatcattc

SEQ ID NO: 50837 - DNA, 5878 bp, Oryza sativa
gaactatttgctctatattttatttgagagaaaacattaagtagctcttaacatctcatgtattgatttttattcgtagcttcccatggtggtcaacatgctttgaagaagcttaaattgatgaggcaagggatagatatttcacaggaagcttctcctgttgcatcacagatgagtaacatggcaaattctgctaaaattataaagataatcaccaatagggatcgtgggagaaaaggcaaagcactgaaggtactatgatttctctaactactaccatgcacctttctctttatttgcataagcatcatagttttgtcagtggtcgaagatgggacctttgatctgctgtgttgcacatttttctgctctgtatacctataatcaagttagaaattaagatgattcttttgtcatgtcatgttcctctttccgtgagcaatagaccagtaagctaatttcacctagggcctgtgttgctggttggtcaagatagagagacagactcagctcaggtcaagcaagcaggtggaagtagtaaggttatagttatttcagttgtatggctggaatacagtgaataatgttgaaaagggttgctgatatccaaggaaaagctgtccataagtccagaaccttctcatttctcatccatgatctaaaagactactatctgtagtcacaaatgcatgtcgttttggacattggttcactattcagaatacaaactgtccccaccaatatggcaatattttctgcagaatatttataaccactgatctaattaaagtttggctgcacatatgttgttcttatggtcttgctttgttcctttccatttggtccttttcagtcagttgttttgctactgaatcttaacatgataaacatttcccttttaagttgagctgtcataaatcataatcatgaacatacaagcataatgttgtggacaacacatgctgtacaaacaggatatctttcctacaatttgcttattgaagttctatgcttttggtagatggcttccagcggtggatggtcaaacttcgaggatcaggtttgcatgtgcacatattttttatgcttttggtagatggctttgattgattatgtgttctttaatacgatttgtggtaatgacttaaatatcataaatttcaggctcttgttgtccttgtccacgacttgggtcaaaactgggaattagtaagcgacgcaattaatagcattgagcaattcaaggtaatttaaaatctgggatagcaactttttctatgtttgtatattcttcaaacatgtcctgcaagctctgattttatttccgttcttggttctaggcattttattttagtggtagatgccattaggagtaagttttgggttctgttgtaaactctagttgcagtgaaaaaaaatacattttatcataatctcatgggctgctgttagtgatctttccctgattaacttgagttttgcataccttgtcatgcagtctgtatataggcaacctaaagggtgcaaggagcgttataaggttctcgtggataaaaattctggtgatggtgccgatagtgcagaggactctggttcatctcaacactatcattttacgttgccaggcattccaaaggcatgttataactactcttttgatttatatatttaattgcttgccacatatgcgggtacatctcacaaaaatgtgatgttggacctatttactgtctgatactttctttctgaattcaggtgttgctttcatcagcaatattgctataagtgaagacatgttgagcatttcactgagttcctaacatgttttattcatatgaacatcagggaagtgctaggcagttattccaacgacttcaaggaccaatagaggaagaaaatctcaaggcacatttcgaaaaaatgattctactcatgcggcaactgcacgccagacgtagaaaggttcatgtctctccttatgattattctggtcgctttaatttgttggtggtttataatgtataatcatgcaacttattttgttacatttataacagaggttaggtaactcttgcttttttttttgtcttgcaagaattttaggttgtaatggtgaaaccaagtattcattttctagtcttgaacttgtattagttctatacctgtgcttgtctatgtacctctttatttcaatttatgcatgtacctatgctatatttgataatatgatgtggtagcaaactcttccgttgaactatctcacttccatctgtctcaatcatctttctgaactagtaatgctgaactgataatgtattattcacattatgccagagtgctttttttactacccttcttgttgttactgggaagtatttcttatggtatgttttttcttgtgtcttgtctatagggtaatagccaggaactcaagtcgatcatacagccacatagttctcatgttgccgctctaacacaagcatgcccaaataacttatccggaggcgctttgacgtatgtaatgcttttgaatgttctttttgatatttagtttaatatttttttggtgaaaatactaagatatttcatcttcctatatgttctctagttattattattattttatggccctaacagcatccagtggtcaccttcatgttgatgtgtaatgtgtaacaggccacttgatctttgcgacgctgtaagttcaaacctagatgcaagtacgcctggtagtggttaccagagttcttatacaattgggttaacaccaccaaaccatcatggttccaatggccctacaactcccaattcaactctgaattccaggttatcagggtcacctggtacggttctgagcaacaattttttgccgccttcaacatttagtgcctcttcaaggtaaattcttaattcttcgtagcaggtattaagaagaacgcatgacaaaattcatttaaaaagttctcgtctgtgcaatttcttctatagggatgctcagaaatatggtgttcctagatgtacctctttacaaagtgatgagcaacagaagattcactataaccagattcttagtggtagaaatcttcagcagactggaggttctgttccaggagcatttcctcctggggttgatcgtggtgcacgtgtgatgcctggtacccatggtatgggcatggtgtcaggactaaatcgaggtatgcctgctgcaactgtaggctttcctaggcatagttcccctggaaagccaaatgtggtttcacctggaaatgtattagccaacagtgggcaaggagcgccaaacgcagtaaatgtccatcctggagccatgtctgcccctggaaatccaaccttacggccacataatcctatgcaggcgcttcatgtgagttaaccttttatttattatctagttaaatcttggtgctcacacagagtcagacttgagttaactgcatgttttaacttttaagctcttctccattggttatcatctctcctataaagaaaagaatgggagatttttactggtgtctttgcttgtctttccagttgcaccctccaagcaatccatgcattatttgttattgcataagtgatgccagcatacttatgtcttatataaacaaattcatgagtactgctcccacttagttgctttctatattttttattgaaccaatgttgccagcaaacttatgtaaatgagaagttgcctttatcgaaggatatcagaggcttgtgtaggatgctatgcagcttctctagtgatttgctgctcgaattttttgctgtgtcacattttctttgttttctatggacggattttatatgcttagatgtcatttgccagttaactgattacgcaaatttcaatgttccttcaggacagttaactgattggacatccacatgtttgttccttgggaaattagaaaaatatgaaatttatttttatctgaccaatctaaatagttctgtgtaactgaagcttaaaaagtttgactcaacacattctaaagcttagttgctttagactcggagggattacatttacatctgttatttatgtgacttgaattttatgaaggttaaagtacctcactgaatttataaactgttaaaaactagggatagctaatttatatttcctttcctttagcctggtcaaaatatggaagagcataggcagattgtgatgccagagttctgcatgcaggtttcacagggaaatactcaagccatcagcagcatgaatcattcactctccaatgcggcatcttcttcacctgttcagtcttttcctattcagcaacatcaacagaaacatcaaatttcaccgccatcacacatgtttggaaatccgcagcatcctcagatccaagggatgagccattcgaatccacagcagcaaacatatgctatgcgcttggctaaagaaaggaacatccaacaacgtatggtgcctcagcaacagaatgatcttcctggagcaagtgcagtacccagtgtacagaatggttcgcatggtcagcagcagaagcaatcacctgcagccttgtcagccccatcttcacaaccacagcatcagcggcagcaagctgcacaaaatccaccagatagctgtgcacatcccaatcaaccaaccaatgctacacaacataagccaaagaagagtcaacagcagcctagacagaatcagcaacaaaggaatcaaggtagtcaacaggctaagcttatgaagagcttaggacgagggaacatgctgatacctcagactacagttgacaccactccaaccaatgctgtttctgcgtcttccaaaaagcaaattactgagaacaaactgattcaacatggccaaggaactttacccggaaataaagcatcaaatccgtcaatccctcatcctggaaatcaacataaactatacagttctccattgcctcaatcaccaaaacagttgccagatattggtaaccaaggcgtattgcagggttctcctagtcaggccctcttaacttcacaacagcttccactccatcctaaatcttcactgaccacacaacagcaacaacagcatgtccattcatcgcagaatagcatccaaagaatgatgatgcaccaaaacctccaaagtaattctgattgtaggccagactcacaggtcgttcaagtccaaaacaatcagatagttccaacaccacctattcctcagagtacagagaaaggcagcgctggactttcatccataagccagcagaagcacgaggtgtcgaatgattcaaatgcagttaattcaacatctatgatgcttagctctcctcaagatacatttgctgggggtgagagactattgccatcatctagccatgatgtgctggaaaggcagatgccaggtggtttgcctatgtatggtggccagtggcaccaggagcaatctaagcagcaactgcagtccccaaaccagcagagaccagttgttcaaggcagtgtatatgctccattaaatcctgggcctggctgatgataaattaatctgggttggtcacttttacagagcaacccttttttgaaatctaaagttattgtacaggtatgcacttttaacttccttactttttgacttggtaacggatactgtctttgaattttgttatgtcaatgcagagattaagtaaacttatggaaccatttgcttttccttctgattattctaggacatcaagttgctcgtattcatcatttcttgaagtagaggtagggtgatagaattgatattcgagtcgagcagtttaaatgatccatgtctaaaagcagatgggcttttgcagtaatttaaagcttgtgctactatattctttgtagggagtatttt

SEQ ID NO: 50838 - DNA, 2678 bp, Oryza sativa
tcgtgaaggaaggagaagattttgcaaagagataagaattgggcgtacacgtgggcggggcagatcgatcttagatacatacagattgaaaaagaaaaaaaagaaaagaagaaggagaggttgagggagggaaggaagctaggaaaaagggaaatactcctaaggaacgcggcggccgtttcccgaaccgtcgcgggcgttccctagttggactgggcggttccatcccagacgcaacgcgcagcggtcgtaggagtaggtgttttttttttgttttgcagttgccttctctcgaggccggggggctcggctatatatcctcctcctccccctcagttccgcacaaacacaaattaacctcctcctcttcttcttcttccgctctctagctttgctttgcttgcttcatcaaaccccacacacgcacacaacaacaacaagagtaatcaaagtagaagaagatggtttcggccttgttgcggacgatcctggtgacgggcggcgccggctacatcggcagccacaccgtcctccagcttctccaactcggcttccgcgttgtcgtcctcgacaacctcgacaacgcctccgagctcgccatcctccgcgtcagggaactcgccggacacaacgccaacaacctcgacttccgcaaggtcttccttccttccttccttccttacttaattctctctctctctctctctacattagattctgattttgcggttccttttattaatttaacaaaacaaaacaaccattcccatctcgataagcggcgcgcggcgatatatcataacttgtctttttgattagattgaaatgaaatcaattggattggattaatcatctcatctagtcaacatattactagttacttatatctgtattcgggcgacacaaatccaaatagtaactactcctcttcctccttagtaatggaaagttagagttcctacaaatatttttgtttgaattggagttgtagtcgttcgttttcatggggaggcggtcaattgaattgaattgaattgagttggtggagtagtagtggaaatgggaaaaaaaaacccaaggagggagggagggaggcgttggaaggcgccggacgcgttgttcccgcccccctgcttcatttctgttttgatttttcatggccaagcacacaacgcatgcaccacccaccccacatacgttccttctactttctttccacccatatataaaaagatcctttacaatccacatctcaatctcaaatataaataggattattaatactaataagctcattcccctggtgcattgcatactcataaaatttcttgcttaaaggactcaaaatctatcttagactaatataacatataaattattatgcaggttgacctccgcgacaagcaagcgttggaccaaatcttctcctctcaaaggttggttagtcttccttgctccttcaatttgcacttaagtacctacctttaatttgttttcatttttggttagcagcgtgacaccgtaaatttcagcataatatatatacaaactatagctattaaactatttcagcataatttcatcggtcggtcggtcggtcggtcgtttattccatgaatcaaatcaaatcgatcattgtcaaaataattactcctcatcatgtattacaagtattctggacctagctagctgctcagccagcctgccaggtcaagaatctggtgcttggccagtttaatttgcagccgtctatcacgcacggtagctgtcacgctcatagtaccaaccaacgaaccgaaccttccttgtggaattaatgcattactatatatcacaggtgacagtccatcccttttgtacccaaccgcgtagtatactggagtactaataagcaatactatgatgaatgaaatgaagagtagtagtaggtattattatctgttttggcgaagatttgagacggacggacgctggtctgcttggctgcaggtttgaggctgtcatccattttgccgggctgaaagctgttggcgagagcgtgcagaagcccctgctttactacgacaacaacctcatcggcaccatcactctcctgcaggtcatggccgcacatggctgcaccaaggtacagcccccgcaccatttcatttatttttctcccattgttttgctttgcctatatgtatatgcgtgcctcttgctggctttattggttggctggcctggctcttctttgcattgctgggggtcacaggatataccttatgcctttttgcattgctggggaacacaggaacatataccacagattacctacctatcacaaccactctgtgtctgtgtgtgttgtttgccatgcatgatgcacgggaatataaccctcccctcttaaaattgctgcctgcctggtcccactcccagccaagatttttttttttgttctcttcctactgccctctgatttttcttcttcctttcatcttgttttggttggttggttggttctgagcttactctggaggcggcatcgcaacagatttatacttacttaatccactaaaagtaaacatatatgctttagtttttaataatggacataatcataagctattttgctccggccagctggtgttctcatcatccgcaactgtctacgggtggcccaaggaggtgccctg

SEQ ID NO: 50839 - DNA, 13602 bp, Oryza sativa
gttggagctcacccaagcgggtacattggtgaggacccctgcggcatcccaaacaacctcatgcccttcgtccagcaggtcgctgttggcaggaggccggcccttaccgtctatggaaccgactacaacaccaaggatggaactggggtatgtatatgcattattcattcattctcaacaatcagtcgtatatgatttactaattaattttattccttgccggcaggttcgtgactatatccatgttgttgatctagcggatggtcatatcgccgcgttaaggaagctctatgaagattctgatagaataggtatatatgaaccctctcttgttgtgcatccatccacgggacgggacacatgaaaacatcatcatctcataaattaataatttatgtggctatattcttccaggatgtgaggtgtacaatctgggcactggaaaggggacatctgtgctggaaatggttgcagcattcgagaaagcttctggaaaggtaaactaacaggacaagtgtacttcctcttaattactataataatcattaattcccaacttgtcctttgcttttgttgatcatatgatgtcgtcctaacaataataatgccaacttgaacagaaaatcccgcttgtatttgctggacgaaggcctggagatgccgagatcgtttacgctcaaactgccaaagctgagaaggaactgaaatggaagtaagtatcaggatatatatatatatatagcatctcacatcatttcatctgtactgtaatgaaatgaaatattaaaatcatcatgtactctcttcacaccagggcaaaatacggggtagaggagatgtgcagggacctgtggaattgggcgagcaagaacccctacgggtatggatcgccggacagtagcaactgatccagctgaatataggcgtccaatcctccagtagcagcagcagcagcatgacttctatacatatatatatataatcataaagaatgaagaaacaaagaattcggacttgttgagttactactactactactactaatcccatctgatggaccgcattgtatagggggcttgtaggggtccagcagcttcatcatcagtctccttaggaggcctctaatataatctccatatttatggtagaaataaattttgcccaccgtggaagaactatataatagaatcatgatgatttgttgattcattgtcgcgtcgattcgtgcaaagacgtgtatgtatgtgcacgcccatcttcttcaagtcacattgcacaagttgaattgggccttaaaagtacctaaagttgatcttgggtgtttttccgtcaggacatacctttatgatttccgtatccatcccaacaagataaacgggccagccagaccatctccgaatcttcgatccgtttgtgtctctgcaggcccatgtaaaatacaaagcttgcgatataagttcactttaggtcactcctgttgacgttgaatctgaattccatccttgacctactacaccagaagatatagagtacccaaactatttttttctggtgccatgtcagctaaagcagcctataatactatcttaggactatatatgtaccggttttaaaaaatgagtgatgtactatatctagtatggtggttcaaggatgtgattcaaactgaacgtcaagataagagacctaaagtgaacttattccaaaccttacttacagggcttgctacagacacaataggcccagactttactacatttgcaacatacatgacaactagccacaaaactgtaaagtgataagtgaagcacaaacaaaaccacaaataccggtcatactcatatcacgatcttaccagataccttgtggtccgatcaccattagagatgataatgctatggaatacgttgtctatagagtagatatatatgatctgaatttaagaggaggggatccctattaagcgaaaatggagggtggtctagggactacttggaccaccccccttggaattgcctatgggtatggttagctattggctgagctaattagttgcacataaaacgaaatgggtaattgatgcatgattaattgaatgttaactataaataataaattcatttgattgtttcaataaatttttattatagatccaagtttttgcactctagtggtttaaagaaacgtgctcctaaaaatgaaaaggtagcccgaaccgaatagttatttggaactcagccttggctcatgtagataacctttcgaaccggctatgagacggagattatacccgcgtcaatctgaattattggccttgaggcaacttttgccattcatatcatcactaaagttaggagcataaatatgtacatcatctacttagttaatttgtgatttgggatgaatgatcttgtacaacttttacatcgtatctatacacgggaggttcgatcggtggcaacgaacgtgttgatcgataaagaagggcgccttgtgtgttgtgtgtaatcttctctctaaaaacaagctactaaaacagtaaaaagaaattgcactgtataaataaataaataaataaataaataaataaataaaattcaaactcaatattgtttttaacaaattaagaaacatatatatgcaaaagaaaaaaaactgaaatacgtatatatatgctactccagaaggaaattaaaagtaaatcgatctggcactagctagaaagaaatgaagaaatgacaggtagctagctagtgtgcaggaacgcgtgtgggtggaggaatggaatggaatgggttaggttagcggcacctctcccttccagttgcccggcgggtcgtaggagcaggtgatgaagacgccgccggcgacgcactcggagcggccgcagccgacgagcttggtgtcgttccagacgatctgggtgaagtggccgcacatctgccccgggttgcagctctgcccgcgccagtcgtagacggaggactcgccggcccagctcttgacggcgtccgtggcgcgccagccccacccggtcccccagaacacgttctccccgtacggcgactccggcgagtgcatcatcacgcagtcgaaccgcctcgccgccgaccaccgccgcgcgtacctggccagcttgttgctccacttcagcggctgcagcccgtactgggcgcgcaccttgttgtgagcatccaggaactcgtgcgccatgtacttgtacgtcccgcgcccgccggtgaacgactgccccggccccaccggcgccgccgcctccggaccctcctcctgatcatcgccgccctccccctcgccctcatcgtaattgttgttgttattgctatcatcatagtacggcttctgattctggttctggttctggtcctggttctgattctggttgccgatgccgatgccgccgccgatacccacgccgacgttgacgcgaaatgacgcagccggccggatcaacaagatgaggtacaccaccaccaccagcgccaccaccacgacgcctggacctgcagatgcggccatcatgtatgtactctcctctcctctcctctcctcagctcagcttcctaattacatacacatatatatatgcaatcagcagcaaccaattagctagctaggaatattatgtgttattagctagctagctagtatgcacagattatgcattccattcatcatcgatcttctagcttgtctacccagcctgcaaccttaatttggccggctatctgctattattaatctgcaaggacatcggaactccgatcgatcatatccatcgcttactcccatccacgcatgcatctttatttctcaccccacgcgcccgggaaatgagctccgtcgatcatcgtctaaactctatttcttaccattcaatttcctccaccattgagggctagctatagctactagctagcgagcggctgcagcggacgagacgatcgaacaagttaactagaagaatacggagtagagtaatacctacctagctagctgttgtactcattttcttttggggaactaacctaataattaattcaactgtgtgttgtgtagagtgtcaccaatcactttgatatggcaagttactaaccaagatggtaacaagataaaagctggttgcctctagtctagaccaagttagataatttgggaataaatagccaaaaaaaaggattttcgagacaaacatatacaaataactttgtgtgaaggtgtacgatttatagtgcaaattgataaacatggataaactaggacacaaactaggtgaaagataaagcggaacacatctatatacctatatataattagaaaaatacgtaaggattccgcacattttttttatccatcccttcctccctcgtgcacgtcgccctccctcccgacatccccccatctctttcatccctccctcccaccctcccactcgcctccgcttccacctccctccctctcggcaccccctctctccctcgctgcatgcgctccccctcctcccgtggcccctctcctccctagcacccctcctccccatcaccccgtcctcccagcgtccctcttctcccaatgatccctccctcctacgctttcaagaaaaaaacataacccccttgtccaggaacacgtttgacgcactcacctcgccatattcaccacaagagctcgccattactgtttctctctctgtccggaccacgtcgtcgttgggtgtgctcccgctgttctggttttcttcgttgccaactgccagcatccatggacgtgccacattgtgggacaagtccgaccaccttactcgtcgatgtttggtaaacgaagcaccgtcgctcatcttctcttttgtttcttgtttggctagggaagacgatgaatagtgttagtcattttttcttcatttttctttctttcaatgcgttcaaagaaaatggaatcccctcatctgagaatgcattttgacacactcatccgatcatgttcaccactagagctcgccgttgttgtttctctctgtcggaaccacgtcgttgtcggtcgcgtttctgttgttctggttttctttattgccaacctccatcatatatggatgagtcatattgtgcaagatgtcctaccaccttccttagcatcatttggtcgcccgagcaccaacgcctatcttccctactcttttgtttctcgcctttgggaagggaagacgatgacctattggccactatttcttcttggtctagctcaaccatgctcttggacgactcacgtaatattgagactatatgaatatgaataggaccggaaaaattctaatttatgtctatgaaacaagcacctgttttgttgttcagaattattggatcggattttcatctaagaactgaaataagttttttttttcaattctagctaatttaagttgtttttccatttaggatattagttttagcactatttaattcattaaaaaatattgtaacctatatttttcctttgtattaaattatttatagccaaatgaaaaaaatggagatttagttacattttttttgagttattgttccggtcaaacctatgtgtagtttgatgttattatttttatgattatatttcctttcgttatttataccaaattgtgatatagggtttataattttaatttatgttatttagaatccgttgtaacacatggacattatgatagtgattaaaatacgactcaaacggttgattatagggggtatccaattgaatcggtaaaagtccttataaaaaggttgctattacataaaccgtgtctttccacatcttattagctaggcttaagttgtgttttagagaaggcaaagaagaagattgagaaaatacgtgaaacaaggtgagtcattctcgtatgactaattgggtattaattatttaaactttaaaaagtagattgatatgatttttaaaacattttttctatatttttttttcagaaaatgcaccatttaaaggttcaaaatgggtgtgcgtgcaagacgatagattttttctcccctttatggttgtctcaaatccaacctatcagttattctctccatcctaaagtaaacttatttttcacctatcccacgtataccaatataaaatccaaagactagagtacttctgctttatcaaattccaatacaactattgtctactttatccactcccagtgtatttatcctttactttcacaaacttcgacacgatgattacttagaaatgaatttattttaggaaaattttcaaaaaaaattattttaggaaaaactggaagagccaaaaaaaattattctgagatggaaggagcagctagactagaaataccttaggcctaaggacaaaaatccgtttataatgtactccctggttgttgggttgcatcaccattatctgtccacattttactggccaagtggtcagctttgcatgctttctgttgcactacacagccaacgatgggtccgtccatcatctagccatagacgatagttgcatcacgcacatgatcgatagtactattcgtcctcatcttcattgtctcatctttcagtagtggactggtatactcgctctgagtgcatgtagtatatgtatctcatcgatcaaaacgacacgacgactgcatgtacatgtgcaagtctgccctagatctgcactattatggccctgcttgacctactttgggtttatatatagggttaattagttccacgccattataaattcttcagcttagaaatatgccactaaaatttatttatttgtagcgataccattacaattttatagcaaattggtatatgccactacttacctcttcattgcattcataaacatatttagaccattttgccctcctttttcatctccctgtcttctttcccctctctcatgtcctaatcaggggtgggcagaaaaagaccaaaccgaaaagactgagaccgagattgaaaagaccgagactaataaattcggtcataggcagtgaaagaccgaattttgttcggtcaattcggttagtctcctcggttaaccgaatagaccgaaaaaaccgaattatcaaaaaaatgtctaaatgcaacctacaatccactatgtttaatagaattaaactctaattttcacatccctacttcttataggcatacaacctaataagagtctttactcataagtgcttacgaattttttttgtgatttttgtgttgaaaatttccatagtttgtttgcatatatgaaaacgttgttgaatttcagtaatgaccgagaccgaatttatcggtcctaacatttttcgctaaaattcggtcttcacttttcaaataccgaaagaccgaagaccgagaccgaaattttcagttagactgaatgcccacctctagtcctaatgtccagtgaacctcggacctccaccggcctcaaacacttcctctaggcgtttctttaccctgtcgccgaggaagacgagcagacgcttgcccgccggagtaggccgccatgctggagctccttcgtgggccaccggagcagctgtgcctgagccgtcgtgcgtggatccgtcgaggccgtgtccgggcgtcgccctcatgccgtcgtgttttgtcctctgctcgtcctcatcgtcgtttgcttgttgtcctcacgctgaatcctctgctcgtcctcctcggcacgcgggcgagcgggcaaatgagcacttgaagggaggatagaggccggaggaggaggagctccggtggagacatgggcttcactggacatgagagagagaagatatgggaaggaagaaaggggaagaggaagaagatgagggcagaatggtccaaaatttttcgtgaatgcactaatctcaaattacatcaaaattataatggcatcgttacaaatagacgaattataatgatatatttttaaactagagaatttataatggcatggatctaattaaccctatatacaattatacatacgataatccatcgatcatcatgcgttaaaaaagagagaacatgtcctaatatgatcgtgtaaataattagcatctactcctagctagcgagttagctatctcgctcttgcatgtatatttatatatagtagtagtagtatttatatatcatggaagtgctcgtgtacaaattaaattaacgagctttttcgaagaaataagacaaataattccaaaaggagaacaaaacaagatagaagaaagaagaaggcgacttacacgccggagaaggagaattgctagctggcgaacagtcaacaggtcgcggtccaaaacgaacaaattaataagctgtaaagagatggagaccagctagctagcaatcagcttcccagccacggatattaatttatcgcaggtgtattagctttctacgcgatttaatgttatatattttgactatttaaatctattataaacaactacataactaatactttcagatacaaatataatgaaactatatatgcatggcaataagtgccactattgatagttcaattgttaatgaaaaattaaatgtcgattttcttaaaaacgaaggaactatatacataccatacatcctaagaaaaagacaaatagtaagacatgcccacaaattatcattcttaaatttctttccagagtaaatttcataaaatcctaccttttatcattcaaattacacaaaaccacagagattttgacatgtgacatataacaccaggtattatagccttaaagttttcacaaaaccaccttgttaaccaaaattgccatattcctatattaaatttttttaaaaaactttatttacatttatatgatggataaataactcacaaatttgataggtgattgtagaactgaaaagtatagacgctcaaagtcaaaacaattaatagtgttgtttttgtgaatgataaggacatcctccactattacccgctaacaaagacacaaaagtcgggcggcgactatgtgagcctttgaataatcccaccttgcttagcttgggaggaggaaaccaccttaaaagggagagccacctgtcaggattatggataccatatacctaatagtagttgactaaatctcggtaagacccaccacataccatgtcttatacgaaaactgacctcggatatggagggagttccggataaggaaagacaaccggagttctacatggaaacgacaaggattactcgaagataaggattactcggattgtattcatattggtttccctagttctactctgacaaggggacacctatgggtataaatataagatcccctaggaggagaggagagacgaaacaatagatcaacatacaagccaacatacgccaagacaagccgccggatatcaacatcggagataggcctagtagtccccatacggtacctaagatacgactaccgtcaggaggatctagtgttgtctctgatctcgtcgggcacggattcgaggaggaagactactctgttgtcgactacgggatggttttatggctgccaagtcgacaacagatagataggctaccccaaatattgtactggtgtgattatggtaaataagagcaacgaccggcttcggccaacaggagtagggctattacctgacaattcaggggcctgaacctgtataaaaatcatcgtccccatctcttttacctcaatctcgcatatatcctagtaccaacgatccccatactatgcaaataccatagtcgtgacatcaaacgtcgacaccacccttcccctcttggactagtcttttagggagattaggcctttccccgagtgggtgtgcctaagaactgttggggtccgggcaaccttaagttattgggcctcggttgaccccacctgggccagattgttatgatgaggacatcctccactattacccgctggcaaagacacaaaagtcgggcggcgaccgtgtgagcctctctgaataatcccaacttgcttagcttgggaggaggaagctaccttaaaaggggagagccactcttcccctattggaccagtctttttgggagattgggtctttccctaagtgggtgtgcctaagaatcctccactattacccgccggcaaagacgcaaaagtccaagtgggtgtgcctaagaatcctccactattattcgctggcaaagacgcaaaagtccgagtgggttgtgcctaagaatcctccactattacccgctggcaaagacgcaaaagtcgggcggcgaccgtgtgagccactgaataatcccgccttgcttagcttgggaggaggaagcccttcccctattggactagtcttttagggagattgggcctttccccgagtgggtgtgcctaacaatcctccactattacccactggcaaagacgcaaaagtcgagcggcgaccatgtgagcctctgaataatcccaccttgtttagcttgggagaaggaagccaccttaaaagggagagccacccttccctattggattagtcttttagggagattggacctttcctcaaatgggtgtgcctaagaactgtttgggtccaagcaacctcaaattattaggtctcagccgaccccacctagaccggattgttattagtgaatcataatacatagagttaggtgtcatgtgtcatagggttatgtgtcaagtgtcagaatttctatgtgttttgtgtcatgtgtcagaatttctatgtgtttttacaacttactctctctatcccataaaaaacaaacctaatacgtgatatgaaacatcctagtactacaaaatctggacatacttatatactaatatatcacatcccgtaataggtttatttttacgtagggttaggtgaaatttactcttgtttttgaaatagtagtaattaattatttgtgctttatagggggtgtgaatggtcaaactctaaattttacacacatttataagtataaatacaaaataatagaaagtctagcgtagtaattaagttaagtggaatgtggatggcagttttaatttctcgcagagccgggtttcatactttcatgtgaatgatgatcgagttgttttttgaggcagtaatccgctatttattgccgtgtgggagaagagaaaggagagatggacggacaaaagtcccgtttaccgtaggagaggaccgtaaaaccgacgttgatgcgagcaattcacgttggttttttcctgacgtggagaagagagatcgaagagaaaagtagtcctgcgtactactccagctccggacatcagtgacggaaaaacacgactcgtcaaatatgagtcatctccaataaaccaaaaatatcctgattaatatatggctactggatagaacccataaccgatcacagttgatatatgatgagacataaccatggctataacatgtcacgtgtgacatatagtattatgaaccatcatatatagatgagaccactcatctttgacgggtctttaactaccacacgtgacacatcacagataaagttatctctgacgggtgctagttatgatccgtcagtgatgagtgaaaatttaaattttaaattttgcaaaaaatctcgagttgggacatgctctataaaagttgtagctctcgacgagatatatacaactttataactaacaacatttccattataattttgagttttttcaaagagtggtgctcttgtgaaaatgatttgaaccattcgttattaaggttaaagtagtaatttactaatatgtgattagggctaactttttcatttagtttttctctggctaaattgatctatggtcattccatgtgttgacaccactcatattccataaaaaaaggaaaaagtttggtcaatgctaaatgacaattataactctctgcacctaattgttttaacaaaaatacccctccatgtttctaatattgctaaccatggtgatagtacaattagatctgaatcttcgatcaaataagatcaatgatttagattgtcttctactactaagtagagagcacggtaatgggactctttttcaaatgacctggatgaaaacatgctttatatcaaagatatagagctcaaccaaatttacaatattataattgacaatattttcatttacaatattataattgacaatattttcatttgagatagtttacatactcaaatatccattataaggtgagatctattttgaaaaaaaataattctttaaacaacatcggatgaagatattctttacgtaaaagctgaacatgttgagaactataaatgtttagttgataatattttcatttaaagtcatttagagtattaaatatatgttaaatgatttggacacaaatagaaaaaaaataataacactgattgagtagtcaacatgtgatgaggatgagatttggtaagggtgctctttgtggaggcggaggtcttgagtttgaaactcataatacgcatgcatgtctatattacacaaaaaaatgtggatatgtaggttgtgatgtgtgaccttgtataggatggctagtaaaatctaaaatatttttttttactttttgttgctttaaaattaagagattgtcattcttgctttgtcggtgatgagtcgtaagagatgagtcattagcaacaggcggaagttacgacgacacgccactaatgacttatctgtgacggatgataagttatgacctgttacagatgacttaaatacccgtcagagatgagttatctgcaacaaatgttcactcgtcaccagtgatattttgtctttgctggaactagatccaaaaacttgcaaggggttgttgtattcttgctttctcttctataatgaaattggtagagctcctgccctttccttaaaaaaaagattttgtcatcactaaccatttatctatgatggggtttggacctgccagtgatgacctaatctgatgtagtgacgttaattgttgtcgacagtaagaaaggaaaccgaggagttacggacgacgacttgtagctaagttttgataaacacacacacgccatgtatgctctaaattgtgtttgtgtcggtcacaacgtatatacatgtaccccattttgttccaagttccaacatcacgagttcatgacggattagtcacccttgttggtggatcaatataatctcgactgtacatgatatttcatacttttcttagaattaatcaattttagtctcatatgtctctaagagtattttggatatttttctctatctcttctctatctctactattataaaattgaagatgtttccactgtcggtcacttgtgtttgagtcggttttaattttatgttttggttttaatttatatatcttctctatctctactactataaaaattaaaaaaattttgctggtattttggtacgttatctgtgtatgagtcgatttttaagttcgtttgcttttgataatacagaaggaatcatataagaaatctgttaaaaaaacttgcatgctaaactgagacgatcagactcctaactgcagctcatgattatataaaaatatatgtgcg

SEQ ID NO: 50840 - DNA, 7377 bp, Oryza sativa
ctgtatatatatatgtatatgtatatgtatatatatatatatatatatatatatatatatatatatatatatatatatatatatatatatatatatatatatatatatatatgtatgtataacggcacgcgcacggcggtagccgtacgtctttgtcgtcgtccttcctccgatccatcccatggatccatggagtatgattatgttttagccggctccaccgcaggctaccatccaaacccccttcaattcatcaccctagcctaattaatttgcttacatatatatacaattgatcgactatatatgacacgaaataacaagtacagtactacgtcacttctgcttaattagatttattatactaggacatatctaaccttatcctaatttatagacacgacatagtatatccaacatagacgaaacttaggtggctgtttcagttctcccgctagcagatttgcagggagacgacggtgtggtggccacgtaataaagttgtttacatagtggtaagatgtgttctgggtaaaaacccggcctgatttataagccggcaacagtgacattctcaaacgccgccaccccgttgtgggcattgtcgtggctttctccttccatagtggattccttcaggtggaaacgtagtctcaatttaccgaggcgacggcggcatcctcagtgtcattttgaaggtctattttttgacaatcacttcttgagacggtttgtcctcttgcagtgccacttctgaccgttacaagatggccatagtgggtttgtgcaaagtaagaatggatccatctccttccttgccctctccctctctaatctaaagatgtggatggagatgagtacagttgggatgttgcgctcctgtgtattccttagcgggttgttttgctgtaggcgtgtagtaggtcttgtttttttttttgccaaatcatagtcttcaccggttatgacttgtattttttttatattaataggagaacccatactatcttatgcggtttgtttaaaaaatatagtatattgtgcatcagatgcaatgtcctctttggttgctaacaaacaattaagtgctgctgcttggacatatatatatatgatactagtacataatatgatgccggggccttcgatccagtaggctccgagaggaggggagaaacacctagccagctgtttggttttcataggatggaacaagattagaagaggacacgacaaactgcctgcctacatgcatattcgtgtgtggttaataattaatgcagggaaaattgtatatactatactgggtaggatgcatatgtatgttgtgtggtgccaaggacgaattagaggaagcaaagcatgcaactgtggatatgtgattattgatggtgtagatgcgcaacgatgaaaaggtaaaagacccccatgtgtacctcccagagacccagactgacgtacgtactgcctgtctgtcctacgatgcagtggaggcgcaggcacggttgattttgtgtccacggccgattattattaattaggattaatttgatacatgcaattacaattttacaaatatcaatataattcataaaatcttctacgtgtcactgaaatcttgtgaaattcaaatcatactatatattgcagtcttgtgtccaaacctctatctctgtttaaggacatgctatttcttcctccttggtcttcttcttcctatggaaagatattttgaagcctccctgctcctttcccttccctagctagctcaggtcgctcattctgccgtcgccgccaaggcctagctcggctgcccgttaatcatcaccgcctcggctttcccctacatatctagtactccacaaccctaggaaaggctcagtggcataggggcagtggacatcgtcaccaccgctgcctgctacttgtgtcggagctgggaaagaaacgccggaggaaagagagagaaaggatagaatatggaaagaccgtgcaattttgatggagttatgggcgacaatagcacggttaaattttacaaaatttcagtgacatgcaacaggtttcacgagtagtaatgatatatatttttttaaatacgctaaaattacattagtatatggatcaaacttaccattgttattatttagtggaaacacataacgggatactctaccttaagataagtgactttatagtcacttgcatgagttcactctgctattggtccgacgcattagcggctcttaagtcaggtaataacataaggtaaaggatctagatccgtaggagtggtacagcttgagcaatagtttctaagagtaattctcaaagagaagaggtaaagtagtagtttgaagcagatgaaagggagaggtaggtagggaaaattggcttgttgctagagtagcaaacggagtagtgtagtttgcatgtgggatgaatggaagcaatctgagtggagatcagggaagggaagggagggaatcacctgcaaagcggccaagggaagctccacaagaggaggaggaggagcacagaacaagacactctgccttaaggcaagtgattttataatcaacggcatgagttcactttgctgttagtggacacgttagtatgtactcccttcttcctaaattgatcatcatataagtttatgcaccaagaccgaggacaatttaaatcacatcaatcaagacaccatgcacacattctcccacaatgtatgcatcgattaaaaccccatgccgattacatcttagcatgcacacattctctcatactgcattaattgtattccgatgaaatccgtgtccatacagttatatgatgatcaatttgagaaattttggattctattacatgatgatgatcaatttaggaaggagagagtaataacgtaagtgaaggatccaggtccgtaggagcggtgtagtttgagtaatataatagttaataggagtaactctcataaagagaagaagtggtaaagtaatttgaggtatatgaaagagagtggtagctagggaaaattggcttgttgctggaatagcaaatggaggagtagtctgcatgtgggatgaaaagcaatccgggtggagagggaagggagggaggaaagaggaggaggagtagacctgtgaagtgcacaataaatatatataagatacgatatattttaatactataaatttagaaagttttctagcagtattagtagtagtaataataataataataataattggaaagaggaggagagaggggaggggaggctggcatcagctgtggtgtggaggtagagtggtgagtggcactgtagaatgcgtgggcccatggaccgcgacagggggggcccacacgccacacatatactgcaaccagcttttggcgtcttgtactccactgtctccgttcattgtcacgcgctccttcgattcctcttttctcctcctcctgaaatgaaagacaagaagagctggttgttttcgttttggctataaataaatctgttgcataagccctctccctgcttccgccttgttcaataatcaatatactcttctcctcgatctcttctcttgtccatctccaataattctccatgtacgccgccatgtacccggagaccttcggcttctctgcttacccccagcagcagcagccgccgcccgacgccgcctcctgcatctacaccaccgccttgccgctcatcgccgacccgcctgacatcctcgtgagctgcctcctcctcctccttccttgcacactagctaatccgcatgcatgtatccatggaatggattttcctctaatcgctctttctcttacccatggttcatgcatctgctctctctctctctctctttctctcatcacatcacacgtatgaagatatgaaatgaatgaagaaaaacagtcgctttctcttgttcctatttctttctgttttttcttgctccgttatgattaagatggcttgttggtccatgtactatctatgccaacaaaagccctcaataattcaccccttcactttcctcttttaagcaaagcaaccacaacatgtatgtacctcagacatttcatgagtgagatgactaatcgaatcgatccatccatcatccttaattgctgctgttgctttcctaatttctcttcaaacgcaaacgcttagctagcttcctaaacagagcaactaaaaattcactcactcacctttgagatttcttttcttcttccaccactactctactacatacatggcgtggcgaatgaatgaatgaattaattaaaattcatactctcacctttccttttcgcactcagctaataagcagctaagccaccgcgcgagtggtgcaagcaactggtcatgttggctgcaacttttcctttcctttttgtctttttcattcacatctttcttcctttttcatacttttttttctacttttctgcgcgcgcgcgcgcacacacatatattggtacatacatgcatcgcgcatgggttcagtctttgagatatttagtttagtggcagggaggggggatctaattaggttgagtcttaatagagcttttttggccaggatttctgatgcccctcctgtccatcagtatatgctctcggagcatgacagggacctgtaagttgacatgtactgcaccatcaacatactacatgcttgtagtcgtagatgtacccaaaaaaaaacaaaaaaacaagagagaggcatagcactacttgcaaatgcatccatatatactcacttttaattacttgccagccacactccacacacacactttgttattgcctcgcgcactgcttcctctcttctgcaatcttcccctcccctccccattgagagaggctacacttttctctactcaaattccctaggagtactttttttttctcgtcactctccttgccttaatttggagggaaaagaatatctacttactgctgtcgactcatgtagacaaaacaaaacaaagcacagtcattaatctgaccttaatatcttttggccttctctactttttttcccatagtaaaaataaattatgttttcactcctgaaacaaaaagtaaaatctactgaccagaaaatagaatgcttgttagtaacatgtttgcaattaagaacgttacatttcagtacttcattcattttaaaatgaattaactaagtggactgaaataacctctttgtcatctgtcgatcctacagggaaacatggcacaaccatcctttctatcagagtatgaccttggaggggaaggggacctgttcaaagctcctgaacccatcattgaagaaccagtgcttagccttgatccagttgcagcagccatttcgatgatgtctggcagtgagaacgtaatggatgaaactatagaggttgcagatatcagcgacattcagaatgactctcttttaagcgaagtattatacgagtgcgagaaggaactcatggagaagtccgcaatcgaagagactatttctgaactgctggacgtcaagattcctatgctgcaagtggaagagttccctagggaaacccaagtacaactaccggccatggagaaggagaagccatcagttcctgaatgttgttcactccagaaaagtgtcagttctgggtgcctcaactcagctgattggatcaatggaccagccaggccaaacttcctggacttccaaggattggactttgagacagcgtttgggttgaggagggcatacagcgaaggagacattcaggtttgatcatttttctcttgcggttatgttatgtacttactactgtatataggtaaggtagtgatagataaggaatcgttgtgagcaagcaacggctgtgtattgtaaagtgtgtttccgaaacacaggtgtcgagaaaagaaatcacctttgcccttgtatgtatatgtgcgtggtgcttctttactcaaattaaaggccatcaaagctatgacactgattttactatttctgcccaaagtaggccttttccttgtggttttaattttctttcaagatacttttacatgcaagctcctgcatacaaagttggtttctaagagactacctaggtgccaaagcgtacgtgtatatcctatggttttttgtttttatatactgtattattttagaaaggccgtgagattgttcgagtaaacatttgcagaccctgctaggttgttgaagaattgtacttacgatgctagttgtctttccaacagaatcttggagctagcacccctcgacccgggaactcaggaaacgctcaattagcatcttgcgagaggcttgtaaccatcagtgacctgaaatctgaagaaaggaagcagaagctatctaggtacagaaagaagaaggtgaagagaaactttggcagaaagatcaaggtaaaactatatattgtcctcttcctttttaatttttcaaagaaaagaaaaaagagaacataaggacagagaaggtactactacatgattaattagagaagctgattgaggctgatgaataatagtacaaacaaggagactgactgactgactgacactgactgatgcatcgtttggcatggttgcagtatgcttgcaggaaggctcttgcagacagccagccaagagtgcgagggaggtttgccaagatcgaagaaggcgacttgctcaagccaaggaagtagtaagaggaagaaacaaattaaagtaactcctggagaggacgagctgccagtgaaggaaggaaccttggcttctagaagcttctagctggtggaggaggaggaggaggaggaggaggagaggaaaggatccaaggtgcaaggcccagcctttgtgtgtagggggagggcgaggccaaggtggaagagaggcgccgtagtcgcggctgcacttgtcggaattaattttagctgctttggatcgtctccttctactactagactagtacttgtaattctattttccttccaatgcatgtgtaataataattagtaataatgctagtagtcggtattacttgctgcgagctgaaggccgcccatccatgtacaaatggctcgatgaagaaacttatcactagtagtaataaacttcagctcccttcaggcttcgcactggcactggaaggcatccattatctctctcatctcgtgtgtacatcttcttcttcttctcttgtcacgacgactctcgtacaagttaaaatgccgtactcaatcaacgcctatgcaatctttaaactagtaatacctccatctgtacaagaaatggagcttccaaatgctgcactatatatcttattattatgattaacaactcctttcctttcagttcgagaatgctccaaatta

SEQ ID NO: 50841 - DNA, 5847 bp, Oryza sativa
atcatttggttatttagctgttcactgttcaaggggaaaaaagccactcaagccattgttgttgtttttcccccattgcttgcattttattccttgtgcttgggttgggtggcagccattgttgtgttgtgttggcttccctttcccctccctcccactcccagtctgtctctctgtctggctgtgctgtgtactcctactatagcgagacagagagagaatctaaatccaatctcaaggacatggccaagcccaagcagccgcctcctcatgctcctcctccgccgccgcccccgcctccggtggagggcaagcccaagcctcctcctcatgcgccgccgccgccgcctccggaggccaagaagagcttcatgcgccgcatgttccccttcctcctcgccgccaacgtcttcgtcggaggtcagctcacccctttccttctctacttagcttacccgatgccgcgtccttgtcatctaccttacctctaccgctgcgctgctactcctccttgcgggatcacctccgtacccagggctgactactgttggtcgcaccagcagttggggctatatcagtattcatctcttaggcgggttggttgttgcattcactctcggctttactcacatgtctcatcactgaaagatccatccgcttcagtaaacttatattaatataagctcatcaactacacataatcttttactcacattgggggcaacttctgtctctgccttgtttgggctagactagtgcattgttgtcttagcatctgcagtgccatttactactactgtatttacgtttattctagttgttcttgtttcttctcaagtgttatgcatgtaatggtaaaccagagctgccaatcatatttgtgcattttttgtctcctcagtatatttgagcatatctattaacaggatattaatgtagtactgaagaaatatagtacatgcataaattgagcgcatatatgtatatatattctttaagttctgaaagagatccacttctgtagctcttatgtgctgttattctgcacttctgcttttcttactcaaatgctattatagttcagttattaacatccttataacaatatgcagcttatatgcttatgaggacctaccaaaaggactcgggaaagaaagataccgagaatgatcctacttcttctacgccgacctcatctcccgcggctgctgagaagcctgcagaaccaattgttgcacccataaaggtgctcacaccaatctcccaagacgatcagcgccagctgtacaaatggatgctggaggagaagcgcaagatcaagccacgcgatgctgcggagaagaagaagattaacggggagaaggcccttctcaaagagttcatacgagcaggatcccttccaagcctataagatcgccaattaactattatttggatctgtagtgctcttgtgtttgatgattgactgggaacggtgcgagtttgattgtatttacaagtccagcactgtaatcagatttccaaatgatagttgtggaaagaccctgttgagcttgatctcctgaattgaattggcttctttcataggacatgttgggtatcaagaagccgatttctgggaggcatggaagatgatgtatgaaactattatcagtgttgatttgggcttttcagctattggtgctgtgtaagttcatcagcatatattgatgtttgtggtctcttacagccttgagcctgcttgtcacattacaaatatacttatgtatagttgccagctcaactgctctgttgacctgaaatgctgccatcatcaatctatcaattactatttcgcatactattatacaaaaggttgaaaagaagccctcacatttgctccgagggcttagaaatacccatgtaaattggagtaaacgatgaatacatgttataatagtgtagattgatcgatataattgtatatgaagtatatactagaagttaagggaatgtttgaggggagaggaaatgagaagatatgcaaaaggtgagtcgttagtaaatgattaattaaatattaattgttttgaactcttggatgaatacaattttttaaagcaacttgcttgtagaagattcttctttttttttttaaaaaaaagcacagtgtttagcagcctgaaaagtatgcgtgcaaaagaaaatcaaaacaactttttatataagattattgtaaaaacacattgtttagcacttagaaaaacatgcgcgaaaaagacgagggggacaccctaagagttgtatatgatcaaattcaacatctattgtatataaaatatatctatgtattttaggagaaacatatttatgtttatagggatagaaactagtctatcactctaatccaatacaaaatacagttgtacgcgtagaaatataaagcagattagctaggagttgtagtaatatagtagcaagtctaaatcaacattttttttttgaaaaaaaataaaagggaaaccagctactccagtttgtttgacatcagattcatagaaaaggtgggcttactgggttcggcccattaaccaacccacggacgcttccacctaggagtagtagtttgggtttgggttcctctctcgtctcgtctgttttgttttcccctccgactccgactccgatcgatctccaccccgaatccctcctcctcaccgccggcgagcttccggctgcggcggagatggccacacgttattggatcgtgtctcttcccgtgcagactcctggctccaccgccaattctctctgggcgcgcctccaggactccatctcgcgccactccttcgacacgccgctctaccgggtaagcatcctccccgccttccttccttccttccttccttccgccaccaccatcctcaccctcctcctccgcctcccgcccgcagttcaacgtccccgatctccgcgtcggcacgctcgactccctcctcgccctcagcgacgatctcgtcaaggtaacccatctcttctcttctccccgatctcgatctcccttgccccccagctctcacgcgattcctattattcctgccgctgctgcagtccaacgtcttcatcgagggggtctcgcacaagatccggaggcagatcgaggagctagagcgcgccgggggtgtcgagagtggggctctcaccgttgacggcgtccccgtcgacacctacctcaccaggtcgctcgctcgctcctgcccctgctgcctctcagcttagcgattccaactcttttgctaaagctctctacctcttccttcctttgcttcttcttcttttctaggtttgtgtgggatgagggcaaatacccaacgatgtcaccgctcaaggagattgtcggcagcatccaatcacaggtctccaagattgaagatgacatgaaggtgatgacctttttcccttgcgaccacataatcactagtcaagacccaacctacatatagtgctgttaatatgtttcgaccctaatgctgtctctagtcattaattaacgacacttggtgtattcttattcttcttgtacataagacataaagttttgccgttcagcgggaattgtttgcttgctttgcaacaagtaggcaagttttgacattatctccataacgtgcaaagttcaagctagtgagctttgttctcctgccaagtgtgtttttacagggtctagcttggtttctgttttggtatgttctgttgttctagccagctatcaacacaaccatattcttgtgattaggcatccacgtctccttttttagcattgagttatcacgcacaacactacagcgtgacctgttgaatttacaacagctgagctgaatgtgttttttaccttcaggttcgaggagcggaatacaataatgtaaggagccagcttagtgcgatcaacagaaagcaaactggaaggtagattgcatgccactgagtttttggctttaagccaattctttcttgttttatttcaaaggactcagaaatgcgagggtatggtttcatcttttgttagtcaactctaattagtttgttttccttctgtatagcttagcagttcgtgatctttccaatctggtaaaaccagaggatatggtcacatcagaacatctagtgacactccttgcagttgttcctaagtactctcaaaaggattggttgtcaagctatgagtcccttgacacatttgtggtaagtatatgctcttttatagtgacatggttagtaatagactgtcatttcaactatttatatgattttcgtcctttcagcaagttgcttattttacttttgtagtttttgttcaatccaacaatgtttagtttgttaccacttgtggcgttaatagttctactagcaggagatgttacccctgtagaaaccacttaaagtaaagatctgtttgacctgtaaattctttactcagattgttttatttagcccttataaggaccttgtttttttttccagcactacatgttgatgtgattagtattcgtaattggttgttatatttgagtgcttttttccttgaactaattattgatttataggtaccgagatcgtctaaaaaactttatgaggacaatgagtatgctctctacacggtaacattgtttgctaaggttgttgacaactttaaggtccgtgcacgtgaaaaaggtttccaggtaaatttgccgtcctaactttttcatcaaaaacctttgtttacacttcacatttagcttttatccctagagccttaggagttccaaataacttgggacagaaattcagtcttgtttttctgtccccatcaatctggcaattctctgtcacccattaacttgtattacgttgaaatacaggttcgcgattttgagtatagttctgaagcacaggaaagtaggaaggaagagctggaaaagctaatgcaagaccaggaagcaatgagggcatcacttctgcaatggtgctatgccagctacagtgaggtgcatgtctttttaggcttatttaataatcctgtcaacaatgacatttctttagagaagaacttttttattcttatgaatgtcatttttgtttcatgtaagttctattaaaattactaccaattaatgtttgatgttcatttcatcattttgcaccagaatagagataaatatgttttcatctcctttagtagcctgacggtcttaattgtccttaaaagcatccaattatgcggaatctgaaccagtaagaagatattgtctggtctcagttgccacttgccagcaatagatagatgccacgctgtgttttatgtttaaattttacataaggattttagtaagttataacttcatggcatactgcaagttcttcctactgctgttattatctcactagaaccttattattcagggataaatccttgtttctgggatgtattaataagcttgtgtttattatccataattgtctattttaatttgtgcagaataccatttatgtacgtcatgctaaagtgcaaaactttgtgcttctctatgtgcgtaaaagaaaataattctgctgttgtttatctctgcttatgcagtgaattgccgtcatgaaggatttgtttactgaactgagttagttagagcctagctctataggctatagacatacttattacatattcactatgtcccaaaaaaaaaaaccaacctagtcaaggatgggatacaacctagtcatgtccagattcgttgtactaggttgtctcatcatgtcctagtcattgacggagggagtagcacatatgtttcttgattgttgggttttgtggtttgccttttctttgat

SEQ ID NO: 50842 - DNA, 2318 bp, Oryza sativa
tctagcaccttctcaaaagggtgaaaagaaagtaaggagcatcctggaggaactctgtggcaatgtccataggtaattcagcgtttgagtttgtgttcattgcattgttagtcacaacatgcacctgcttttgtcattaattgagcctctgaattgcagtatttactggaaatctgaagacgatgttggtgtagctggtctgggaggtgaaaccgaggctcacccctatgtttccttcacaataaattttatctgagcacagtatgttccttgctacctgtggccaggcaaggcagtgttttggagtaattactactttggcaaacaaaaaaccagcgaatggttcggtgtatattataattgtgatacgtcaattctttcttgatttatttacccagcttatatgatcctgtagtttgaaccgatcaataatgtagctttttgggggaacctggactattttcctggcacaatagggtatctgtttggactattttatcccggcaactacaatattccaactgtttcctttagtatatctattgtgctttgagagcaccgtgtaagatgttgtggatattatgtttttgtaactttgagcagccaggttcgtaataaaagatcaatataaataattcaggtcgccgagcctgattgtaaacagtttgttgttgaattcgagctgtctccttttttctttgacgattacgactgttgcactcatatataaatagaaaggtggttgtgttttcacattcagtagggtggtgcaccgtaccccgtacatgataatactgatggtgttgtgacagaaggacaagttgggggttatgtatagaacgtcaatccttggtgacccagttcccactgatgatagtggagtagacaagacacaagaggagatgatggtcaaggtgagaggtgagggtgggtgaaattggatcagcatcaaagtctcatgatgttatcattaacatatgtgagtctgatgaattattgattcactgaagaggatcccaatggaggtgatcgcctcattttgatttgagtaggaccgcgttatgagagcggggtgaggtcggcaaggagaaggatggatcagaatagtcatagatggaaaaaaaaatgcaaggagtaattaagattaataggagtaatgtggatgaagaagaaacagctaggctaggcacataagaagatgattaatgggcaaaatcaatccaatccccctcatcgcgtcgcgtgagaagagaggaggaaatggcatcctcgagattgcattttgtcgtcgatgatccggtccattccggcgccggcgttcacattacacacccaaccaatatcctcaccagtactactattccattctgctactagtatactccttcagtagtgcagtatttttcttgtataaataatactctaggagtgtactaatactcctagagtagtcttgtttcacctacccccgttccgttccttgtatgaatccattgccttgcttctgcttgcccatttgatgatttgatttgatttgattcaatctccaaatcgatcgatttctcctcctccataggagaaggagatacacgtgatgtccaaccggcgtcgcaagcgcggcgaatccaagccccaagcccacgacgccggcgacaccacgcccatcgacaacatactcacctccctcgacgacgccccgccaccgccacctccaccgcgccacgagctccccctcctccagctcaacgaccaccaagaggcagatgacgctgacgcctcgtcgtcgtcgtcgccgcaccagcagcggcggctgtgggtgaaggaccggtcgcgcgcgtggtgggagctgtgcagcagcgccgactacccggaggccgacttccgccgcgccttccgcatgtcccgccccaccttccacttcctctgcgacgcgctcgccgccgccgtcgccaaggaggacaccgccctccgcgccgccatccccgtccgccagcgcgtcgccgtctgcgtctggcgcctcgccacgggggagccactccgcgtcgtctccaagcgcttcggcctcggcatctccacctgccacaagctcatcctcgaggtctgcgccgccatccgcaacctcctcatgccgcgcttcctccactggcccgaccaccccacctccaccgcctacaagacgcgcttcgaggccacctcgggtgtcccgggggtggtgggctccatgtacaccacgcacattcccatcatcgcccccaaggtctccgtcgccgcctacttgaaccgccgccacacggagcgcaaccacaagacctcctact

SEQ ID NO: 50843 - DNA, 10434 bp, Oryza sativa
agctacccgctgacggagtggatgctggtcccctacgcgcagcgcaacctgacgtggacgcagcacgccttcaacgagaaggtgggcgaggtccggcgcgtggccacggaggcgttcgtccgcctcaaggggcggtgggcgtgcctgcagaagcgcacggaggtgaagctgcaggacctccccgcggtgctcgccgcctgctgcgtcctccacaacatctgcgagaccaggggggaggacatggaccccgacctccgctgcgacctcccccccgacgaggaggaggacgacaccgtgcttgtgcagtcggagtccgccaacaaggtgagggacgacatcgcgcacaacctcctccaccgcggattggccggcaccgccttcttctgatcatttcgatttccgtcccaatctgcactacaaacactgtattgaggtttccctcctcccctcctgtttgttcttgttattgctatagattagtttaggtgctccactcaacaacaacaataacacaagattgaaatgtgatgctttgccctcctcgttaataaatcactggaatacatcgcttcgtttcaaaatttgctttgctttttggactattctttatcctggtactggtaaattacacatacaagctgaatatttactcctataagtaagcacgacctacagtatttgggtaggatactagaattctgcgctttgttctattgtctgacctgaaaattttacccctcgtacaaatctcctctacatgtcaacttatcagccacatccagaattcaaactttgaatttagtggcttttattttcagcattagctttgctttaaatgaataagaataaaagttctaacgacaaattgtttttttaatttgtttcgtttatttttctatagcttatccttcattgcacgaacgattagtgtggccttgaaactttaattgtaggggatgacattgaatccaatcctaggttgagagatgccactgtaggaccatgaggcttgccgaaatttttgttctggatcttttgatatgcttgttggccaaatgtgcattgctcccccaacggtgtgctgtcaatgctaaagtagcaaaacatatacagtagcattacaacagtatacgtgctgagctttagttcctctggtgaccaaccactctgggaatactattgcttaataaatcattctgtagtctgtacctttggttagtgtttttgttacagtggggttgtgtgtcttgacttttgacatttcaaaggaaacatgttacttcttctgtcccataatataaaggattttgacattttgcttacactgtttgactattcgtctcattcaaaactttttttgaaattattattattatttttactttattatccaaattactttagtcacagcttttcgttttttatatttgcacaatttttttgaataaggccatgtttagttgttttggcaaaaaaaaaattttgacgtatacgaaaacacatttaaagtattaaatgtagactaataaaaaaattacagattccgcctgtaaactgtgagacgaatctattaagtcttattaatccgtcattagcaaatatttactgtagcatcatattatcaaatcatagcgtaattaggcttaaaagatttgtctcacattttacatgcgaactgtgcatttagtttttttcgtccacatttaatgctatatgcatgtgtccaaatatttgatgtgacgaaaaagttaaaagtttgaagggagctaaacacagtataagacgagtggtcaaacaatccaagcaaaatgtcaacgtcccagtattatggtacagagggaatagaactagacgatactactagaaactagactagtgaaaaagaaaatggaagtctgtgacatgaatggcaccagtggtctagtggtagaatagtaccctgccacggtacagacccgggttcgattcccggctggtgcattttttcttttctctctcactctctctctctctctctctctctctttttttgccttccttccatctatgtgctgatgttaaatacgttttttttcccggttttacttcagcatgaagcaccaacaaaatggccattacaggtttgcagggactttactgttagcgcaaaatgccgttgttgacttgttgtaaagagcggcttgtcagatgtttttcatttttcacaccgtgctgtaacttggaagcatgacgcggacggactgattattgttacgctgaccaattctagctctagctccgtcagggtcatcaaatgagtggttgctccatccgagaattctgcagcctcatcggttggcatatttcaaatagcatatttataagagataatccaagaaatgtgagttctaagaaatatcatcgacaagtgtaaattctaagaaatatcatcatacaaacgattttgtcctaaaaataccatcgtcattagggttctatccattttgcgccgttaaatacactgttcatcctatagaattttaatatcgtggaatgaatggaaccctaacggcgatggcatttttgggacaaagtcatttgtaagatggcatttcttggaacttatacttgtcgatggtatttctgggatttggatgcttgtcaatagcattttttgaattatctctatttataaataaacattaatttgtgaataaaacttctatacacatgttcttagcgatccaaaagtaaatgctgaaaaataaacttctatgaaaaaaaatcccataatcaagttgaaaattttaatggctgaaaccgcaatgatacaatccgtatattgttatctgagtgagccatcctaaccgtcaacgtgaaactacctctgcctcacactgtcgcacacacaaaaccttagcccacatttaacctgtttcaatcagttttatttaagaaacatgatggttcactggcacttaaagggccaaggcctcatatgttggtccagacccccacattgtcattctcacacaaaaaaaaatatgcttgtgatagtattttatttaaaaatttatccattgtaaacgtgtgtttggattggctttggtgaatgaaatggtatttggtcctcacctcatccccaaaagcatatactaccaaataggagggggaaaaaaggtaaaaatgcagtttctaaacacaccccaaataaaaaggaataatatgaattgacttctcaaaccgagctagaaattaaccgagctggtgtgtttagttcacgctaaaattgaaagtttggttgaaattgaaacgatgtgacggaaaaattggaagattgtgtgtagagaagttttgatgtgataaaaaagttagaattttaaagaaaaaatttagaataaattcggtagaggtgaaaccgagagaaccgagtagttgtacttacacatgagatgagatgagatgagatgagatgggatgggagtgcagtgtacagtaaaatatgtttggtgatgagggggtagagtggtggcagcacaccactggctgagcgcgtcgccacgtgtccacgccatttccaaggcaggcccccatcaacggcccagacgtcagcacgtggtgatgtcaacacccctacccactgtgtcactgacaggccggggcccatcctcctcttcgtcctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacatctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttccctttgcttttgtttttgcctcatcacagtcacagcacattaaacgaatccaacacaccgatgataaccttttctccatgctctcatctgttgcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaagtaagccatggactcccattgattccatgtatgagtaattgactcgagtcctgaggataattggatacgaattgccttgttcttcttcgtgcttcagccaaatagggaagacgagtacgcgaggattgaggcgctgggtggcaaggttatccaatggaatggttatcgagttctcggtgttcttgccatgtcgcgatcaatcggtatgcattctcacccttttgacataattgaaccagtgtttgtttgtgcttcattgtttatgcttctccaactttactgatgtgactgtgctgatgatagctgattgggtaattgatgtgtcaaaggaaaagtctcttgactggttcattttgttattttgttctgaattgtgatgatatatggtgctctagggtttgtgacttttctaagtgaaaaatcactggctgattgttgctccctggtgtaatgacattgtacccccaagtttatttacaaataccttgcatcaatgcgattgtttgcaactggtagtgagtttgtacctatggtggcagagagagctcctcggctaattactttgttagtttgttcctagtcatactgttaagtgatttgcgatgctatgattcaggcatatatttctatatttgttagctatgttgccatatgcgatactggtataggcgtttggtgagtatacatgcagttcacaataggaaaatataagagaatatgagagacttagacattgagatcaccttgatggaaaaatattaagagtaatactaaatggcagaatacttcaaagtagtgatttctgtcataccaaacactaggatgagtcactaactacacgacagctgtataagccattgtttgcattcattgtgatcaaggaacagctgtactatatcgaggattgtaaggactgatgtaataatgtgccattgtgcatcaattgagctttggatgttagcttcacaccttcacccatgttgctgcacagcagtcaatcatatttgttaatttactgttgcagtcagatgaggtttcttcccattgaatcttaagggagaaagcctggcccaatatatatcacaagacttgaataactctttcatcagcatttactctgattcgcttttgctgtattgatgcttcaaactagagagagaatcataacatcatgctattcttctgttgtaccccggtttattagttccagtgttcatgtatcctgtcagtttttgttgctcttaacatgttattctgtgactggtaatttgatttcaatgtctttaatatatggcttttgttgatacttcaaagttcaaagtagataaattatgtttgatttattggtgcgcttgccaatacttctggtctgtgcattgatgtatttgcaggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgattcagggtcgaggacataaggtggatctgggaattttggggtctctcaagacaagacagaaaacataacaaaatctgtagatgtaggtaggagtcctaggacagattgggtttctgcctctggcattaatcgtttttgttaaccggtaaagatactgctacttgcaattgctgtttcatatatactcctatatctttcttgtgccttcccttgtgatcaatacctggtgtttctcccttgttcaagacggtcaatgtacttgccgattttggagtacttgaaatacagagaaaataatgtctgaacctgaacttgtacactggtgagctgaagagaaaccggactctagttaactttagtttgcagaagtgtaggagaccaagaccagtgacgaaactaggatctgagtattaggggagtcaacttatcaaatgattatgataaaaaaatagtagtataaaaatatacgaaaatttaaaggtttttcatagataatatatcatatcaatgtaaagaaaatgataatacttaataggtatatgatacagctacaatgtatatatttatttatttcaatcatgagctgcaattaggagtccaatcacctcaagttagcatgtaagtttttagagagatatcttatacgattgctcatgcatttccaaaaaacgaacttaaaacctgactcaaatacatatctgtatttccaaaaacgaacaaacttaaaaaccgactcatacacggatacacggatgacgtaccaaagtaccggaaaaaacatcttcaatttttataatagtagatattttaaagagtaaattgcagtttgggtcatgtatttttacccttgttgcagcttggacaaggtcttagccatgatttccactttgcaccacataaccttgccatttgtttcactctgcaccacccctcatcttctccgagtcaggcagccttattatctctctcccaacctgttcttgttatgctatcaccgatcaggaggaggtagaagtacgacagttttccaaactccaatcaccctatccaatctggagggaagagtagcaaatcatcacaggttcagcaccggtacaggtgctcaagctgagatgaagtgcatggtgataatgctgaagtcattgctggtgcctgagctcgagcgtgggagcagtactacaacacttcgtcagggactagaataggcaagtaattggggtcgagtatgcaggttgctttcaccagagagctcaatcccaaccacacatggggaagatgaagactttagtatgctaatgactaaattaaagggtgaatagccaaagtggtccttcaagttttatctgaggctcaatttagtccttgatgtttcaatctatccttattagtccttcaagtttttattttagttcaaacttatccttgaaccaacaactctcttgataaatgacacttatatccccatcattcacatatataaaacaaaaattacatgcttgattttatttatagataatgcatagtaaattatgtaaaacgaaaataaattatgtactatacgatagcaattgcttaagtttcatgtgcacatgttgaaataatgggaagtacatctgcaatgttgtttattcatcttggtttcctcttttctagtatatagtatacaaattaagggcaaaagggatattttctaatagaaatattgactagaaatagccatatggcatattaagtgggcccaaggatgatttcaagccaaaataaatatttagaggagctatgtggacaaaatgaaacgtgaaggaccaaattgagccttcggtaaaacttgagggactaaattagctattcaccctaaattaaactaatcgtatcaccttacctaacatgctagttttagtatcaataaagggaggacatggtagtgctcaagctcacgtacagtggcttcagctcaatgaagaagagaagagaggggagatggaggaaacaccggcccaatctgaaacttgtgtaaaattatttagtccaaagtgaaaatattactttgtccctagtccaatgtgtaactatggtaataaaaggtagtccaatgtgcaattcactctattttaaattatgatacagaaagatatatggttattagatatttttattttagataatacttttgccggtcaaaatttattaagaaagaaggcatcagtttataaagccacaccaacaaagctgttgctattgttgtgtgcgtgtttttttttgggggggggggatgggggaggcctcccctatccatagtccatgctagtttgctagagctctaaatttgatacaatgtcagaattttagaggtgggaaatatatctttatcctttgtatgtattttgtatagcaaatccacccatcctgttcttaaaacaatcaaaatcaagtagttcttgatttggctccaactctatggataaagatctagagcaagtaagctgtagacaagtcatgattatctaacctgatgcaagtgagattggttatggttgggcctgttcggctgtctatttgcggtggttgcagctgcggctgcgccgtgtgtgtgcggcactgttagtgccggctgcgccacaaccacagcacaggcagccaaacaggtccattattgcgtgatacgaactctaaagtctctaatacactcaaacaaagctttttttaaaaaaaagtgagttaaaaattgatgggtgaagtttatattagtatgattcatattgaaaaaaaaaattataaaaacgaagaggaagcggaggcgtagtaagaaacgtaggggtgaaaacggagcggatattatccgatccgatccgctctgaatctgtccgatgtgaggatatggtaaggatttttagatatctggccggatgcggatgcggtatgaacgatatccgacggatgcggattatccgatattttaatcggattatccgatgtactgtttggcggataatccgcaaatttcagaccacacaacaactttcaggcccacctagctagcccaatagcccaacccggcctaatctaatcctctcctcatcccccagatccgtctctggctctctctgtgtgccgtccctcagttgtcagtcgaggagtcggagagagtagcgcggcggcacggcacgacggcgaccctgcgcggtggccgctccttcccaacacgcgccaggccgatcctcctccccaacacgcgccagccgttcctcctcggctagcgccaccgccggctgcaggaggctgctagcgccgccgctcactgttgtgtgttttgtgctgtacacctgtactactactgctgtattcctgtatgcagtatgctgcgtgtagcactgcataggggtgctctactgctctatgcttgctg

SEQ ID NO: 50844 - DNA, 2231 bp, Oryza sativa
  unsure (1)..(2231): unsure at all n locations
tgccgccctcttgatgtatggattgaatacaaacttgacatccgataactttttgtccgtttctgaaccgagttcgcaccgaatccgacgtccgaaataatccgctccgcatccgcatccatacgtcatccgcatccgcttaaaaaatatggtttaggatatagtatagctattattcatccgaatccgttccgttttcaccaataaagaaacgcatcctgttttggttttggttgtattgtggagcagtacagcagtatcccgtttcgtttgggcttttggtgggggttgggtgggtttcccgtctccttccgattgctgagtagcattagcaaaggagcaaaggaaaggaacctcgatctccatctccatctccgcccccaaaccctaacacacacacgccgactctccaaaccctacacccccccaacccccaaccccgccgatccccccgctcgccgccgatgggtcgcaagaagaacgtcgccatcgatgacgatgagtactccttcccgcaggaggacgccgcccccgcccccgccgccgacaaggacaagcccatcaagaagggcggcggcaagaagggcaagaagggcgccaaggccgccctgcccgacgacgacgactacgagccccccgcgcccccgcccccgcccggggacgacgacgacgacgaggagcccatcaacctcgtcttgaccggtaagaagaagaagaagaagggcggcggcggcgccgtgagctccttcagcgccttcgacgccctcgcggccgacgaggaccagggagaagacgacgacgaggcccccgcccctgcccccgcccccgtcgagcccgatgccgccgccaaatcagacgccgaggacgacgacctcgatttcgacttcagcaaagccaagaagaagaaaaagaagaaggacaagggagctcgcccagtccctctggaacacgacgacctcgacctagataagcctgccccgccgcccccagccgccgctgctgatgaggcagacgacgacgaggctgctgcagctgcagcttccaaaaagcctcagaagaagaagaaaaagaagggcggctttactgtggacaatgaggacattgacaagctcctcgccgagatcgacgatacttctcctcccaccgaagaggctgagccggtggaagaggtgcctgcccctgatgcagatgatgccttaggaaagaaatcaaagaagaagaaaaagaagggaggctttaccgtcgatgatgaggacgtagacaagatcctcgcagagtttgaggaccagccacctcctgtcgacgatcctgagcctgagcctgaggcggtgaaagatgtgggtaatgtggccgcctcaaccagtgtggatgatgcggaaggcaagaaatcgaagaagaaaaaaaagaagagtggaaggacagctcaggaagaggaggatttggataagcttctcgctgagcttggtgagggcccaacgccagcagaaaaggagaaggaggttctgccccaggcgccacctgctgcggcaatggtgaaggaagatactgaaaccgcagaggatggtaaggctggggaaggagaggtggaatctgctgcagccaagaagaagaagaagaagaaggaaaaggagaaggagaagaaggcagcagctaaggaggcagatgctaagaaagaagaggaaaaggctgtagaagctcctaaagggaaggttgacatgaagaagctcccgaagcacgtgcgggagatgcaggaggcacttgccaggaggcaggaagctgaggaacggaagaagcgtgaggaggaagaacgattgaggaaagaggaggaggagcgattgaagaaagaggaggaggagaggaaagctgaggaagcaaagaggaggaagaaggagagagaaaaggagaagttgctgaagaagaagcaggagggtaagctcttgactgggaagcagaaggaggaagcaaagaggttagaagcaatgaggagacaattccttgagcagagtgaacttcaagtagccgatggtgctgtccctgagacaaagaagaggcctatatatgattccaagaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50845 - DNA, 1342 bp, Oryza sativa
tgaagaaagaggaggaggagaggaaagctgaggaagcaaagaggaggaagaaggagagagaaaaggagaagttgctgaagaagaagcaggagggtaagctcttgactgggaagcagaaggaggaagcaaagaggttagaagcaatgaggagacaattccttgagcagagtgaacttcaagtagccgatggtgctgtccctgagacaaagaagaggcctatatatgattccaagaagaaaaaaggtcaacagaagactctggagactgcaaaggtagttgaagaacaaccacaagaagttaacgaaactatcaatgacgaggaagaatatgtgttagtggatcaggaatctcagttgcaagtggaggaatctgagaaaaccgaacctgatcaggatgtcgaagaattgaaaccagaagaggaggaagatgaagatgaatgggatgcaaagagctgggatgatatagatgtcaatttgcctaagacaagtgcctttgaggaggaagaggcaaaccctgtcgccaagaaggttgctgaacctgttcagaagcaggaaaattctaaagcacaatctacagtggctactgtaaaaaaggttgcaaactccaataaaggtgaaacggaagatggcgaatccagtagtgcaaatgctaggaggaatagaggcgcttcaaagaaaggacctattaaagaggatgagactaagaatggcagtgaccttcgttcaccaatttgttgcatccttggtcatgtcgatactggtaagacaaaactgctagactgtattagacggaccaatgtacaagaaggagaagctggaggtattacccaacagattggggctacgtacttcccaactgaaaatattagagagagaacaaaagagcttaaagctgatgccacacttaaggttccaggattgcttgttattgacactcctggtcacgagtcgttcagtaatctgcgttctagaggttcaagtttgtgtgacattgctattttggttgttgacattatgcacggtcttgaacctcaaacaattgaatccctgaatctcttgaagagccgtgatgcagtttttatcgttgccttaaataaggtatattgctttggagtttttttttgccctttgacctcatcttttcttacagtctattaatgtctcaattgttttttggcttaatctctatgaaggttgatcgtctttatggctggaaaaagtgtacaaatgcccctattgggaaggctttgaggcagcaaaatgaagatgttaagagggagttcaatatgaggcttactgatgtgcgtaaatttccatcttgattttctttaaagaaatgactt

SEQ ID NO: 50846 - DNA, 1119 bp, Oryza sativa
gatcttctcaaagaaaactatagagtaagtcaacgtttattgtttatgtttctgtgcattttgatctgcattctccgaatctatttgtaccaaactacacgttgacgatcttaaaaaaatcatttttgcaggacgatttgtcaatggatgactggaaacttgttgttaagttgaagagcatcttgaagataccataaaatcgttaagcttgcggaagcccctcaagcctgtccaccaatcggcaaaaatgaaaagttaatggtggcatctgggctactggggtagcatccataaaattttcacgttactcagacttggatttgccgggttgagaagttctattctgacacaccgatgttcaagctgcccagggagtttttcaattttgatacggttttgttttattgtaatttgttcgaaatgcggttgatcaaacattttacaaatataagtgaaactacccgattttgaggggttcttgaaagaggctatgtttgtcttttttttttccctgaacacaaactgttttcacatcccgttgcctggtatgagtggttatgtaaagggcagccggtaagtcaaatggagtatataccaggctgaatatttacactgggtaagcctattaattcagcatttgttcacgaaggcattagatctacatggtgttagcattgggatcggtccgtataaaattcattcctgaataaaaaccttataatcaatattaatgtattaatattaatgtgtcatgagtatcagtattacgatcgatgctcacaatgtttgtaaaatataaatattaaccttatgacaaattactatttttagcctttcgtgtgtattttcataagccatggccttctctaaaattatgagtattaattttgtgaatattctggtcctaagactttcgtaattttcaccctttggcagataaatttctgtccattccttttgggtaaagtcacaacattttttttcagggccaaaatttatgagtatttaactttttatgaaaaaaatgaatattttctctagccatttcctaaaaaaatcacgagtattagcatcggaatcgttgcgcactaaattttcctgggcccgaaatgtcacgag

SEQ ID NO: 50847 - DNA, 899 bp, Oryza sativa
atccaccaaatttgtgcacactgttccagattctacatcacacactggactgatgccactgttatctagttcatctacatggatagaggtaaaacctttatccaattgaccatcctcaaccttctgatcataagcatgtgtttcacttgcatgatgtgtagattttgcactagaataagatgacctcaatataatgtttgaagtagaatcagggatctctacaggttcacctgctgcaactacctcaccacatccaccaagctgttgattgccatacgcattgggcaacacttcaatagctttactgctaccatcactttgtgatgcttcattcttcactaagcagttgcttccacgattggtttgaatcccatccaactccattgcaacatgttcatcagaagctgtactcttagttgcattttcacgcttctgtcctgcttgttttaaaccagaaacagaacgtgcaccatgcccatctgcctgtttttcctgcatttcaccttttgcatcttttggttcagaacttttagcaggaaccgtaggtgatttgactgaagtaatctccctacatggttttgacctgttgcgtcgaacatatgcctggctcttcactccaaggcgtgatagaacagaatcctcagcttgttttgcattgttgtgaccatcagtgggcaagggctgcttggattgagcagcattagttctctttgttcctctttttacaatcttctcctctacaacgtcatttttatctccacgaaagagcataagattgtctgctgtgttggtttcacggcatggtgaacttcctggtctgccgttactctcaccagaatctccacgaggcgaagcagcacaagcaaaactacctttagcatcactacaaatgaaggaaa

SEQ ID NO: 50848 - DNA, 3700 bp, Oryza sativa
aatgcggcagtattagcgattgtggaaccaacatagagagtcgtatgatatgataagggcaccatggtgtgaagagtggcaccgaggctgacccaaggcgtgaagcgagggtggaaatgaaggagaaaccgtacctggcgcgcggagctagggttagggtttgcgggcgagaagacggggcaggggcggagcgggtggaggtgcgatcgaggggagaaggcagggaggcgaagggatgagtgggcggcggaggagggcggggaggtgggcggtggaggggggcgggggtcgccggaggaagaggaggcgggaaggagagctgcgtgcctgtatgtatgtatagcgcgaaccaacaagaggagaagagaagagaggcgaggcgagaggaggggggagaggagagggcggccggccggcctgtgtctcgctcgactcggttcgggtcgggtcggactcacactcaggacattttggcagggctccagctcccagattcaacttatttggagctgaagtccaaccaaacggttcagatctgttcaaatctggagcggagcgcatggaatcgctaactggtgggttggagcggcattttggtcgctccttaactccaactccaaccgcgttatagaattgcccacatattttcgatgaaattacccgcaaatgccatcgccctacccctcatccctctctcccgtaccgcttcaccccgtcttccccaacctccatctcgcgggagcgaggaggcgaagcagcagacggcgcacggtggaggaggaagcagccggcggcaacgacgcaccggctggaaatagccggcgcatgggcttcccctttcagtgtcgctcccctccttcccatcccggcgcacagcggttgagggcgagcatggcggcgcatggcggttaatggggaccacaggggcgcacggtggctgagggcaagcacggtagcacaaggtggatggagacggcgcaagacgaccccaaatggcggcacggtattttctcccaaaccctaaaaatttccctcacctcttcccttcagatttggttgagtagttgttatcatgtaatgagcaaatggggaagtttcagatctgaagacttgtctagtgatgaatggtaaaaatgcaatgagcgattgggatgtgtgaaatttcagagcagtgatgaactatctagtaacttttttttgtttagtgttgtaccttgtgtttacaattatatacacacttggttggaattgagcatatcagcaaatggttatatacacacttggtttagaattctttagtataaaacctggcagtggaaagaatgtccttttatgggaggataattggattgggggcatacccctggctgagcaattgggagaaaaagaatagggaggaagctatgactttcaattctgtgatagatttgaagctatacaatatctttttatatattgtccttaattgattcatggggtgttttgcagacctcgacggaaagacaagtcacaagtgagattttcaaatcaagatttggttagagggcacctctacaaaggattcaagattgaactgccagaagtccctttttttttgccgtcatcactgttgtccttgctttcacttgttagtttttcaaatatgtgataccgagatgtttcgcaaaggttctgttggatgtaaagtagcagcacaaaacttcagtgggttatgagatgtcggtatgactgagagactaaaactattgttggtttttttgcttggagctgacctggactcttgcttgcaagcaaggccttgaacttattcatggatggatgcattttaccttgtatacggagcacggcaacagcggcggggtcggagcacggcaacgacagtggtgtgcaaggtttccagatctgtgtggaaggtatctgcatggcaacgatgggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagattactatgaatctcttggaaagtcattgaaaattgtctggacctttattaaaaattgtttgaacctttatcaaaaattgttgtaaattcggttcatcaatcatgttttccaagtgattatctgtgttgtgattctgcatgtagcagctgcacaaattgtgatttggtttgatatcttgcaagagagaggccaatactttcaggatgggataacacaaagcattcatgatgatctagctggtcatactgcacgatgatagaccatattatatgttattttgtggtcttttgctctatcttttgatgataatgatgctacaagttgttaaacatttatattactaaggaaaaatagcatattaatccttcatgaagtaaacgacaagaattacaagggtagtattgtccatctcctccctatcctctctttcagaaatttaggagctgaccaaatgagccaaacacttttacatcatctctagctcctacaagagctagctccagctggagttagagtttggagttaggatctgagagttggagctctaccaaacaggccctcactcttgtgactctgctcctccgtccaatcggatcgatcgcctctcgtttctgccccccaatacgaccatcagtattgggccgaaacggtattcgcttggatcgaaagagtccactttcggtcctcaccaactatgactcgggttttattaattttctgaaatcgggtacagagtatccctcactatcaaaaccctctacagtttatcctacatggcacgttgacttactctttgtccgacataacatttacgtatcagtgaaaaaatataatgggacccacatgttaacggtaactatactacaaatatttaacctacatatcagtcatattgaggggaaaaatcatctctctccctatctatctccatccaagcgagaggaattatatgcatgggaggtagaggtggatctgactatagtgatggtgggcggagacgctcgtcatcgaggttgatgaggtggtgggccctgcggagatcctggttgataaggccaatagcaatgcaagctacgccaaggatgtctctagcccaattgaaaataagaaaccggtcagaggtccccgacgccacagtgcaagtgacctttttgcattggggtgaggtgatgacgagacggagacacgaccccacagtgcaagcgcgactgctttgcaggctgcgcgtggactcgtgacggcgaaagcacttgttgctctgtgtgggggcgagatgctatgtaggggcacacagaaactcgccatgtaggcattcatctgagctggccacacgaagaaattcgccacacaagcgcaccgtgaaaggactaatgtgctcaacgtagatgaagtggttgatgcagtagggggatgacaatggcgcctaactgctggaagccgtattggcgctataagacaatcaatcttatattgaaactaatttagaaagcatatttttaatagtcttacgatttaatgtgcaccatttctttcgctattaaattaagccttccagaatcggaattctaaaagtataataaaatcttattcgttaaaaccaaatatgtatgatcaga

SEQ ID NO: 50849 - DNA, 6001 bp, Oryza sativa
gaggaggaagcttagcggcggcggcgctagcggaggaggcagcggcggcggacaggcccctcatggcagcggtgttggcaaaggaggcgtagcggcaccggacaccggacgggcccctcgcagtggcgtcgccggcggaatagtggcgccggaggaggcgtagcggtggcagcgggcgtggcaccggatcggagggagagaaggagagagaggagaggctgactagtgggtcccacactggtttcacccctccattgctatgttgacctgccacgtgggcaaaagtggcaaatagttaagatggcatctcataagaggagaaaaatatgtgcaatcctaaaaggggtatttggataattgcccaatctaaaagtagcaaatagttaaatttcccgatgatttcgtcacatcatgtagttgtatattcacatgctgacatgcgttctattgatctgcccaacgatgagaaataaaaaaggaagggggagaaacttgatggacgatcagtatctgaatattcggtaaagccatgagctagtattcctaaatcaggaggaatgtctgagagagaatccatccaggttttgacatgacatgtattttcttttcttttcttctactaccacaaagaacagacaaacctggaatatcatttgcacgtgcagggcaagtcagacacacgttctatttccttctttttctttatagagcagagcagaacagaccatatgcgttcgtagtatcatttgcaagcatcagtcgagtcctattgccggctggcaactgttactgctctcacaaggaccaggccacaacagttattaaaccttcacttgtacattgacattcatccatgaagattattagcaacagaatcagtttaaaatccacccaagctatgctctactttctgctacgaacagaggaacatcatcaccagtaactaacatactcacgtctgtgacaaacagcatacataacccttcttctcatagcagttttccttgtccataagttacaagaggctggacacctctccctaatattcaaactttaaaaaagcatcccccaacttcccccaccggtcatccaattccagtttccaaagaagcacatggcatgagagccctgcatgcagaaatctctccaaatacaacaagattcaaggggcacatgtccgcgcaatgaaaacaaatgggaacctgtacaaacagcctaagcattgccatgagtccaccaaacagttgctaagggccaaagccccttagaaccaaccaaacctcttattttccggtctttagtactccacttcagcaggcgtgacccatggagtaggggctctgatgatatgcacaccgccaagattgagacatactagtactgaatcctatcatcgccatcgaaatttaggccctggatgccccgtatggtcgactcgtagttcttagcattcgatggatgcctgccagaaggcgtgcgcctgttgtcagaggagtcaaccatctgtggactccaccgcggggcccctgatctttggaatgcccccggacttgcatctgttgtacgactacgtgactggtcagcttcagtgcttggttctcggctactagagacagcaggtcgccttgaggatccgcttgaccgtcccaaaaaagtcgaactggagaactacacgccacttaaaggtcagatattacatagcaattgtgtataaagtagcacttcaggggcacacttttttgtcatggcactagcaacacaggcatcatgagaactctaagaactcaccactgcatctttagaagttgattgctcatgtccgataggggacttctgcttggctaggctgcctgcatttatagctggaggtggaacctgacgccgcatcgcatccatatctgaccagccgcttctccttccctcttcggtggctacatcatatcagtagacagttaaccaccaaacaactagcaagctttgttaattggcaagactctacatgaatcaagcagtctcaagggttgaccaaacagtagaatattagaatggacgccatctatattttatttgattaaaatataatgatctctacaaatgcaattccttctaacggtttgacccaaccaaaggctccattcctactttactgtcttactaacagatttggtaatgatcgacccgtttgtaactcactaacactaacattacccctttttccatatcttatttggggtggtaggtgatagtaacatcattttattgaatatttccatgattatgagttgatagaaactgaaaaacacctgctgtttatctaggtgaaaataacttaggagctgcagtacaattacaatccactaaagaatagatttatacctgacagcctgttattatttgctataggagccatcgccgagctttgtcctgttgcaggggcctaaaataagatacatcagcaaaagaagagtttgaacataaacccccaacgtgcacacacagtgaggaaaagaggagtggtagttgttttcaactgacaatggcacgtggtggagcactggtcatctgtgactgttgatacttcaggattgtccagtcaaaaacataatcaaactgaaatcctacatgtagaaaaaaaaatcccatcaggtgctttcaaaaggtagcattttgcagtatatacaagtcataaacactgtttagtcactgaaataaatatcgagcatgtttaaagaaaatcaaaacaataaaccaaccctctcgaataaaaaggtctctgaacaatctcttcaaatattggtagtctggcgaatcttcaaagcgcagcgagcggcaataatggaagtaagatgcaaattcagtaggatatccacgacagagggcctatagttgagaaatcacaataagaaatagttcaggaaaggtggtggatgcaatttatagaataatatttacctcagttgaagtagcaattttcctttcgctgattttctcatatttttgtttcttgttcccagcttttagaccctgccacggaaggctggcagcaataaactataagttaatacagaggacgcagttgacgcagagatacaaaagaagaaattacttgaggttatgttgaacaaccttcctctcaagaagtacatcagtacatatccaagagattccatgtcatccctccggctttgttctatggagaagcataaaaccgtattatgatgctaggaagacatacaaaaaggtcatataagcttactaggaacaaataacatcaatgtcaatcttgacactgctactggataaaggaatacatatacagtaatcagataacttaccaattccaagatgagtgtttacacttgcatatcttgctgttcccgtcaagttcttgttctccctatgattaaaagaaaaattggtgtgtttaatttggaagtaatatacagcaactgccatttcaactttcaagtagattaaaggtatccttacctatatgggatgtgctggtgtgttgatgtatccctgtacttctttgcaagtccaaaatctatgacatagacctacacagagaatgaaagcaagggttaagtacacctataattaattcatgaatacgaacagatcaattgaacataactatacctgatttgcccttttacctaggcccatgagaaaattatctggcttaatatctctatgcaagaaagacttggagtgaacaaattcgacgcgattgatctgagagatagaagatggttttggcaaaacaaatgaactgaaatcagttgagaaatgctagctttgggtaaaacaaaaactagaaaataaccaaatgaatagcaaatgggtttaaattgactgctaatagtaccatttgatcagcaagcatcaaaacagtttttagagacagcttcctgttacaaaaactgaaaagatcttcaaggcttggtcctagtaagtccattaccaaaacattgtaatcaccctcgacaccaaaccacttaacatttggaattccagctgcagaacaaaagggtcattagttgatgtgtcagtttaaggaaaacccactggataaagtaacaagcaagcatcaagcatgcattacttcctccctggagtattctgtacagcttcgactcatacagcagttgtggatgcttggtcttcacattttcctagacaaaacattggagattaacaagggtgttatctattaagacaggaagaggactggtggaaacagcagaaacaataaattattctcacaaaatacgcgcagcattacgtcagatcaagtccatgcttgcgatggacgtcaaacaaatttaatcctaatcaaccgcaactggacaagaggcatttgtcagggtataacagtagtatacccagtggtacatctatatagctcttgaaaaaaaaatcatgttttggcagagaactattaacagaacaaaaacttaagtagtaaaagttatgtttcaatagttttcctagcaacagaacacattaaaaactttaacacatactccagacaaccttttatattagaggtgccatatactatcaccaattcaactgcattaaaatatattgttaacaacaaactacattcgcatagcaaccagttgacagatttccaactcagaattcctccaatcaagtatagaacatgtcctctgcatctgagatccccacatctgaagcaatcgaatcataaatcgagtaacacaaagcaatactaggaaactcacgagcttaatagcgacctcctcgttggtctgaacattggtacctgcgagaacacacgcaaagaaaacaaaatagaagtcaccagaggctgatgggtaaagatgagaacttttgaatcaaaacgaggactttgggtagaattgcgcacgaaccaaggtagatctccccgaaggagccactccccagcttgcggccaacacggaacttgttgccgatgcgtggctccatcactgtgtgcaccaagctccccgggacaatcccttaatcacaaggagtgggccctgccagacaaggatcgaaccaattcgatcagctgctccaggggaatttggagctaggacgcataacatagcggtgaggtaaatggggatttatttcttgctctctctcctcatccatttacgtgctgctgcaggtgttgagcacgacacacacaggtgttgttggtctcagaatagaaaaatattaagaaatcgatgcatcaacggaattgggcacggcggcgcggtcggaatggttttccctctctacctgatttttccttctccaagtgatctggatctcctccatcttccctacacagtttcgatcggatccaacttgtttggggctacaaacaaactgttactacttgcttgtattaagagaggttaaggctctggaattaaggaggagaagagcttcatccagatctactccaagagaagctagggttaacgcaagcaaattccagctcccggtgggagagagatgaatcagaaagaggatgggaggtgctcaccaggtccaggataccctgctctgctctgctctgctcgcgcagatggagatcggcagccgcgactcgtcttggcgcaaggagcggagcggaggagacgacgagacgcccccgggagatttctctttcttttacgccgcgagggaatgaagggtactccacttcttcttttttttccccttttactttaaaactgcatttgagatggacaacttctcttctatgctaatatttcgaaattttcatcccaaagctatttcggacattaggacaaaattataagtactaaccaaaactaattagcaacgatggtatattatcgaagttaagcaaaatacgatgacatattgtagaacttaacaaactcaatgacatatatagaacgggaacaaagccagtgacctacatctttttcacttgataattgatatacactttattataaattctataaataaattattggatgat

SEQ ID NO: 50850 - DNA, 2485 bp, Oryza sativa
ccttgcgaagagagtgacttatgaagactaaggtgagcccggggcccagaacaaggccgggctcgaggcataccttagttcaatctcttaagatgtagatcttatagatctctacgatcttcccgctaaaggacgtaggacttataagaactggggtgagccaggggcccagaataaggctgggccgaaggcagacctcagcttacatccttaagatatgtgttttgtacgtctcaacactcctcttttctgagtagtgtgtgacttctgcaaactaaggtgagcccggggcctagaagaaggtcgagcccaagacagacctcagctttacatccttaagatatgtgttttgtccgtcttgacactcctcttttctgagtagtgtgcgacttgtgcagactaaggtgagcccggggcctagaagaaggccgggcccgaggcagaccttggctcaatcttcttaagatatatatcttgtagggatctacgctcctcttgctgagaaccgtagagcctacaaggactaaagtgagcccgggactcaggacaagaccgtgtccgaggcagaccttaggctatattcttaagatgtatttgggtatgtttggcaccgaagccaggtcccaagatgcccttatattcaaagctttgagtcattgtacatctcatatattgcattcctccttagccaggcagagttccatatatgagaacacatgtgggcccgggactcaccagagtgggccctagctacgccaccctagggttgcctttttatttttaaagatactctaagcatgatatttatctgataatgatcattttgccaggtaaatgggtacctcgattcccatttcaccgacagccatcgccgttagcaagaggttgccattgtcgccagcgggagagggtgaggaggaaaccaccctagctcgtcctcgtcaagttccagttgactgctccccggctcgagggagaggataaggttggtgaaaaagaagatatgggctgagggtattttcgtccatacaaaaatatggtatgcagaaaacaactagcgtaagaacgtcctagacgcatatatagtaacacgattcgaattttacaaaataccagtgacattgagtcacaccgagttttcattataacatattcttaacggcatggatttaattaattgaaccaccatcttacaacatattccaggaagaaatatatattatctgcaatgggtcatccatcgttgtactttttttttcaattaagggtaaactcgatgtgagtgatcgatatatggttatagatcgatcacaaccggtatgcgctaggtgataaattttccatggcttccccggcccactctctggctctttgtcccctggatggagtagctgatggagatagataaataaataaagtagtcttaattaaaatgaagaagtttgtttgtaattaagcgatgggatacaattaataggacatatatgtacccctaatctgtatgctcaccgtgcaggacgcttatcatgtgcagattactggtggcaacgctggaataataatctgtatttagccggccgttgacagtggcagctaggcagtagtatgatgacatatatttgatttggtgatgcacattacatcgatcattgttattgcaggctgcagctagtgatggagatcaattagagatcataagtgtaacggaggaggggatggacaggccagggaggcggccttggccatggcgtggtgggggacgccggcgttgcagatgttggcgaaggagcgcatgtgctttatcccgtactgtcccagcgacccacactgatcctcgaacgtccgcaccatcgacctgaggcactcccagtcctcaaccagcgcagcccgctcccgcacaacctgctgcttgtgcttggcgccgcccaagaggaggcccccgatcatctccacgcttctgtccacgcgcgatcgccgtcccatctcctgcacaagccgctcccgagcctccaccttctctgccgtcccctcgccggctctccggtacttgcgccacaagtagagcagatcggcgtcgcgctgattcacagacacagtgtaggagtggctgcctttggcgccagcagcagctaatttgtggtcgttcgccgtcgcaggtgatgtatccatgtagtagaggtccaggctctgcggtgcgagcgccatgtcgccgtactgcatgacgtgggagccgagcgtgtaggtgccctcgtcggacgtccggttcttcaccgtcctgtactgctgccgcagcgtctcggcgaggcgcccctcctggtgcgcctccgcgtcctccatccacgccacgctgtagaggtccccgaggcaggtgtcgaactccgccgccggggcgtcgtggtcgtcgcccgggcagtaggtgccccagctgctctcctccgcgttggaggccgtggtggcgtacacggagatgtcggaaggcaggagg

SEQ ID NO: 50851 - DNA, 26234 bp, Oryza sativa
cttaagcccagtttccaactctctaattttagtcctcagatcgatatcgatcttctctcgcttatctggtgacattagctgctttgctctccagtaaaaaatagccacaaggcattctctccattaattagcatagcagccagtgctctccctccatttacagtttttaaatttcttctacaagaatacgggctcaaacacgcgtaaacatcaccagcagatcacaaactcaagtctccaggcggcagatgcagcactgaagcagcaacatcaacacctgctcaaattatggcagcagggaagggccattgaccacacgcacaaaccagacaagattgatgatatccccttcctagatttcactgttagttagattccaaaaaaaaaaaaaacccaacctagaatgggatgggacatgttttaggacaacgtatttggactgtctagatacgttgtactagaatatgtccaatcacatcctagattaggttttttttttttggacggagagagtagatcatgcttcacaaaaatccaaggtgggccatccaacactccatccaacctaccctagccccaatccccaattgtgaatcacaatcattactgtcatcatgccagtatcaacatcttctggaaaatttatataacgcagcagctaccggaactgaagtaccctgcctagacatccttcaccaaatgcaaagctacggctgccccaccttgtagcctacggtacatccggagcataacctcatccccatttatcctcgtttcatttgaaagctcaacgtacgcttcattgatcctactgaaaacaactcgaagcgggatgcatgcaatgcccagagatttaacctattactgacttcttgtttccggcacctctgtgatttatgtcgaaagatgaaaggctccgcatctttcttgaggaaggcacatgatttttttgtgtgcggtcgccatgatttctctgtttcgagttcggacatcttcctgtggcttttgggctctgttccacctgtgtgtgattccagacatcccaggcttgaagcttaatccttcttcactggtccatcaacagtgcttgtggcagggcggtgatcacttacacctgatgtaggaagaaaacatacaccatccgagactggataacccacaacgggtcttcggttccatatactcattagggaaacaagaggaccagttggcttgtttaatgaactcttgcccaccttttcttccaaaaggataaccttattgattgatatccaaccctgtctttgtgatatctaggctccaatgcatttcgttccatgttgttggccccatgatcagcggagctcatgatttgcttagtaaaatttccgcgttcgcatcgggaagatatgctagctttgctgcagttggtaggtcgccttttgcgtttgcagataggatcctttttttttaaaaaaaaaaaaactaaaatcgacaagagaattgtcgggttggcactgccataaccaaattattttttgaaaaaacactatgatgtagtatgcaatcaaaggacataaaaacagaatcctctcagaaaatagaatataacaatgatcacggtttgtcttgatcttgtaatcgtcaagaaatcgaatcaggggaagagaaaaggactagatgaagagaaacagtgtgtggggggggggggagaagaacaactaaatagattaggtcatggaattgattgttctgaatttgatagatcttcatgaattatggatcacatttggatagtattttgaaaaatctgatcaaaatctgccaaaattcttccataagaattgggtgttttctttaaaaaaatatatatggtgaagtgatcactagaataggcacacccagtataatttttctgggtccgccactgccgagagaaagaaaagattacggcggtttgaaagcaaactctctatcgttgatgtcctctaggatgacagctacattgtgggcaatatttgggagttctcctttaaagacttttgcatttctcatgaaccaaatatgccaccatgtcgttattaaagctccaatatttattcttgcttgcaccctatttccagaggaggaaatatttagaatctagtcttatatgttatcctacatatgatggtttgggattccttttatcgttgagattgattgccagatctgatttgtgagatcacatcctctgaatagatgatcagagtcttcaaaagcgcccctgcaaagtggacaaatccaatcacaaggccaatgcctaattagtaaattctctactgttaaggtcttctggtgaaggattagtcagcccaggaatctttgcttagattgagcttctgctgtccatatcatcttgaaggctgggtttgtctctgatccaatgaattgggcttggtaagaactctttgctttgtagatacctgcagcatttcttgtccacacaatattatcttccccagtttcaatgagagtgatttgtgtgagtaaacttccaagttgtactagctcatgaagagtttcaacatctgttatctgtctaaaggatgacagccaggtgttgtcgttaagctctgttttgactcttctatttttcctgattgccatgttgaataggttgggtgaaatatcttggagcatagaccatggagccagttatctttccaaaacatagttttctgtccatttccaagagtgatctttgtgcaagcttgaaaaagttgatgatctgaatcattacatgggagatacatcagttcccatggtttcgaagagtctttccatttcagccagagccacctttattaccaaggcagaaggttcacactctttcaaatgatctgggggaaattcaggtgataagcaggagtcaatcaaaaatataggaagataagctctttttccttgccgaagcgttaccgtgatatatatattcattttttgctgctcgtcatatcgctgctatgcatatggttagttgcgtgttcttcagttaggttcctctgctgtttggtgttgataaatgtacggttatatatacttgaatgatcccgataataactcgttcttgctggtgatggtaaatatatatacataaaatctgtttgtgtatcagtatcagcagccaaagcaaacattgatgaatcatttgaacaaaagccatattatttttcctcgcctatattatgtaacttgttcttacagccataggagcgtactatgcgtaagaaacagcaataagcttctgttccgtcctctattagctactccatatagcagtaagtaagttgtaagtagtactccagttactagtactataaatttaacaagggcgatggatggatggtgtgttacagtagtataattgagatggaagaggtaggatggatggtcaggcgaagagcttctcggcgaagatgtcaagaagggatagggcctcggcgacggtgagctcgaggcggaacttggggccgtcgtagtggtgcagcacgggcctgaaggcgtcctcctccagcggctcacagatcttgcgcgtggccacccgaacctgcgctgggaacctggactcgccgccggggcacttgctgtcctcccaagcgccgggatcgatgttggatccgccgaagctggtggcctcgaagatgccgtgaagctggtgggtggagtagttgtagaggaagagcgggaggccgggcctgatggccctcaccgagtccctgtacctggatggcaggccgaacagctgcctcttgagattctcctccatcgtctcgttgttgcacacgaatatgtatcccccgatcgcctcctcctttggcaccgactccgacgccggcagctggctcttcttcaacctgctgctcatcttgttgtcgttgctgctgctgttcttcttgttgttgttcctgcctcctcctcctcctccagcaggagcgtcgacagcggccttcttcttcccgttgaacgcatctacgacgacgctgttgctgttgtagttgaagttgaagttgttgttggccggcctgccgacggacttgttgaagtaggtcttggcggtggcgttgttgttgctgttgttggcgagggcgagcttgttgctgctatgatcgacggcggcaggcgagggggaggaccagatggagtcggcgatggagaggctggagaagttgtggaggcggagctggtcgctgaactgccagaactcacgctcgtcgtacccctccatcttctgaattaacagaaagatcgggtctgctgccaccgccgatgggagatgatcgattgatcggaggaggaagaagcagcaacaccaatttactcaattaacagaaagagagaggaaattaaggtggagaggagggagttaatttggcggtgcacgcgggtggatggcacttcctagatatgcttgggttggatggggagatggaatcaaagtgaacacttgctttgcagctaagcaactaggcggacgactgaggactaattatatgaatcggacgcgtagaaacaaagaaataaatggacgaaaagaaattatggttggacgtgcaatcagtcaataatctgatttttaaatttcattgcatccatagacacgatgacacgtacacatagagtggtgaagcaaagtctgcctttttgaacgcgtcaacggcccggacttcttcttctagatggacctgctactatacattcatccatccaccacctgaccgcctaaaatttccttttaccaaacaccgtagagacatcttcaaagatgttactttgcccaataatatctactccctatgtccggatttctagtttttcttacaacgtttgaccattcgtcttatttaatttttttttgcaaatataaaaaacaaaaagttgtgcttaaaatactgtagataataaagtaagttacaaataaaatacttaataattttaaatttttttaataagatgagtggtcaaacgttgcaagcaaaaactcaaaatcctttatattatagcatggagggagtataaaactaagatgttttaaataaaaaaagttgcatattatgatagtatgtttaatgataaatctagtaacttcaattttacacgattgattctttttttttctattagtggttaaaattaaaaatgtttgacttgttactgtactaaaagtgcttatattttgggacagaggaaatacatttttttcacctgttttacgtataggaatatacatgtttcgaaagtacacaagtggggatggaaacttgcaccgaatctgcacagtgagtgtgcgaactaatgatatcgcgcaggccaatagcagagtcggacccgcctcgagttcgtgcagaacggcaccaagtcgcggcttcgcgcaaagaaaatgtgactcgtttcattagctagttaggaattaggattccacaggaagtcgtcgcgacttcttgatgttccggtgagtatactcgaggatggggtccgagttcgcgcacccactatgcgagctcgttgtgagttcgtgtataattctaccaattctttcgaaacatgtataaacctcgaaaactggttaaaatagtttttttaaagtcatctttaactttatcccaaaagactatatttttacttgccacgaattaagaaaatttatctctttaaaattcaaaatatacctcttacatgccgcttcagaatactacttaaggataccttttgatcgaaatgaaggatatttaatttgatttttatcctcatcactattttattaactttgttaaagaaaatgcgaaaataatacaatctttgtgcggcgagagagatcgagtaaatattgtactatgcagattactagtttttgtttataatatgtatgctatgaataactacagtatcagcatgatatgaaagtatttttaagtatacgactctaatgtatggcatgcatgacactaagtatatatattagtactagtttcgaggcgcctacaaatcggacgtccgatttttttagcaaaaatcggctgctgttttaccacatagattagaattgtttcactaaatatatcgaaaatgtttcaatattaaaaaaactgaaacacaaccaaatcatgaataaaacattttgctacaacgtatgaaaacaatgattttcaaaaaatcaggcgttgtttcaccctatataaaaacaatgctttagcaaatagcaaaagaatgtttcaattcactgcactatttgattcatatataatgaaacatcatgagtacacttattgaaatattgttggtggaaaaaaaagaaacatattcccttaatagaacattttcgtaatatacggatgatttgttgcaacggcgcatgtggtgggatagcgcggaggcgcgggagacgacgggcgcctgatttttctactgctgatggggcgctcgatcgtggtcattttcctactagtttaattacatgtgtgcgaagagatgaacaaatatatactggattggagtttctagtagtaggctactagctaatactacctccgttttttaacagatgacgccgttgattttttctgacatgtttgaccattcgtcttatttaaaaattttatgcaaatgtataagatataaatcacacttaaagtactatgagtgataaaagaactcataacaaaataaattataattacgtaaattttttgaataagacgaatggtcaaatatgtgagaaaaagtcaatggcgttatctattaaaaaatagagggagtatatataagatggtggtaacatacatacatacatagaagaaattaaagtggtgtgcatgcttttggttaattagtggcgtaatgagtggtgtgcgtacgtcgagcaagcgcgatgatggcgactcatcacctatctttgaatcttgctgaccgtgacgccgtaccgcgtttaacatttcctccctcaatttaattttcttcggtcagtatcaaagttatgtcatactatatatctttattttaaaatgtaataatcttaagatggatgtatattctagtagttcgataaacctaaacaaactcctttgaaaaagataaatataaacaaaccattccaaaacgacctaaactaaagcaacccattaaaacccaattgtgattccctatttgaatgaccaaaccagccaattgcagggacggatggttgggtcgtggtatcatcctctatcgtccgtcagtctaaacaaactggatccatgcatcgatctccgcccagtccggcttcgatcggctgcctcctcaagcaagcagatcgtctcgtctccgccgcctgtgctagctacggtactcgatcctcttctcttgtgcaagcagtagtacagtagtgtacaggagtactccgtagctagcacgtactgtacggactccatatatatgttaggcgcatgtacgtacgtttctgcttctgcggtctgcctgttagtaatttgctacacaatcacatccagatggtgaacaccgtccgtccctcctacacacacacacacacgcacacgtatatatatgatcagtcggccggcgatcgaccacactatcaaatgccaaattactactctactctactgtctagtagtgcttcctacatactgtagtagaaagtacataacataacatatacctgcagaacgccgtcttataacgaaaaagcacacgctgatgacagcgtagcacaggacaagaatcaatcccttcagataatgtgattctccctcctgaaacatatatatacttctaataaaataccgacaatcttaagagttttactgtactactgtatttcactttgattctgaacaagatcgaaccaataatttcagcttttactagctagtacttacctggagggtgaaggctgtcactaatattgctagaaacagagagccagtctccagcaggttgaaatcaagatccattgggattcccatagtccaggctacaatcacactcactggaacctgccgcacagttcatcacttccatcacaacaacatactaacacgcatgtctacatacatactccactaataactattccctccattccaaaatataagacacaaccacccttaacccaaagaccaagaaatagttattatcaccttgtagtttggatcatcctaataaatgtaatgcatgtatccaatagagttagagaatgtgagagtgaaggattttaaaaaaaatagtaatttaatggagaattgtcatagttaatggcatgcatgtgtatgtatgtcttacattatggaacatgtaaaaaaaagtggttgtgtcttatattatggaatggagagagtatcaatgtatagagcgaggttagtaaattactagtactacgtactagctactcctacataccacaaacatggagatctgtgtggcagagcccaaagacactccgagagtaatatcctgtcgtcacaagtcacaacaaattaatgataagaaagaccaatactctgctgcatatatatatatatatactgtatgtgtgtgctgcttaattatatggagtaccatcttgttcttgagagcaaatatgacggcaccggcatgctctgctgcgttcccaacgatgggaagcaagatgatgctaatgaagctcactgatagttcccatgattctgaggccgcctgtacattcacaagatacgtacaaaaggtggtttagctagcttcattatgcatgcatcttgccaattcactgaagattaatacagtacagtacagcagcatatatgtaaatggtactaggatgatatatatatatactgtacctcaattgtgctcacaacataccctgacaagagcgcagtcaggagagtcatgagagccagccaaatcatggcactcgagaatcccagtactggctcatcatcttgagcgatcactaaatcatcgtcgtcatcatcctcaacctaattagaaaaatataataattaccatttggtgttggtgggatcgaacgtagtacaggacatgcatcgatcaatcacagacgggacgtacctgttggggctcaaacagctggcgatgcgtgttgagttggaagaagaggtaggccaggtaggcgatgagcatgaggatgctgcaggcacgcgacaggtggagggcggcgtcgccggagacgatggcgtggtcgccggaggtgacggcgtacctgagcatgagcggcagggagtggcagaggacggcgagcatgaggagggcggtgttgacgtgagcttgcttggtgtcgtacggctggtgggcgcggaggttggcgatgccggcgaggaagagggaggtgccgaggacaagcagcaggttggagaggatggatcccagcagggagcatttcaccacctcaatctttccttctcgcagcgccaacagcgcgattatcacctccgtcacgttcccaaatgtcgcgttcagtagtcctcccactgcaaccatgcatgcacttcacttgatgcatttccacttgatcctgatcgaaacgaatagctagcatgcatggaattcacttaccagtaggaccggtgtaaaatgcaatctgcctgcatgcatacacgcaaccaattaattgtcacaaaattcaagatcactattataattactctcccccatttatacttataagtcactttgacttttctaaaagttcgatcaagtttataaaaaaatatattaatatttacagcattaaattaattttattaaaactaacattcaatatattttatattttttcttgttttatgttaaaaatattattataaagttaattaaaactaaagaagattaatttagaaaaaaatcagaacgacttatgatcagaagagtatatggttgcatgcatgcatgatgtacattatctgagcatggtaggaattagttaagggagcttactcggtgaggaagctgagtcgctcagcaagaggaacgaggccgattaagctaagcacaaacacccacacctgcaattaatactgtaagaaagctggttgatcatttagttttttttttgaatggttgattatttagtttgtacttaggttgtgtttagatctagaggtgaaaagttttggcgtatcggatatacgaacacatatttgaagtattaaacgtagactaataacaaaacaacaaatgacagattccgcatgtaaactgtgagataaatttattagcctaattaatctatcattagtaaatgtttactgtagcatcacattgtcaaatcatgaaataattaggcttaaaagatttgtctcgtaatttacacacaatctgtgtaattagttattttttttatattaatacttcatgtatatgtccaaacatttgatgtgacagggtgaaaaatttcacagggatctaaacaggcctttagcttagggatgttacagtagtttttggttagtacagtactagtggagtgtatctaggacgcaccgttgccatatggctgagatgcgacgacgaaaaatccgtgaccgtgaggagggggattaatattagcctggccatgcatgtgatgggtgtgtcaagtgtcaacttgcttaattgttgcaattccatgattccatctgtttgtattttaatagggtttcacaggctgcaggcaacttcaccacatgcgcgagcacatgcactcagctagtacaaattaatctaatcgccatcatccggctcgatcttgtattcgtcatgtgttgttggtggagtgttttttttttttggaaaattataaaaaaaaacctgttatgctaagtttaaaataccctcctaatttactttggtttgacgtaatttagtgcatctcttgatgaacatggccccaaacatatttctcagcgacacagtacgcactactcacatctttcttatctcgaatctaacgaacaaaccaaacatcgttgaaacccatgagacaaatgcagtttatcttgcggtaacataaatgttcaagagctaagactcacgaccttcactgcctaacgatacgatgggcgccatgggtagggattatagggcttggccaacaattggagtttttttgtgtttagccccgtagtttttttaagctttagctttttattttgttttttctctcttactctagtataagccggtctggctgattgtgttgtgtaattatacttttttcttctaatatattgacgtgtaattcttttgcgcatccgtaaaaaaaaaaaagggctgggattatcgaccacagttccttgcctagtactagtattgatatgagcatgcttgtggcttgtcataagaatggacgagcaacgtaaattggagagagatggatgaggagggtacctgtccgaagtggaggtaagtggcggcgatggcgaggaggacggcggggaagaggaggaagagcctggtggtgaggaggacgtcgttgagattggcgaggagggagcggagggcggcgcagggaaccttgtggaggagggaggcgtcggagcttttgcggagggaggaagatgagaggttgtgtgcggtgcggcggcgaggagaccccggaaggaggtggtgccgcacggccatctccttggccatcgtattcgactccatcatcatccgcgacactggcatcaagctctagttgttcctcgctcgctgagtcgctgtgcgtggttggttggatgagagagagagagagacgatctatcgatttcatacaaatgcggccgccgtcgtggtgctaggattttgctgtatgtatgtagtgaatgactaattgaggaggaatagtatattaatggagcagctcagctcatcggggtggatgcaaatgtcaaatgctccatgaccagagtactccagcatgcagtagtagaatatggagtacagatattaataatgaggaggcacaagcacaacacaagaagaagcagagagagagagagagtggactgatggtctggtcgaatcccgggttctctaaacttaaacgtacaaaatatcacgcgaataattagtatgcattcttggtagtactcctcctgttaattatgcagttactagtaactaggcaaatgcaaaacctccgtccaaaaggtacctaccatagacaacggagctgcaacagagcagaaagaaaccaatccaatccaaatccagtgaggactgaagaggaggtgagagactgacaaaaatggaggaagctccggtggtctattccgctccttccaggggcgtcgccgtcgatcgctgcttctcttgtcttctattgtgctcccctccctaatccaatccgtacccacccaagggatgacaatcccaatcatattaaacccttttcttcttttggattttttgtctccggtgcaacgcagccaaggcccacacgcttacaaataaagtccatacaaatcacggcccaacccaccacaccaacctatccttttaggcccatttgatggataatagtttggaggaaaacgttcacattatgtcctccaatttatgggttgagtttcatttgcatccctcaaccgtaaaatcaggtatatagcgcccttcaattatcaaaactagatcaaattgggtcccctctcagtggggcatgcatgtcagtggggcccatctctcttccttccttctctctctctctcaccatcctctcctgctgtagggcggtgatgacatgtgcacacatgatggaggcttgcaacatcgggtagaccagcagaggcccactgggcaggggagctcgatgtcagctgctgctctgctcgtccttccattgaggctcggcttcttcccaatcaacatcaacgtgcagaggggatccccattcccccgtcgaaagcagagcgcctcccaccttgatggaagaggcagtcaacggcaacgaccttgcatggctgttccaggaggccgtcctcaacctcaagcgcaacgccaatgaggtcctagctaggcttctccttgccattcatcatcgacacctctgcgcccatcgctattctgcagcgctcgccgtctttggccacatagggaattgtcgtcaaggcgatagtggcggcttggtgtcctcttcatcctcaagggcttgatggtggtcatgggacaacaagcaaacccctttccttggacacgacagcgacagtagtgctggctacaccaggtacttcgaggcctgctaccccgtcatcagtagcaaagccggtgaaggaagggacctgttgagcgtgcatatgttgtgaccacggcgatgattggaggagatattgaactatatgccacttttagatgtggcaattaactgtttgccactagactcacatgtcatagacacatgtggacccacatgtcattgagatatgtgtggcaaatagttaattgccaaatcgaaaagtggtaaatagttaaatgccccttattggagatagagaaaaatggaatcgtaaggggaaagagtgaaaggtcccacatatattttttgtttctattttttcaactataattccacatgaaccccagagcatattagagaccatgacacattatgaaaccaccaaccaaaccgtgagggatgtaaatttaccccgctttaatagttgggggtatccttcatatctagttttaccgttctagtacatgaatcaaactggggctatcgttgagggatttaaagtgaactttttcctagtgtggaccagcgttattgggctggggtacagttaaaaaatgaattgctcctactatagttgaactaacatttttcactctgcattatactccatatgttttgcatatattttgcattatactcccctgtttcttgtctgaggctgagcagattcgagcagggaggccatgcatagggcagaatagatgaaggtgaagttgtgcactctggttgctctgtagtggacagggaagaagagggacatcaccagcttcatcgctggattgatcgtcttgcatacattgaatgattgattgctatactagtacatatacatacacgaagaacatagtatatattgtagctgctgccgtacccatctgctacctgttggagaagatggcctcaagatccttgtagagtcccttggacttggagctccactgcgaatgcgagttctcgggtcccttcgccttggagtccgacgacgacgccaccgacgacatgctccggctcccaccctttgctctgctccccgacgcctccgcctcccctccctgtccctccttgctgaagctcgccttggccatctccctcagctgccccagccacgacctctccgtgccaccaccaccaccacccagtgccactgcctccggctgctcctgctgcttcttcatcttctccagctgctctccaagcgccgacgacggcagcaccagcagcagcagccccacccacgccgccttcgcgccctccacgaacgacctcctgtccgagctcagcagccgcacctgccggtacagcgcgttccactcgttgcacacctgcgccgccaacgccaccgcgaacaccgtcagcatggccagccctaccccgctcccctccgccacggcgctgcccccgctgtccaccagccgaaggcatgcggcgaacaccaacacctcgcttgccaccgccacgatctccaccagctgcacccgcttcttgatgaagggcttcttgagcaccatgaagaagagctggaaggaggcgatggcgagcaccaccacggcgtgcgcccgcgacgagtggtccgacgacgcgtgcgcgcccgccacgatccccagcgccacccgcttcaccgactccaggaacgtgtagtagatccgcagtatgccgaacagcttctgcaggaacggcgcctcggcgtcctcgttctcgtcgtcggacacgatgatccgctccgccgcgcgcttgccgccgctgccgccggcgatctgcgagagcatgtacttgggcgggccgcgcaggtcctcgaagagcgggccgagcttgacgaggcaggcggtgcgggcggggtccttccacgtccactgtccacgcttgccgggtcccagcgtccggcgaacaatctcctggtaccagtggtactcccgcccctcctggtgcacctccttgtactgcagcagcctccccgtggtgacgcccagcgacaggaacagcagcagcgctaccaggaacgccgttagcacccccgtcagcacgatcccgacggccagccccgccgttgtgccgcctcggatcagcgccgccgacgcctgggacacgcagggcatggcgaggatgacgagcatcagctccagcctggggaacacgagcgcaccgacgtgtgtgtggctgtgcctgtggcgcagcttgaggtagaggaggagggtggcgtgcagcagcaggaaggcggcagcgatgacggccagccagaagatgttcctgaagaagtacttccatccgtccagatcctgcagcttcatgatgatctgcgcctcgggcttcatgtcctggttctcgaacagataccggtactccatggcggtgagaggcttgccgtccaatggcgacgtcgacggcatggccattgcaactcctggagctgcaggagggcggcggaggacgtcggcggcgagagcggtgcggtcgagcatctcggagtaggcgatggcgggcatggtggagtagccgacgaaaggatcggcagaggggccttcccatgggaggcgcatgtaagggatgctccactccagccccttgctcagctcgtagtactccaccggcagatttatcgacagccatcgcgacagcgcgaatacctgaatgtggcacgccattctctgaaaccaacatcgccatcgattactgctctacctgctagttactccatatgattctatggaattcgattgtagtgtaccaaccaagagatttcgtgatggctcggatacgaggtaagaaggcggcctctggatgacacctgatgccagtagcgacgatgttgaaacagtcagcagcgtggcgaatgctgcggttgctgtaaaaattaccgtcgtcacgatcgcgatcgatgatgatgatgcaggaacagaatctgcactcaacacagtaaaaatgcacacaattagttcgtgcgtgcatctgtctgctattgctacctaataattcaggttttgacgagcatgcatatatggactctgcttatgctagctgacaattactactacattacgtatccagactcatgttactaagatttactccctccgtcacaaaaaaagacaaaccctggtttccgtgcccaatgtttaaccatccgtcttattcaaaaaaattatgaaaaaaattaaaaagacaagtcacgcacaaagtattaatcatgttttatcatctaacaataataaaaatacgaattataaaaaaaattcatataagacggacagtcaaagttggacacgtaaacctagggtttgcctttttttgggacaaagggagtatgtattttggaacgaagagagcaagtagtaatgatgcccttacaatgcctcacttccagacgatctgacggtaagttggtatttcctgcaacgtcctgagcagagttctcggcgacgtggaccgaaaccagattatcaaccgcctgtatctgcgctgtgtatatgctcttactagcttcatggaagctgaaaaccacgacgaattcgtttaattattaggaagctgcatgcatgcatatggatggatggatagatgggtttgttcttgcctgaggagattgcccccggaaacctgcaccgcagaggaagtgaagttgaagacaggctttgcaaactttatcaaaaccgggatgttgcgtgaacttgttctgacagtggatgtcgccagcttaacagaaggcctttgattatctgaacaaacattctcttgtacacgtgttatcgtattgaaaactgaaagtaacgtatggattgagtggaagtggagcagagtagtactgtatatatgattggcttactaaccgtaaagaaaagtgtatggctctgaagaagaaacaggagttccttgtctgctgattatggaattcccgtcacaggaaacagtgacaacggcggtgttggatgtcctcttaacctggaaatggtatggaatgaaggttgttaacccagcaagcaattaagcagtgggattagctaggacatgacagtgagagtggattagagtaacgtacgaggtatccaaagcggcgattcccgagcgtgcttcggttggttggcgtgagaatggcatcggtggcggtgagagcggcgaggatttgggaggaagaattcatgacgggttcagcgaaggagaggtataccctgaggtccttgtcgtcgttggtggcttccaccaccctggtggcgccctcgatctgaagcagcttctcagggatgctgctgccgatgttcatcgagtcgctccgtctgtctgcagtacatccaatctcgatcgatcatgaataatactagtactagcaagcaagcaaagcaaatgaaagtgtatctagtgtaggtatacgtaccgaagcgcagggtgaaggtagagttggcggttctgatgaagtggtggccggcagcatcggtgcagaagcccttggccatgacgagaatgaggcggccatagagcaactccggcgggatggtgacgtggacggagtattgcagggcagggcggaggacctgaagactcgacggatccacgcgcccgggaccgtacacgctcagctgcaaatgcaaaattccaattaataccgtattacattccattccattcagtaacaaaatgatactactccatgtggtagtgtactagtggctcgtagtacatggcagtaggtggcgttgcaggtgaatccgcctccgccggggcagggctcggagaaggagacgagcaccgacacgttggatccgctcgtgaaccccgcctccgccttcacggacgccgtcggagcaaccgtgtctgcatccaaaccattttcatttctactactataaggttcccgcctgttaaccacattactggagttgtacgtacgagtactgtactagtaacggcaacaatcaaatcaaatactagtacaagtaaaaaggatgggaattaattaaaatgctactactgtactgtctagcaatagtaatagggtgttgttactgaaccaaccaacatcccaggcgtaggtggcgcaggttgttgttgttgttgttgttggtggtcgtcccgcacccgcgcacacagccaaggtgtggttgccgtctttcagccgcgagtacctcaccaccgctgtcccgttgctgctgctgctgtttcttccgcactcccacgccctctccccgtccacctgcattcacgcatgcacccaaataccaacttacattcgcatcttcttcaatactcctaccttttttctcacttaattaacctccttcctacaaaaaaaaaaaccttgatactactactacaatgctgtaccacaacttgttggcttgttgcaaatcaaatggtctaatccgccaagacatttccacctacctatatagtaatctgaccaacatctatgatctatccttgtcatggtagtactatactagtagtatcaccggagaaattgatgcatcgatgaatgcatctactatgaggctattattaactgactaattgctctttcaggggaccaggcacccaaatccacaaaaaggcacggcatatgctaactgaaaccacatttttacacttgattctctctatgcattccactggagtaggagtactccactaccactacctagggagataactcgaggcaacacatgacattagcaactgtaaaaaaaaaagagatttcatttcagacagaagctactcctaggtagcaccgcacgcacacatttggaaaataaaaatgatggatgtcgaaattaatgccgagacatggaatatatgcaatgcgagtgcgtgatgaagcagatgagctagaaaagcatggaatggaagcaggcaggtggaaagtgaggagtgaccttgcaggtgatgaggcaatcctggcacgggcctgatccattggtgtgcaggacctggaaggtgaagacggccgacgccgacctggagacgcggggaggggtcttggagaagctgacggagaccacgtcatcggcagcatcggaggagcacaggagcgccgccgccgccgccgcaaccgcaaacacgacgccgccccagctcttccacaccatcctacgcgcgcctactattatctactcctactccctagctactcagcagcagcagcttgctatgctactccagtactgttgcaagagaaaagctcaagaagttacacctggtgtgtgtcgacctactgagctactcctactgaattcattcatgcaggcacccagccaacagtgttatggactggagtactggacagggagggaagtgaatgcacgccacgctgctgcctctgcctttgggaaaggaaagctagagctccctcttgacaatggcagtattactgacttgagttcagtgtggtgaggtcgcagtgcagtaagtatggtggtagattggaacagacaaaaaatgaagggagggagggagggaataatggtgggggacagacaggaggggagagggggccaaatgcacactggcaggcatcgcatcgcccgccatgtgaaggacgagacggaccatggttgaaatgcatggttggctgcaatgcaagcagaggactgaagaagaggaaatggattggatgatgcacatgaggactagagcgcccaaactgtcttttgtgcatttctaccttttatcctattttccctaatcctttcaataatcaatcaatcctccttcctactcactagctcggatgtaatccatgtcattcgatcggcctagcttgcttccatccatagacaggaagaaaacaacaaccagcgcgagatgcacagattgctacagtacgcgacgatccaaatttgcgagcaatactgatcaactgtggcagcaaggacaaacatgcagctatcaccgatcgaggcactgaaatttcagtcatacggtggcgacatgacgatgttacgtaatcaaaattaaggatgggcctcgctcgcgaaccactgaatcaggatatgatgcctggggattagctcaccatgggtggctgctgtccgtcatttagaccatgcatcaacaacaacacctagtaactcttcactagttacatcgatcaaagatggagtactacatacatgtaagagtagttaatactagtttatttatctcagcgcgctcagttatcatcgaaaaataagggttttctgacagcaaggcatactgctagttgccaaaatgcaatcggtgacatgcaggtcccaaaatatgatggtaggagtatatattggaccagcaagccacaaaccctcttaaacttcttctttcaccctcaccctcaacaacaacatgcatggtcctcatcacagacagattcacggtgctgtgtgaaacatacgagtaactagtacataatctcaaataagcatatgattgtagcacaaaaataggggaatcctctctgaatcttggaggagactccagatctgtacgtgcacatgcagcagctgcctgccccccgcaataaccaccatgcacattgtaggtcagctaacttcatatatactccagtttctagtattcttctattgtgttgtgtcaccttttctacactggtctccaagattcatatcgtacttcgtacataccacagtgatttagtaaagaaattcttaccacaacttgtgttttttccaaaaaaaaaatgcaagtcggaagaacaagaacatgtccattctatttcgtggtgagcgttagtagtagtagacgacaaacaagctaggtgtggtaaggcctgattcatagtgcgcagcggttataaaagaaattgtcatgcatccatgggcagctctgaattaacgtcgtgtcgccagggagaagggggcactatttcagagggtcggtctgtaacatgtagtattgccaatataattcatctgagcatttacacatgtgtacaactgtattgactgcagatcgacgacgagggaatccagtcagagacgtcgttggacggatcaaaccttttctccattgtaaatcaggcagatcactgcagctgtagtactactagtgctggagtcatgtgattatcactgaagattactgcagtccatccggttgcctccgactgatgaatgaagaatcaatcagtagcaagagcatcccaggttagttgatttttcaaattatttatattttaaaagatttaaaaaataaacattccaaagttcttaaaaaaacatactccttctgcccaactgtagggcgaggcatataaatcccctacagtacggcaatctatataacgtggcacctggcgagagaggcgtgccatggcaatttttgcaagcagccccttctcagcaataaatcgcattcccctatagcgatttatcgccaggagggaatggtatggaaaattatcacagcgcaaagttgggtgatggatggagtgtgccatgtcaattttgcaggcggcctcctcctggcgataaatcgcccttccctaaagcggtttatgaccgggagggggtcgtctgtaaaatttggcaggcattgaggaatatatttatgtaaaactttaaaattgtaatttatttttttaatattttaaaaaataaataaaaaatcaggttagttcccggctaatatatgatgaagtcaaattggaccttttccacttgtatcatcattgttgggttctcgaagccaacccatcctgctctaaatagtactccgtagggctgggcctgtttagttcgtgaaaagaaaaattttgggtgtcacattggacgtttgaccggatgttggaaggggttttttggtatgaatgaaaaaactaatttcataactcgcctggaaaccgcgagacgaatcttttgagcctaattaagccgttactagcacatatgggttagtgtagcacttatggctaatcattggactaattaggctaaaagatccgtttcgcgatttacatgtaaattgtgcaattagttttttatctatatttaatgctccatacatatgtcaaaaattagatgtgatgtttttttaactaaacaaccccgtagtattaggaaaaagtacaccgaaggtctctcaacttgttatcgagttagaaaattgtctcccaaccgcaaaactagatatatgacatctctcaactcacaaaacctttgactttaggtccttcgatggttttgatctgatgtgacggttgagtcagcgtgggacccatatgtcaggatgccacgtcatccctttcccattcctcctatttctctcgcttctttgcgcagggccggcgggtggggaggatgccgtcatcgttgaagaagccgcacgcgtccggcgagtcgcgtggccccgacaacccccacagcgggtcaccagcctccgccgcgtgccgcctcagctgctgcagcatgtacttgtgtcgtagcactggaactcgcccacctcccgtcgctcccgacgggtatcggagctcgccgttcggtcccaaccccactgtcacatcctgcgagaggaagaagagatcctggaatgataatgcacacatgcgtccatggtagatggtcggccggcacaggactgcggcgacaacggtgaacggcggcgcgacggtgaaaacggatcggagggcaccggaaggaagagcatgacgcggggaactcaccgaggggcagctcgacgacgacggacggcaaagggagcttcaaacagcgacgaggtcgggtccaaggcgacggcggcgttcgacgctctttggcggcaacgaacgggtggacggtcttcaccttggtcctgcgaatccaacggaggcgacatctaatcttggcgtcgatgggaatgccggtgaggcttggccggaggcggagtagatcgatcgagttcacacttgacagtgacagcggtgttccggtggcttgtggcttcgaggagatggttgccggcggtcttcgtttggcgagatgcggctggagcagcagccggcggcgttatgtaaatcagtgattcagtaaatttaatttgggtatatatgtgcgccatgtccgtcccgctcctccgtctcgctcgccgtagcacttgtgatttccaccgccgtcctcccactcgtcggagcggaggtgcgtccgccgccggattgtcaaacgacccccacctgcaagaccgcgggtttgtcagcgaggtcaattgcatacatgcccatgcgtgcaagctaaaactcacaggatttattttcatggcgggttgctgccaccagaggtaggactaggagttgaagacgaggatacgtcggcgtgggcggcgtgcttgttgatggaggcggcgcggacgatccggtcagcgatgcggtggcgcagcgggtgataggagttggattccaccagcaccttgccgcgcgcgttaacaacaccttcatggcgcaccaccactccaacagaggagagggaaggaggaagggagagagttagaggaaaaaggaaaggtgctaacgtggacaccttgacatgtgggatccacgtgggtcctatgctgactaagccgtcacgtcggataaaattgggtcaaaaccacccaaggacctaaagtgaacagttttgtaagttgagggatgacaatatctatttttacgattggaggatgattttgtaactcgatgacaagttgagggaccttcggtgtactttctccgtagtattatgggcttatggccacatccccgcgtataggtcgagaaatctaggcgcatacatatacgaggcctgggatttgggccccctcaacctcaagggccgaatgtgatctcgctcgctcaacttcttttcggtcccccatccccatccccatgtaagataccatagagttttaatctttgaatgaattcttggcacagcaaacaaggaatgaaatgtctaaaatcatcggataagtggctgaattaggcttggttcgatagtagtacttctagctgtagctttgcgatggtataatgtataacgatatgagttactagggtacgagttgtaattaactattcactgttaataaactcaaaaggtaagtttactttttaaaaaaaacttacataaagtttccttttagaaaaaccacaccgtataacagtttaaaatttgctcacagtaaatgagctagttgaaaaagcaaaacgtggaaacataacccttagggctcctttgaatcaaaggatttatataagtatttcatacgattcaaatcatataggaaattttcctatttggccctttgattcaaaggattgaagctttccaaatcctatgaaatttttatggaatggcacattgcatgtggattttggagaaaatttagcaagagctccaacctcttggaaaatttcctttgagtctatctctctcatccgattcctgtgtttttcatgcgctccagtcaaacgacaattcctgtgtttttcttgtgttttgtaatcctctgttttacacttcaattcctgtcagaatcctgtgttttttctattcttttgttttttctaccctgcgattcaaagggacctttagagtgtgttttttgcatggctgtagaggaaaatttgtagcgcacgtgaaacgagaaaacccattaaattaaaaaataaatacatttgatttttttaaaaaaacaaaatttatataaaaatttattgtaaaatacgtatcatttaaccgtttaaaaaatatattaagaaattgaaatgtggagttaaaagaaaagagctgagcttagtcccactaggccactactacagtcaaaataattgaaaatttgcagctacactattagttttcaaaataattgaaaagtgagtagtttagtggtttcgtgcagtgtgcggagcattgttgtacgcaagcatgcatgtgtgcacgtgggcagccacgtggcaatataaaaaccaactcgtctacatctttgagatgcagacaagagtcaatgccgttctaagaaaaccatgagatatcgtacgagtagaaaatagaattgagtaaattacataaattttctaaatattgactaagaaacagcacactaggagtaggggatatgcttcccagcggtctaaacatgtataaactgttcgttccttacttttttatgtgcccgtgatttagatcccgcgtacctcctaagaggccaaatctaaaaaagcggtttgttctgctccccgctgaaagagctcgggctccgatagatatataatcgtagttactttcttcgggttaatagtatttatcatcttgatcaaagctgatgttaaactttaaaatatttgattatatcatagaaatatgaacgatatgtatagagtagtattagaaaatactacaacaaaattgttgatatttctagttacattataataaaaaataatagttaatgctatttatttgaaacgataaatactgtcaaacctgaagggaatatggtactagtgctacacaaaagcacacagttttgataaattctacttataaatcagacctgacattttagatggtaattttatataatctgacagaaactctaaagtggataaaagaacttgtggatcttacatgtttgttttgggtttttatgattttagttttgtgaagcacggatactgtaatacctaggattatgtatcacgtgtaaagataaacttgtgattttatataacttgaacaacaacgctataagattagtgcaatttactgaataaaataaaatgcaggacaaaacatatagtagcacaagtagtggtagggggaggagcagcgtacgtgtggtttgcgacgtggtgtgcgtgggcggtgcggtgggcatgtatctgcatctgcatgatactagtgtccaccacatattacgggactattttcatctgctttttatttattcattgattgattggtactactactgctagaagaaaaggcggtttaggctgtgtttagttctttttttaattttttttaacatatacgaacatacatttaaaatattaaacgtagattaataacaaaataaattatagattccgtccata

SEQ ID NO: 50852 - DNA, 2700 bp, Oryza sativa
acccatgcaattcaaatcatacttcattttcaagcacttctctctctctctccctctctctcttttccaaattattattattattattattattattattattattattattattattattattattttcattcattcttacctgttaagcacgcctccttaataattaaaagaggtcttgaggtacccatgtaaacttttccctttttttttaaaaaaaaaggatccttgctagcttgttatgtcggcaacgcaaagctatttcgtgtcacctcagctgcttcaaacttcaatttgcattcataccctccagtccgaccggaatatatgcaaaagcaagctgcttttcattatactgcagctgcagcattgcctttcacataatcacattgcttgcttcattgattgtattcatgcgtccaatacgcgtctaataatccaatgcggtcactacctttctcgctacagctagctagctgtcacaccaccaccaaagtctctttccgtgcgctctggcttcataccattggagtccacgtttcctgctcgcacttgataatgtgtcactgtcagatttactagtataatactggtctacatttggggtgctggcactgccaactcccattttttaaagctcaaaaaatccattcttttttctgaaataagattttcttttttttcttggtttgcattagcagtatatatgcacacacactcattcctacactaacaatcttactacatcatatcattaacacttgcaggcctgtctagagggcagccatggccactgtttctgacatcggcctctccgcggctatcaacgtctcgatggccgttgcattcttgctggtctttgcttttctacgattacagcccatcaacgatagggtttactttccaaaatggtacctcagaggaatgagagacagccctgtttcctctggtgctgcagtgcaaaaggttgtcaatttaaacatgagatcatacttgaaatttttaagttggatgccggctgctctcaagatgccagaggatgagttgatcaatcatgcaggccttgattccgctgtctatctacggatatacctaacagggtctgttcctttccatcttttatgtttctgctcttctcaattgttccttgttgccatctcattttttgttccaagtcatacttgtggaaataatgccaattagttaatgatacagtgagcatttaatccaatgggtaaaggcctgcggcttcactttgttattgtttctaaacaataagagatgctaatgaagaaatgatgagcaaatttatcactctgcatttttcccatgttaatttaaacctgagaatatgaatcgtatcattgttgtcaaaatctatttgtgcctaacttcaattatgcctgtgtattgatatacctgtattgaccttttacaggatcaagatattcgttccaatatcaattttagcttcgcttgttctgttccctgtgaactggacaaatgacaccctagacagcatgaaggtagtccacagtaaaattgacaaactttcaatatcaaacataccttatgggtcaaacaggtaagcctccataaatcatttgatatctggatgcggtgtattttgatgagttgtgtagagataaatgtttctttttttggtctggttcaatataaattgtacgtaaaacatcaataagattgcccattggtccaccaattacacaaacaaaatctgtatagtgattcattttacatgcagattcaacctttttaagttttgggcggcacctgaaatccaaccacttttacttatcttcatgctgattatgcacatgtacttggtacaatttttaggagcattatcatcttatggttttgggtgatttgataaatatgccacttgcctgtgtgactgtctaatttagtaaggtacaagcactctattttggcctgtgtgcttgggacttagcagctgccctgccaagttcaatattgggtggcagttgctctggttgaaaataaattcatccacactgaacttctaggtttcatttattaatttctgttgatgctagcacatgtctttgctgttcatgatgaacattccatctgttttacaggtttgttactcacttggttatggcttatgctgtcacgttttggacctgctatgtactgttccgagagtatgagataattacaacgatgagattgcggtttcttgcttcagagaaacggcgaccagaccagtttacagtatgatcttgtcaactttgcaaatcccctctctatttagtaccaacatgtttacattggatccacaagaagggtaaaaaattgtaatattaatggactgaaactattcaccactggaaatagtctaagagattgtggctaagcattttgtctctgagcaccctgatactcactttgcactgacttggtttatattatctaaagcaatgttgtagacgggaatggtttcatatctcaattgaataaacacgatgagttaatttccttctggttggtttgttgaatgcacctcaaatgatttattttaggttcttgtgcggaatatacctccagatcctgatgaatcaattagtgagctcgtggagcatttcttccttgttaatcatcctgatcattatctaagacaccagggaatctttggtcaaaattcgtggatgg

SEQ ID NO: 50853 - DNA, 8492 bp, Oryza sativa
tttttctactcaacagaacccccttcatatattatccttttcccacaaattattgatggtttcaaatgaacctaatattaatgtttgctagtttcatgttgagattttttcccccagattctgagaatagtccacataatagcctacccacagattatttggatataatacataaatattttggttttgccaagtaacaggaaagttatgatctcttggttatctagattttcatttaaataatcatattcatatgttaaagggtctaaaaactgtctctctgtgctaacacttcacagtgctaattgctgaatgagatttagaagggtcatatccaaatttgtgtatcatatgcacttgggttttctaccctgacttcattgatttttttattcttccttatactaattactgtatttattccgtcctttttctggccgattgtctatatctataggtggtttacaatgcaaataaacttgctgatctggttgagaagaagaagaaactgcaaaattggcttgattactaccagctcaagtatgaaagaaatccatcaaaaaggcccaccactaaggttagtctgccatatggaccttgatcaatttatttttcatttcaattataatattacattaggatcttttttctttttaattctctgtccccctgttggatttttgttccagactggctttcttggctgttttggttccgaggtggatgccattgaatactacaaagcagagattgagaagattgggaaagaagtaagttgtactccctccgtaccgtaatataagggattttgactttttgcttgcactgtttgaccactcgtcttattcaaaaaatttgtgcaaatataaaaaacgaaaagttgtgcttaaagtactttggataataaagcaagtcacaaataaaataaataataattccaatttttttttaataagacgagtggcatttttgtctattaattccaaataaataataatcccttatattacgggacggagggagtagtatttttgtctatataatcattggaccattcggcattgtccattttttctgattgagttgtatcattctatgaacatgggtttgcacaatcgattcttttttaggattagtattatgtctaagcatcacacattcacaccttgtgggagtttaatttgtttacagctaacagtcagataacaataaattcatgtgtaacaacatgcaggaagctgatgagcgtcaaaagatcatgaaggatccccagtcagctgttccagcagcctttgtttcatttcgttcacggtggggggctgctgtttgtgctcagacacagcaaaccagtaatccaacagtctggataactgaatgggctccagaacctcgtgatgtctactggaataatctatccattccatttgtgtccctcacagttaggaggctgatagttgctgtggcattcttcttcctcaactttttttatgtcattccaatagcattcgtgcaatctcttgcaagccttgaaggaatagaaaaggcgcttccatttctgaaacccttaatcaaaatgtaagtgtttcttcatgtgttgattatttatactattattgcatttccatgatttattcagcgtgtaattaatttgggtacattagacatatggttatcttctgctattcttttgaaatgccctgataaatcttgttgactattgtgcagtgatgtcatcaaatcattcatccaaggttttcttccaggaattgctttgaaggtcttccttatattgcttccaactatactgatgtttatgtctaagtttgaaggattaatatcacagtcatcactggagcgaagatctgcatctaaatattatatcttcttgttcttcaatgtatttttgggaagcatcgttacaggatctgctttagatcagcttaaggcatacattcatcagtcggcaaatgagtaagtactcctatgccgccaactctaccgacttgaaagtttagagattatatacatgcttggttgttcatttgagtcttcccatcttttaataggatgcagtttatttttcctgcttcgcggatctctgtttgttgacaattgtatttttagcaattaattatgggagaacacagaaaaatctggttcttgtcggagatcactttgttcatgccggctgtcaaatagataccaagttcttaattctgttttgattagtactgtggattatatattcaggagctacactttgtttgaatatttagacacataggctaaatcaaatatgaaaaaatgggaccaatctaggaaggactagattgattttgaattaaggagggggtgaggctcgaacccggaccggctagctcgcagcttgcgttgctagccgggaaggccccgggcctttctccttaatcaaatatgtcaagcagtgaattatgatatacattcttattaaataaaacatgtgctggtggttcaaataacatcatgaactcgtgatatattggttcttaagctatcttagaaatagataaattcttttggttacagtgagttagacataaatagcaacataatgatgcttaataggcaaaaggggggccatttgttgataggctaactctgtagatgcagagattttggcatcaaggcaaacgccaaagcatgggcctcagatacttacctcgtggaaactcagatcgtatttatgctttcacgtaccgatatttatgtcctgctatttgtctgtttattttacaactcattcttcacattctctgattgaaaccaaatgatcattacaatttgcagcaagtctaaattagttcttttgcagaataccgagaaccatcggtgtagccattccaatgagggcgacttttttcataacatatgtaatggttgacggttggactggtgtagctggtgaaatattgagattgagggcacttataatcttccatttgaaaaactttttcttggtgaagactgaaaaggacagagaagaggcaatggatcctggtagtatctgttttgattggtgtgaaccacgtatacagctatatttcttacttggccttgtctatgctgtggtgacaccgttattgcttcctttcatattggtattcttcgggctggcatatgttgtctaccgccaccaggtaaggaccactgcagctacttgcgagaattttattgtgttaagttttaagtgattatgatgaactactaaattagcttgctttgtatgactatttagaccatttttccctggtttattggaaataaacttcattactgatcggcacaaacagtttccactcatgatcagtgttgctatgctgttgtgcatgtgttaagggtatgtaataatggctaagatttactaagaatatgtgcttggatatattgttttgagttcgccaacacaagggagtatgctattgtgatagatggacagttatgctagctaaaagttacatgcaataaatctatcagaatggtcatgcaactaaggggctgttcagctgcctgggatgtgcaagaacagttccccaagcacgaaaatagcagcgggcagcagcttggcctgccgaacagcccgctaagatacttccattatcatcaactgcaaagcaatttatatgaaactgcagtgatgcaattaatctacatatgattcctaattttgcgatattaattttatgatttagttgtgtatatagtgttttggtatgcttacttggttgcacatttctttgaagataataaatgtctacaatcaacaatacgagagtggtgcacagttttggccgagtgtgcacgggcgcataatcattgcattgatcgtatcacagctacttcttattggactgttgagtacaaaaggtttcgaggagacgacaccagttcttgttgttcttcctgtgttgacgttttggttttacaagtactgcaagaaccggtttgagcctgcatttgtgaggaacccactacaggtaatgtgtgacaggaagttttgtatactgaaatgtttgttttggtttggtggtaagagtgaaatttgttggatgtgcaggaagcgatgaggaaagacaccctggaacgggcaagggagccaaccttcgatctgaaagcgtacctggccaatgcgtacctgcacccggtgttcaaaggcagggaggaggaggacaatatgtcaatatccgaggatgtcgggatggaggaggtgatcgtgccgaccaagcgtcaatctcgccggaacactcccgcccagagcaagtacgaaggctccgacacgctctctcttcctgaaactgtacacgaacgatagagctacgggaatatcagggtgactactagcttgttgaattctttatagtctgtacagatagattgatacatacctactcctacggggatgttggcagatagctttgctgtacactttacagcacgagaggtatatggagggattgttcaacacccacagactgatgattggattgccaatattatgatttctttgttggtttccaactgcaactagctgtagtagtaaattagtactaccactgtaataatataaaccagctagctagtagcaagtttttgtcagtgcaagtgtgcaaccgcgcaaggttgttaacagtaaaaggagtcaagccggggaagggacgggagatgcatgaacggctttgctttgcaagccaagaatattcattccccactgactgcctgctttgttgggaacatcatgcatctctcattattatatcttcatatctcctctgctatcttctaaattctaaattccgaagtgcgtgtgcgctcatatctggtgtcatttcgagagctctcctctcctctcctctccagaaaagcacaaccaaaacccttcatatgtaggactgctacctgcactgcatttcatcctgctgctgcttgcaatggcggtacaaaagcgatggtgatgcatgtcaccatctccgagtcatcaccacactactgtcgtgcaagtaaccatcaatctccatatcttcctcagtatccgcaaatatatatactccaaaaatacataacctatgtccttggacccaaaccaacatagattcccatattttcattagcattaactttgggtcattggcattatactccttccaaagttttaggtccaataaatgctagtcttatagttttcagtccaatcacacaagtattgttttcggcccaaaatcacatgtatattgatcttgggatcaaattttcatgcttattaaacatgagccccccaaaagtatctgattgtatttttcagctcgtaatttcagtagtgtcaacctcgagccaaaaaattcataaaacaatagcctttgcttcaaattttcatgaataacttgagcccaaaacgcttgaatatttgcatttcggctagaaaatgaacggcgtttagcttttagccaaaaatttcatgagtggtaacattgaggaaaaaacacatgaatattagcctcctacccaaaattttcatgataattaaccctgggcccaaaaaattgtgtgaattttagcctccggcctaattttttttttgagtattaaacttggggggtttgaaaacacatgaatactagccttcttccgaaaatgcaatggaattcaaattctagtggctatgaacattatgcacacacacggatgcaatttttatggggtttcatgaagctagtgatttgccatggtcttcgtctctttgagaatctattaggggcaaatttgtgagtgtgtgtgcatgtgtagtagtgcatgtatcttccgtgtaatccaaaaaaattctccattattaaccttggcaccaagatacacttgactggcaagggtatgtggtttcaacctcaacaggtaacatgctcatattattttcttaaaaggtaattggagaaacgtctctctaaatctcgttttttaaatcttggcaccaacagtgcataaattctctcttttggcccgaaacacatgaatattagattttgattcaagatttcaggagtactaacttctgaccaaaattgaatgaattttagcctttgccccaaagcacatgagtattgtccttaggcttaacattgcatgagtattatccttggataaaaaaggaatgaaggaattttagctttcggtcctaaatttcataaatacttaccttggcacgaaaatgcatgaatattagtaaatacttttgccccaaatcttatgagtactaatgtgggccgaaacacatgaacaacggcgtccaacaacgacaacgacaggatcgaagcttttcccgtcaacgatgacgagggcgagcatcttcttcatcagtacagatgctaccaacgatgctttggacgacgaaaaagaagcagcaagaggcaaagctgtttgggaatcgccaacttccgcgagcatcttgctcaggattctaccatcatacatgcagagcagagaagaatgagatcgatcatctgtacttgaactgggaggagcagtgcgcagacgtacgcccaacccagctgatcgatcagccgatccatccatccattatatgacgacgacgcccaagtacacttaacaatggtccagtacctttaatactctactgagcatacaccagtgcaaaataggctagaccaccgtatcctccctgtatacacataacagcacaggcagtgcagaataaagccagcttcaaaatgtctatgccacctatcaagcatctataatcagatcaaatgactagaaataggcctgtgcgtgccaacataagtccagtcccgctttgtgtttcatcaagttttcaaaccaaaccattttgacattaactctcatccatgggatcatttccaccgcctctctgggactctgaatccttgtctccagctcctgaagcttttgccacggagtcttcaagagcctccaggaacgaagctactgtgaatttatctgtgccacaaagacacccatcaaataagttttccgaaaacatctcactccatctccagattttacaaatactaaataaatcattttcagacttgaccaactagcatcaaggatgtttgtcgtctagcagaaaaacaacgctcatattttgggcaggggtcacctccataagccattgaaagtaaaagctagactagcaaggtaaatatcatggtcattgaggtatcagttgcagaatttgtgttttttcaatacataaataaaagtttcagccacatgcacaaattatctaccgtgtatttgcgaatgaaaaaaaaaaggagcctgctacatgctgcatttaactttactgttcagtgcaaataaacgagaaatttggttgtcaatataagtgaagatgagaaggattacatttactagggtcaactccaaattgtgctagatctatttgcccagtccgcagcacctgccatacatgcaaatatcagaataaaaataacatttgaagcattgtgtcacgattcaccaagatgttcaatagaaagatgaattactaacatgggtaaacgcttctacttgctgccgcaaaggaggactttgcaatagttcaagaatatcaccagcagtccatgggccctggaattaagcaagcacaataaaatgagtggaagagtcaattgaagtaagaaccaggatgacaaatacaaagttacaaacctctggaagatatgatgccaactgttcaatgggcaaagtttccatgagtggtaacaccaaatcaggcttcaagatgtctcctaatcctaatcctgttacagcggttaaaagtactgatacatacagcaaatcattgaagaaaagtgaatcaatagagtattgtactgtaattaccagcatcagggtctgccacagcatctgaaattacaaggcgaatgcaagtaaataaaatgagaaggtggtcaaatggaagaacatttcaaaagtgacatgatttttcagctgatacctgatggctgtatagcactcagtattctctgcaggtcttccaaccgtactggcccagcagcagatgtcacctcaccagctaaatcagcagtcatgctctgatcaactaaattcccagctctgatgagaagaaagaaggaaacaaaggggttagaattattaaatggtcattaattcattatacccaaaactcaacacgcatgcatgaatgccatatcaggaacaaattgaggccacactttcatatatatttagcaggaaaaatatcagtgtgaaaataggaagaatgaaaggcagtgcacaataaactcagctagacatagatagtgttaacttatgcatgaaattggagtgaatatacttgtggtttataatgaacgtgcatccatctgttactctgacggccccattgaaaaataaagattgcaatgcaaacgtctaggtttttctgtgctgcacattgcatcttgcagttcgttaaaatt

SEQ ID NO: 50854 - DNA, 7408 bp, Oryza sativa
ggtcggtttatgtaggcattaacttggcgacatatttgtgagtcgtcatcagcacttggctcctgcacagtaaagagcaaaacacaagtaaattttagctggtggaaggacttctgtggttttcaaacagatacacacacacacactcaactgacctgcatccagaagaagaatttcctgctatcgtgcctgaacttcaagatgtaaacccttccagaagattgtgttacctgattaagttgaattacaatcatcaatgaagcccaagaggttcactaagatggtcttgcagaagaaaataaacttgaacctatattcaataccttctcaaagacagcctcctcagggaagacaatttgatcctgtgaaaagggaatcaaggatatacaaaagtacgataatttcctaggatatacacaatggaaatcaggagaaacagacacagccaagttcaaagttcaaacatacgagtcatacaagtacagtatttgcagattaaaaaatgagtgcacgatgactactaactactatctatgctcgagaggatacaacttcaactagattctgtccacgatcaagccattgaaaatgaaccaagccttcttcaccctacaaacaagtggatatgttaactgcactgcaaatccccataaaatatgagaatgcaaatggcttataagttatactggacaaatagaagtacagaacttcaattcaagataagtatgacttttagcatgcatacccttcctatgcgaacaagacccttgcgtgtgtctgggatcactcgtgttccatcaagggacatcttacccgcacgaaactcgcacatgatatcctgacaaacacatgagagattgtttttaaatagaagctcaacaccttgttatatcatagcagagataaatgagatggcaaaaataaatatataggtcattaagattctgaataagcacaagatcttaatttgagatagatcaataagcaccatgcactgcaacagaaaattaactcagttcactgaactactgaaagctcactatacacaacctacatttcttatcagaagattttcttgctacaaattgctagctaaatattttggccttttagagtgcaggcaaagattaacagaagttctatcccagttttctgaaaagaactaaaacataaagaaacaaactgcctagtatacaaaagagacatctatgtttttttttctttttttgtatcatgtacgatgaaaaactggtccaaacatggttcaggcctttgtacatattacacacaaaacagcccattaacatggtactaccaatgccattttctgtcaggctttctttaaccagctggctcacttgtcatacactcaattacttggcaagatttgcgaatagttgagaatttgtccaccacaaaagacaacctcaattatccttttggcaaagtgttgataccaaccaaacagcccataatgtcattttagatggaacttgcagcagctaaatcatgatctcaaatcaacagcaaccgatcatcgcagttaaacactaacaggaaattcggtatttgaaaaaaccaatacttgcagaaacactagaaggcaaagtgaggagtttacctgtaggggctctgtgctctccattgattaaagagtggctaccacaaggtgcaggccctaaaacaggcagtaaaaaggacagtaaagtattggacatagaacaaaatcaagcaagtgtgaagtataataggttatcagtaactagttgtcagaagtgtactgcatgccaattgagatgaacaaaaggtactgtagtctgaaagtagtagctgcctttagaactttgtgcatatgagaatgaaaacattatgcgcatgtgttggtaaaatacagaaaaatgcacttgtgaaggattaaagaagactagatctataaatttatgtacactagagtctttgttgtgcagtatttgcatcttcaagtagcacgtaggcaactgacaaattagtatttacataaagaaattcctgcgtctgcgtgcttgtagatttgtaatttgtaaggtggtttctttgggctttataagatattattactgcattacttttgtgctgctgtagtgttatttcatagtggagaaccaacgtgacccaaaaaacggcgaagactagccaaaaaccctagcagctagcaagtcgcattaacataaaactcgtcaatgattagcttgtttgcaggggctagttccttacaggatggtgcagtgttttatgtttgtttatttttttttcttacatgtagatgtaagcaaggagagcaaaataggtgggtgatctataagattttgctggtaaggacccaagaaaaacatgagcaataaaatcgattggagcagccgtcctagaaagagagatttggattggagagaggaacaggtagggcaagggagaagaaaatatcttagaaacaatggagcaagagttggtcaccactcagtcactcaccaacaagtgggggattacggaggagggctggacgtcgtcgtcgtcgtcggcggcggcggcgggacgggaggagagggattctccgacgcgatgtgatgtgatttggggaggcgatgacgacgggagggggagcagagaaggatctctcatggtgggctgggcttctcttagctgggctggagaggcccgcccacgcatttgatggcccatataaaagcccgctcggcaactccaaagacgaagttgagctagggttttcaatctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccgtgagttcatccctcttttttttttatctcatctcacccagctacccaagattctcctcctcctactattactagtgatagatgatgttttttttttctctccagagatcatatccgtcatcacaaacgatggccgcaacattgtggtgagccccttgtttgatctactcgtacaccttttttgttttttttggctctcgctaatactcactcgaattgccctgcctccgcttcgtcaggggacactcagaggattcgatcaagccaccaacatcatcctcgatgagtcccatgagagggtctattctaccagggtagggttgctcccaactctttctacgcttctttcatgctatcttgcaaaccttcaattaattttacagcaatatcaatatttcactaagctagtactatatgccctgataatccggcaacacacactttacttccatcttcataaagttatgtttacaaggcggtcatacttacagttagttactctgctaaatttttctgcgtttagaatctctaccacagtctgtttggcattttccatagagttgcctgtttgctaaggctacaagttcagccacacaatttttttttgttattccagtatgtccttgttaattgtgaccttctccctggtttgctgtcaaatgctctcattggttcactagtgcagaattctgcaatcagcaataagtttctctcatggtgcttgaaagttagttgccaacatgtattacacagtaccctttatggctaaacacagattgttttcaaagatggctctctttcatgatggttataaatgtcatcatgaagtaatgagttcatattgttgactgttcgtatctatcatcatgtctactgtcagtatgaactgaagttcgtttcctgcaaaataatgagtttatactgtaacatgttttagctgaatttgtcataacagcacctttttcttcaaggattggttcgattaattctaccttgtgcacgttcaatttttcagaagtcatattattttttgtcttcaatagttaggtattggaatgtctttgttctttatggtgcagagttgttgttctaacaatttgcaggcaatgttgactatgaatagttatatgtctcgtatcatgcacctctctattgaatatgggatatgccttcttaaggactaggggccaatgcctttaaattgtcatgcttttagtttgtggcatgtgctgttagtagtacagttgaaattttgagtagtgatgagagaaatgtgttgtacctgcaggagggagtgcaacagcttgttcttgggttgtacatcataaggggcgacaacatgtaagctatttcctcaattgtcgtttgagctgtttattgcttattaattacctgcatggaggtcgtttatggatgtgttattttgtttggtggtgtgcctaactgaagttgaatccgtgggtgatgcatatttacagcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcaggcaggtcagttgttgaagagaagaagagcatattaggagtaggtgggaggggtagccggctggtgctgctcgtctttgaagtagttgcaggtgatgaagacgccgccgttgaagcactcggcgcgggcgcagccgatcctggtgaagttgggcctgaccatgaaggcgaagtggccgcactcgtggaagtcgacgccggcggtgcatttgccggtgtccctgtcgtagaggtgctcctcgtcgccccagcatcggacggcgtcggaagccctggcgttccagccgttcctcccgatgtagaggctctcggcgaagctgttgccggtggagtggcggatctggcagtcgccgcgcatggcgtcggaccaccgccgcgcctgcctcgccagcttgttatcccacctcatcggctgcagcccgtagcgcgcgcgcagctggttgtggccgtccacgaactcccgcggcatccccttgtaccaacccatcccattggtccacgacaccaaccaccccgctggtgccgatgctgatgcgtcgtcgttgaaccaacacatcgcgtcgcccacagacagcagcagaaaccaacacaatagcaatagtaatgggaggatcatcgcggcggcggccattgtctgccgtcgtcccgacgaggacgaggccgcccgccgatccgatccaatccaatagtgctaatgggcttcttatatcctagctcatcttttgccatttgcttttcttggatttgcctctcgctcttccaaccataaacaacgaactaataatgccaatgccaagtttaggcagtttttcttttcttctctgcatcgatcatatcatcatatcgcacggccactctgtccaaacaacaaagcctaacctccccgggcactggcagggcagctggctgggctctggctctaccagcttgctgcctgcctgccgtgtctcgtctgcttctacaactacggagcacctgtttgcaacggccaacggacggaaggaatgttttttttttttgtttggcttggattccatccatcctctccggcctgttcgtgtgtacgccttgtgctaggctaggctccacacacctggacattctactctcgatcgttcgcggtcgcggggccctcttctgttctgttgcgttaattgcggccgctttgctttcaattacttaatatctgttttaatttcttcgccacttgacatggttatgagtatgacagattaatatatgctatcttttttgtaagaaaaaccgttaatatatgctagctacgactgcatatatatgacagattatatacgtagtatatacttgtggttcgcaataacgaccagctagcttagctagcggatcaatcatacgacgttacgttacattatactagtacgtgatgatcaaagaatcatgcatgtcaagctcatatgtgctttgtatctactaccttacacttgctctgcttctttaaccggaaaagctgtatggctgctgaatgatttttgctcggaaaactaactatgccttacgctttcccttgctctgcttctttaattgggtcggagtgtgtgtacgtatatatgccgatatatatgatcgatatgatgcatccagccgcgcgctgtagaccaaactagctcgatcggattcaccctccgatcgggcgattgatcatgcaccaacagctaattataaggaaacaaaacagagataattagttatatactactccctccttcccaaaatgtttaacgttgactttttttaaatatgtttgactgttcgtattattaaaaacttttatgaaatgtgtaaaactatttgtatacataaaagtatatttaacaataaatcaaataatataaaaagaattaataattacttaaattttttaataagacaaacagtcaaatatttttaaaaaatagttaacggcgccaaatattttgggacagagagtagtatttagttactcctacctatacgttgttgttgatttcgagaggcgccgaccagccgctgatcgatcgagctacgtagctatctaggaattaatatacgacgaaagacaagttaccccatactgtatatgattatatatgaaatcaaatcaatcaattaactaattaattaaatgaagatgatgtgtatataaagacctacgtgtccggatgtatatataagtattccagtaagcaacatgcatgcatatcatccatataatgaaatcatgaatgaagatgtgtgcccctggcaccgtccatacgtaatactcgtacaattaacatagggtagtagcagtacatgcagtagcttatcttgtttattatctggacacacgatcgagtcatatatatatgtgcatccgaatgcgtgtggataacagctacctccaaatcccaatcacagtcacaatcagaatcgcatgtctttgatcgagtaggatcgatcacaacgaatggatatgtacgcatgcatcacctccatcccctgtctctcccgctctctttgaccattgcatatatatatatatcttcttcttttcttacatacatatataaataaaagaataaagattatatatatatatatatatagtaaatttgtttg

SEQ ID NO: 50855 - DNA, 1547 bp, Oryza sativa
agttaattttactttgggccatgatttattattaaagtttcactttagactaccctttgtccaatctttttactttaaactagataactttatctttattgcacaataaaccaccccaagcaacatcttcaatacttcaatgacttcaaggaaattgttacctacgtgccaacaaattttcatatatatatacataccatatatttgtcgaaagagacgctagacatcactagcgaaaagagttagggtggtccattatgtaataaagaaaaagttacctaatccaaagtaaaaagattatgtacagggtggttcaaagtaaaactttaacaataaaacatggcccaaagtgcaaatcactctgatgataatgactcttactatagtggaatggactaccgataccgaaagctaccagcacaacgtaggagtgcgtggtgtgcatcgcggccattaattatgtaagctatttagagtatgaccaattgttaccttcaattctaaatccaacccttttgacataggaggtcagcaccaaccttttagcgctcatctcaagcacaccttaacaaaataatatagacgttgttctctcattttcgtaatcttaagatatctcaagcataccttaataaatttgtagttgtctatattagaatatgtcacatctatattagagttgtatttatattaaaacgaaggaaatccatatattatagtagcagaccaataagatggtctagtggtttggggtagctgggcaactttattataggtcaagggtttgacaagggtagcaagagaaacattaattttataccactgtaatacaacaactactttcaaccttaatggaacaagtagatatatagtactccctccggtttcattttaattgttgttttagacaatgatacggtctacaaaatatacctttaacattatttttctattataatatacacaataaataaatgcatgtttatttttattatagtattttgaaagacaaatctatatatgttgttctactttctttaaactatatatttttgagacccggagggagtattaattaactaattaacacatggcgttgacctcctgctgacttagaaaatgtgcgagctcgatcggtacatatacgaagtatatatctcatgctggtattacgtacgtggcgttgatatatagtagtgccatcggacatgcatgatacggtcgtggtttattttgaaataagtttattatttagttttgaagatggcaatttggcgaaagctagttccggggagtaactactgtacatgaatttgggggcagacacatgttaggatagagataggaaggaaaaggaatagagcacgcacgcggcaggaggtgattgggagtgcaacgtcgtggtcggcgcgcggcgtctgcagggtcaaaaggcctggatgatgaagccgcgcgcaacgtgtacccgtacgcacgcgccatgcgggagcgggacgacgactcgatcgaatgacggacgttatgcttattccggtgaaagaaatgcg

SEQ ID NO: 50856 - DNA, 781 bp, Oryza sativa
ggcatctggagatgaggtgagacagtcggcatatggaagtgctcgtttgcaaattgcaactgcagatagcaaaagctttatgttgttgcacagcactcattgcttctgatttctccatgattgccaagatgtgaggttagggactttggcatgagtactaccataccttctggaaggatctgccgagcagtagctgcttttggtctgatggtacaatccataccacaaccatactttcactctgttgttgtgggctcatcagttttctgtccatcctgtgaatcttccttggcatgcaactctgcacctgaatcgttggatccagttgagccagcagtatggatatcacctgtgtctggtgaagctccagccgaagcattgttgggctcagatgatgggctgacaggttcatccactgctatccctgtacccatatccccgcatgatccttcagctgcatcttctgcctgtatgtctacctggccatctcgaacatccacgtgtcgctcagattcttcagcttctttggacaaatcttcctcttcagtgcacaatagtttctcgtcttccgtgttagaatctgtttgtttacttacatctgctaagtccccggcctcctcaacagggccattttcaagagagacactttccagttgtggctcgatgctagtgtcctcaccaatttgcacctcatcagtttcctccgtgtttagagaagtttcttcagaattgggagatgaagaagggacagaggcagctaaacggtcatttattcctctat

SEQ ID NO: 50857 - DNA, 1693 bp, Oryza sativa
aaacaggagcacagaaattcagactatcgaaaatacatttatacttgctggacatcaggacacaacacacttgttatactagtactagattcgaaatcttgagtcacttaactgaccacaagtcttaaggacaaaccatttaacaatggaagtattgaacatgcagatcaaatgacaatacaaataacagatgcagcctaaagtcctaaacagcattttaacatacctcatcatctcgttcaattacttgtgcctgcaataagcaaacattgacacattactaacatgttccataatgctagagaggactatatcagtgaaggtaataagagcataagacatcagtgcccatttcctcaggtatgtaaattctagcatgctaccaaagctcaggctgctgcaagttcagacaatcacctcttcaatgtcatcattgctgtacattccataccggaatgcctggctcaggttattagcaagtgccgccacatcatagtccctgtctcggaagtcatcatcatcgctatccctaccacgatcatgtagagaagtcggacgactgcagcacaaagcattgatagccaaaagtcagcgaagacaagtgtacgcaatcacaaaagcatcacaaaacatggtgataacctacccacaggcccaatgataaacgttctcaacctcattgcgtttgaccagggcagttgtctgccattcaacccactcgctgttctcctgtaaagacattattcaccaagttagctaattaataaagtttagatgatattatgcacaagaagtacatcatgcaattgctaaagtgataggctaacgaaagaagagaaactcaaagtacctgcaaatgagactggattatgctgttgctatttcccagttgaataagcttattagctattcgagttatgtgcccaatattcccaatttttggaggcaccttcccttcagatagtaatgttggctgcacatagaagataagaatactcaatatacaggaccctgtgtatatctggtcttgcaacaaggggtatgaaggacataagaattcaggaatagattactgtgttagattctgttgacagggaggaacttctttcagcagcaagaattttgccaacaagattgcattcattaagggcatggtcaatcagctgggatctattaacttccagacaagaaatgataatactctcgacatgatggtgcagaaagttattgtaagggtacctgcagcacgaaccaatatgtgatgattctcttgcaattgttaggaagaagagcacataaaatagccccacttactggaagaacaaatcaatggaacgttttactgcagattggttgattagctcctgttccgcagtttcactaccaatcgtcagcaaaacagagatgaattccacaatctgggaggaacaaacataccgcgcattaaaaccaaaatggaacaggaaaggactgtgaaggaacatgtcaaaagaacagaaatgattcattggacattgcaagcctagactaacaaaagagacttatgcaagggacacgatagttttagaccatcagaactcaattgcatgcatatatcagaaattacttcgccagaaatcccgaggcaagattaataaaagtaagtcaaggtacccataagcaagatttttgctttacgtcaaataattagaaa

SEQ ID NO: 50858 - DNA, 793 bp, Oryza sativa
aaagggagagtgcacagaagcttcttcatttacacacttgtccaactttttttacaacagggaagtcacagtttgaaactagcgaattatcaatacattcttatccaccccttgatccatttgggagtaatgtggagtcaacctctgctatgacttgcaaaatgaaaacctccaatgaaataagaaatagaaaaaattaaataccacaaactaaccaggacataacagaaaatgatcaccgaaacaaacaagggacacccaagaagattccaaaaggtttctaggggatactaaggcaaaaatggtcacaggagaaactaaagcaaaattaagtggttatcgacaaaacactagccccggatgtaacggcaactgctatgaatgtaaaattgttctaaaagagtaaaggactatgcaaggcgccaaggtagtcgtcagccactaataagcaaagagcttcaactcttgttagaagccgagtgaaatcactgacatcatctaatataaccaaagcccttttgtcgataaccgttatttcttaccgaatttcaaactgttcacccatcactctgagagtctgagtccaagtatatatacaacaattatatatgtttcttacttctgtaaaaagatatcaattaaccatcaacatctattttataaagcaccttccgactgtctaattggataatggggaaacctaaaaaataaaaagctttctatgcattagctccttggaagaccttcatccacactttttgcctactatatatgtatcaatggttaatatgca

SEQ ID NO: 50859 - DNA, 1619 bp, Oryza sativa
tggacacagaaatggagagtagcctagtgcaaatgagtgacattggactatttatataaaacaaatgttcttgtaggaagatgaaatggatggtaggaatcgcaagaaattaaacttacgacatctggaaagattaattggaagtttccgacactcaattgcaccctacataacagttagtgtagaatggaatggggagaacaccacacacccaatgggaggggtggccatgtattaatataggaagcacatgtacaggatcctcaattagaggagaatacaaggaaagaaacaatacaatacaatctgtacatatatggcaaagtattcctaatacccgcccgcagtcacagcgggaggatcacggatgcaaaggctggatcgaaaatctgtaaataactgcacaggcaagcccttggtcatgatatcggcgaactgatgcgtagatggaacatggagcacacggacctgtcccagagccaccttttcccgaacaaagtggatgtcgatctcaatgtgcttggtgcggcggtggcgaaccgggttggcggtcatgtagatagcactgacgttgttgcaaaagacaatggtcgtggtggagatgggagcatgcaactcctggattagctagcggagccaacagcactcgacaaccgcgtgagcaacgacacgatactccgctttagcactggagcgggagatcgtcgtctgtcgcttggaggaccaagacaccaggttatcaccgaggaagatgcagtagcctgaggtggagcgacgagagtcggggcagccggcccagtctgcgtcggagtaggcggtcagagacccgaccggaccggtgccgatgtggaggccggcggagagtgagcccttgatgtagcgcaggatgcgtttaaccaaggcgagttgaggctcgcgagggtcatgcataaaaagacacttgttgaacggcataggcgatcttaggacgggtgagggtgagatactggagggcaccggcgaggctcttgtactcagtaggatcggcaacgggggcaccctccgaggcggagagcttggcgcgagtatcgactggggtggcggtggggtggcattcagacatgccggctcgctgcaggagatcgacggcgtactgtagctgggacaggaagaggccgtcgggtgtgcgacagacggagatgccgaggaagaagtggaggtcaccaagatccgtcatggcgaactcggtgtgcaaccgagccgtgatgtggcgaagaagctcagcggaggaggccgtgaggatgatgtcgtcgacgtagagcagcaggtaggcgaggcgatcaccgtcccggaggatgaagagcgatgtgtcggaggccgatggcgtgaaacccagctgacgaatgtatgtagcgtagcgaaccattggtaccaagctcgaggcgcttgcttgaggccgtagagggagcgctggaggaggcccacagcatcgggagcaacggggtcgatgaagccggacggctactggcaatacaccgtctcgtcgagggtgccgtggaggaaagcgttcttcacatcaagttgatgaatcggccaggagcgggaggtggcgatgctgaggacgacagaatggtagaggg

SEQ ID NO: 50860 - DNA, 12034 bp, Oryza sativa
cacccgtgggcagccactgctcgacgttcacagggaatggagcgtgcggcaggtgcggctgctcaacaccagctagtggtggagcgaccacagagggagcaggagcatcctgcagtagaaaatccaaagaggaagcatcgacgagatctcccgaaaatggaaactgtgtctcatcaaaaatgacatggcgcgaaataatgatgcggcaggtggatatgttgaggcagcgataacctttgtgcgaggaggggtagcccaaaaagacgcaagcagcggagcggggtgcaagtttgtgggcagcggtggcactaaggttaggatagcataaacacccaaacgctcgtaacatggaataattgggaatcttgcgatgaagaagctggaatgggattgagttgtttaccgaggacgagggtcgacagttcaggaggtatgtggcggtggctagaccttcggcccaataggagggtggcatggaggcttgtaggaggagggtacggacggagttgttgagggtgcgaatcatgcgttcggccttgccgttctgcggggaagtatatggacaggagagccgtaacagggaacctctaccagcgagaaaggaggtggtgttgtgattaacaaactcggtaccgttgtcggcttggagacacttgaggcggtggccgaactatgtgtgggtatactcaacgaactcaacaatatggcgatgaacatcggatttgtggcaaagaggaaacgtctagcaaaaatgagtaaaatcatcaaccaacactaaataaaatttgaagcctgaaatgctcataacgggagaagtccatacatcacagtgcacaagttcaaaaggagaagaggtactggaggtggacttattaaaaggaagacgagtgtgtttccctaactgacaagcatggcaaagggaattatttgtcttggagcgaggtatggcggataaatgttggagagtggtgacggcggttggacccggatgaccgaggcggcgatgccataacgtggaggaggtggcgaggttgcagtgcgctgcaatggaaggtgcagcggtcgggagggtgtagagctcgccatggctattgcaatgaagaatcacgcgccgggtccgagggtccttaatagaaaaaccaaactcgtcaaactcaatggaacatttattgccacgagtaaattggcgaacggagagtaaattgcgaaccaaagagggagcaacaagaacatgacgaaggtcaaatctagtggtgccaatagggagaaaggaagtgccacggcaaacaaccggaatggagtgaccattactaacggtaatataagtttgtgagttggggaggcgagtaacgagtataccgtcggtggaggacatgtgcgaagtggcacccgtgtcgagaacccacgagttggggttgtgaagcgttattccattgagagcggcgacaaggctggcttggtcccaagccggctggacagaccctgcagacggtggcgaggagtatggcccggcgaaggtagtgtgagcctgaggatacggcccaagtatctcggcgctgggagcacgccagggttgctgctgtcctgcctagggcgagaagcacacccatggtgcagcttggcatggagcaggggcagagaaagtgctggtgccaaagctgttgctgccgttgttctgtccaccagggcgtccgccgaatccaccgccgccgttgccgccggagttgcggttgttgttgtggccgccgttcttgcccttgttcttgccgctgttgccgccgccggcgcagttctgctgctgcccaccgctgccagaggagtggcaagtgcccccggtgcagttggagtgggcctttttttggagtgggcgttgttggctgcgacgagggcagtctcggactggacttgtaccgagttggcgttgcgaagctccttgagaactagtgtgttcctcgcagaggcgaaggacggcaagacaggggcgctcgcgatgttgtcggccgtgctggtgaagcgcgagttgacgccgcggaggaggttgaggacgagctgggactcggtgacggggtggccgacgtcgtggagggcatcagccaccgtcttcatgcgctgacaatagtcggcgacggagagatcgccttgggtcatggagtggaactcgtgatgcagatagatcgcgcgaggctccttgttggcttgaaagaggttgtcgatggtgatccacaagtcctgggccgattgattaggctccatggcgaggtcgaggacatcgtcggcgacggagccgaagagctagctgcagaggcagcaatcggcctgttcccaggcggcgtcggggttggtgggaggagcagcgtcaagatgatcgaggagaccgaatttcccacgcatcgagcggaagaaggccttccacttgttgtagttggggttacgaagctcgagggagatcggaacatgggacttgacggcgatggtcacatacgggttgacgaaaaccggggcgacggtagaggtggaagatgacaccgtagcggagtcggtggcagcggaagtagccgaggaagtggatatggtgagggaagtggggcgcggcagccagggaggcggcgatgctcggtggacgcagcgaccagagaggaagcagcactagagcagcggaagaggagaagaaaacttagaatctgataccatgtagaatggaatggggagaacaccacacacccaatgggaggggtgaccatgtattaatataggaaggacatgtacaggatcctcaattagaggagaatacaaggaaagaaacaatacaatacaatctgtacatatatggcaaagtattcctaatagtttgtactgaccaaatcaagtcagtgtggtcatatgcatgcaggcatgttggagtaaaaaagaaattaattgtcagtataacagcgtgtgcattgactgagtagttgcaatttacccaagtattgtcacattgtgacaatcacaagtagtaatgactaattaacagtggaccaaattaaaccgtgttccgcggctcattccttaatctgaagctagctaggtaaggttgttcttcctttgcaggcaggcagaggaatatatggcacattcagaaaggtgagatcgatgccacgcattcatgcagacacatcaatagatagatagatagatgtacacgcacgatcgactcacacacacggttcaaagaggcacatccattcatcagtcgaagtctgaaaaggaatcatcagtcgttgctgcatcatatcatatcatcggttattcagagaccagaggagtatatataagcaggtgaggccggcaatgacgtggtcagcactgacgagtcgagcactacatctctcgtccaacgccaaactctctctctctctctctctctctctctgcagatagataggtagatccgatcgcggcgaggaagatcgatgagtcggatacacccttcgtatcaacgccaagatgccgccgccgccgccgcctcaacggcagcgccgcgagcggcggtgtacacggtgtggaagaggtccagcatggggttccagggcaccgacggcttctccgtctacgacgacgccggcagcctcgccttccgtgttgacaactactcgcgccgccgcaagctcttctccggcgacctgctgctcatggatggacatggctcgcctctcctcgccctcaccccacaggtacacttgtctctgatcttctagtcattcatgattcatccactgcaaaaatcttgcatttgcatctcagattaattaattaattaattaattacctcctataggctatattcatgcatctttgtctttgtgattgtatactagtattacctaacacctgacaatcagtataatatttacgtacggtttcggtcgatatattgagttagctattagcattcatgaacgatcgtcgatcgatcatcaattcttcatacattcaaccagcaatcgtttatattctgctcgtcaatcatcctcatccgaatgtagacttcattttacatatcttctctcaagatatagaacgatcaccaagtttgcttccaaaacttcactgaagacttctaaatactgcaaatcctgctttgccgagagccccgagactagtgtttcgtccatctacccgatctttcatcttctcgatttttttaaaaaatgtatctccaggctttcactgtttcctcaaaatattcaccaaatcacaagtatatatgtttgtcttgtctatttgtctcacaaatactaaaagataccatagctcaccaaaaagatttaaggcaaattatcatgcatgccgacggtttttaggcaaatgctatcaactacctccactaatacatctagctaggaaaataattagtctaaacacttgcagacaaaatcagctgaccaaagattaaaattcattgctttcatcgttccagcctcggttattttgatgctgttctgctttaatttgcccaaaatcccatacagagttaaaaacaaaacttaaaaaatggagaagttacatacagagtttgatttatccgctagttcattctactttccgactgaagttcttttacctcttgttacaagtgcagcagatgggccaaaagaacagaaaccattaatagaacccatggggagtaagtaagaactaagatttttattttcctttctgctgttgcaacagattatcagcatgcatgaccaatggaattgttacagagcgtcagaagaaggccaaggcaagagggcaagatcacaacaactcttctcaatgagaaaatgctcagttatgcaaagcagtcatgaagcagaagtgcacatgtcaggatgtacccatgcgtcgtcagatcgtactggccatgttcccgccttctcaatcgagggcagtttcaagagaagaagctgcaagatccgcaacagcggcggtgaggaggtcgcaaggataacgaggaagaaagctggagcagcatcattgtcactgactcttgctgaagatgttttcagtcttgaggtccaaccgaatgtagattgtgcgatgatcatggctttcgtcattgttctggatcggatctgctggaagccatacacacctatgatctgttcttcatagttcaaggtgatgagctctatttgacatgtaggaaatagatgtttcaattcaagtgaaatcgacgaattaactcaagaagctagtatgagactgtagtcactaattgtactgtcgattgactgggactaacataacatgtaacttgttctaaatttgactacttatgaaaggaagatcgaattagcagattgaatcaaaatctcttgcttcctcctactgcaacttgaaatgtatgtttcttttcccatgtggttctttcaatccacttgttaccaactgtgagctgttaccaactgtttgggcagtatcattttaatgctatccacctagaagcaccataagaacaaagcactattcatgcccaggacaatgcaaaggacaaaagtgaccaaagtttgttgaatcctaaaagagaaatgctcaaaataatagaatcaagatataagcaatgacttcagctacctttagcagtataaagcaagttgggtatactcacactgaagaagaggcaaaactagtgtcctccacgaagagagagccggagaaggagatggtgggtatccatgcttacgtgttactcaatttcttcaaaccagcacttcgtgtttcatttgcattgtacttgtgcttaagatttgcagtccctctcagaaagattcgaaagatattgacaatatactgcaataagacagcgttagtttactaagaaagttttgtttataccaaatattagaacaataaatagtatggacaaatcccaaggaatattacaaacaacttatttgtcttatactcaccagctttatttatttaagccacttttgatttgtttgctagatgcataaacaaacaaagcatgaaagcaatatggtaataacacatatatatggttattaatacggagttgacagaaggaataaaatggtttctcatcagcaaggaacaacttaacagctaagtatataaattgaaattaatagtttgaacaaggtggaacaaattttagcaactctgcagaaatcattgtttgacttttgcaaaatctaagtcttctatctaacttctgatcactaaagacggaaccgcgacaaaaaagttaaggatgcacggaaggcccattggtatattcacaagttcacataatgcattctggaagcgacatgcacaggatacattctccaccatgagaaaatcccctgtgtacccttgaaagttcacctaatcccttctgtacccctgaattttgctcaatcccttacatacccctgaattttagtttggatctcttccataccctttccactagttgaccgttagttgaccgttaaattcttatgaaaaagtccattttgccctttggtataaagaagcatataaattaatagagtatattgttggagcatagaaatttgttatatgagactattatgtttatgagatagttatgcaccatattatttgcgataaatatacttttagatatgacataaaaaattaatacttatttattagttattaaaagattttttttagcatgtgttttgaagtaataaacaaatctgttgtattactatgaaaacacatatgctacataaaagacttttaataactaataataaataagtatcaactttttatatcatatgtaaaagtaaatttgtcacaaataatatggtgcatcacatactcataaatataatagtcccatccaataaatttttacattccaacaatataattcattaatttaatatgtttctttatagcaaagggcaaaatggactttttcaaaagaatttaacggtcaactatcggtcaactagcggaaagggtatggaagggatccaaactaaaattcaggggtatgtaagggattgagcaaaattcaggggtatagaagggattaggtgaactttcatgggtgcacaggatacattctccaccatttaagggttcctttggaagacagaaactattcaggaactttacatgaagcaattcatttcccgcatggatcaggaaataaagtcccatgttgcagtggtcatctcaacaaaaaaaaaatccataatacctcgtattatacccccaaaagctacataaacagtactgacacagcttttactcatatgcattatattctgacatgatatatttcagatttcaaaagaatgcccttcgaatagggctggtgtgatccgtactacttggtttatcatttacagaagtgttctttgtacctaatacattgagcatctacaaaggaataaacatattatctggcagtaaaatatgtacacaatgcaaaataaatgagatgaaaataaggagttcaatattactaagtaacggctacacatatattacaacagaatatcaggtagtatgcacaatacgattagtatgatcatctgatataaaaacacaacaaatcagtgtaatatgtaaaatgcagctgtgaagctagctgaatgctagaggaatagtgaaatccacacaaagttaagtagtatacatagacattttctaggagaaaagagcacgatattctttggcttcttgggccatttcttccatcgttctatcttttctttcaatatccaggtctaatgtctcgttttttgcattcatctgttatgaacagagagattattcagatttatttgatggagtatcagatgaagtgagagttgttccaagcagcatcactaaccatgccattattgttatcattgttctcaaaatcttccttccttcggggaacgatgtgaacgtgaacatgtggaactgtttggccagagtgaggtccgtcctgataagtagcaatatttattcaacttcatatcatacacaatagaagataaagttagttttcattagcttttacaacttttcattaaaaaatgttacgaacatactaaattgtgatctgaaaccacaattttgtgagcaacatcatacttgtcatgctcacacgaattttagctataatatttcttaaattcaaagtgaaagacctcacaggtacaagataaatcgaacctgaattgtgaatgtgagcgaagaagccctctggtactgctcaacacgtacaccaatatcctttgccatgatccacaaatcacgagtctcatcagggctaagatcagcaaatagtttcacaagactctttgggcatataagaacatgtataatttaagttaaggaagggggtgggggggggagttaaaagtcttaggctgtcaaaaatgcagtgccacatacaatccatcataggacaaaggcaacaagagctgagttgccagttgtcaccagggattaactgaagtaattagcacgaccagaaattaacaaggtaaagcaggtagtattaattgtcttgaaatagaaagcacaataacccttctgaaggcaaaaacaagtgagcactgtgatgtacaccactaccatttttcaatgaaccgatatcgtacattacttatgtagttcagtgcagagtctttctttctttcctttttttttctttttgaaacagaggcacatttcattgatgaatagcaagagaagttttttttttttgcaaataataataataataataataataataataataataataataataataataataataataataataataataataataaagtatgagaagttgagagcagataataccgcaatgtgaagtagatactagaaggcactaaattagagagaggagtagagcagctgtgcatacacataattggcagaaataaaggatatgacctgcagggacaagattggaatagaatgatgaacaaacaaagaaggagagagcaatcaggaatgatagatttgttctgaggagaggagaggagaggagaggagaggaaatagctaggtaccagggcgggtgggtcggaggttgacgatggcgaaggagaggggcgaggtgcggaacacctgccgctcggctatctcgtgcggaccaaacctgtacctgcttcccgcgaccggatccatctccttttcccctcttcttggacggcgacggcgatggagagggagaagaggaagcagcagagaagcagctgagttgcgttgggtctaattaattgtcaatggttgtggaactgaggggccgggtcaagtcaagtcaatgatcttgatgggctcccctcccacggtagaagccaggcaagcccatcagaaatactacgtactattcaaatcaggcccattaattgttgtcactttctctatctgaattggtcagcctgcttgtgctttgaataagtagtagggcgatgcatgcatgccagctccttcacgctaagccaaatcccaatccaacgtgccctgcactatctgtccacaccttcactcccattcgttcctacttgcaaaattaagctgcatgtccttttttttcgccggcccatttcagctgctctcactctcacgcattaataattaacccaatctgcagactgcagtgcaggcaaagctaggcagccacgtacgtccatacgttgcgttgctcatcgattgatcgatcgattagccatctaattggcaaaaccaaatcttgattatttgctagcttcccctagctaacataagctatagcctatagcttcctccctccctctcaaactagcttagttacttccaccagcctcatcaagctatagctagcatgagaaggatacagatacacccctcacatggcggcggcggcggcaccggcggccgtgcacgtcgtcaggcggcagatcagccggtggtgtacacggtgtggaagaggtccagcataggctttcagggcaccgacggcttctccgtctacgactccgccggcaagctcgccttccgtgtcgacaactactcccgccgccgcaaagctttcgccggcgacctgctgctcatggatggccacggcacgcctcttctctctctcaggccacaggtcgatcaccttctcattcacttcattacttcttctctagctctactcgtatacgtatattatatcgctttagcagcgacctgtttactgatcgatcagtttagtttgctagtttggaatcatgtatatatcttaagataggttgggacttgggactagcgcgtctttaattctctttcattcatttctcactttaagtctttcctatcataatctatagacgatggccgtgtgcttactgcttctgctttgctttcagtccaaaaatttagggtacttagataaagaaatttcagggtatacttattagctgcaagatttatataatctatcaaactaacaagatccctattatatacatgcgcatcaagtttaaattctcaacttaaaagattcagtcttattatttgttgctttgatcaaagctttgctgttatattaatcatgcagccaaacatgcattacctattcgaggctggaatccaaccgttggatttacttttgcttaatctcctatgtataaaattatcgctttgcttccttgtttccgttctctgatgatttgattaaaaaaatccagttgtttgagtactccaagtctcaaccgacaaattctactgtactcataatcgtcctaattaactcttaaaaatcttttatgatagatattgaccagtcaaaacaaaggaaaaaaaatctatactagtatgttccatgcgtcattctctataataattgaaagatattgtactactgataaaaacatttaattaattttagtctattgagtaggccgacatgtccaagcaaaatgtaaccaaatccaaaaacaagcaaacaaaatgcttgtatcataataacatgttatatattgtttttcaacctttatgtgcttcacattagatctctccatttgcaacttgcaattttcagttaagtgacaaagaagtaataaaagaaacatgatctgcatgattcgttgtcaacttttcttcagccgctatttttgaactaagcaatgtaaaaaacagataatcagcgtaaattaaaaactaatcttcattgctctaatgtgacagattctcagcctgcacaatcgatggaactgttacagagcacaagaggaagaaggcttggacagcacaagttctccttcagtgtcacagcagcaagtcttctccatgaggaagagctcagctctgcagagcaacgatgaagcagaagttttcatgtcaacaagaacaagtggtgacagccaacctgatgcttctcccagccccagcttcagaatcgacggctgcttctccatgaggagctgcaagatccgcggcagcaacggcgaggaggcggcgcggatcacgaggaagaacgccggcgtgatgtccagaccggtcagtctcggcgacgacgtgttcaccctcgtcgtcaggccaggcgtcgatgttgcggtcgtcatggctatggtcgttgtcatggaccgtatctgccggaggccctacacaccaatggcgtgttcatcatctggaaattcagtagttcatagtggagaaatcatcaaatccaaggaaaaataccatctaaaccgcagtagtagtagtttgctgtaaattttatatattgcagctgagatgtaactaaggttgtgctaaattttgtgtatttgcaactatttcacatgaagaaaatttgcgaaaagttcaggctttataaagagtacataatgtgagtatgtgacctcagagtgcacatttctagcaagagaacgacaagcacttgctattctgagtggatacctgaggcactatattttttgccgaaagaactacttttgcatttgcagatgagaatctcctgctgatggagatgaagcatgcatactacctaggagtatatattccagcgaatatttgcaacaacgtactcaacaca

SEQ ID NO: 50861 - DNA, 4100 bp, Oryza sativa
acttatggcatatatgcataatcaataattctgttcagtgcatcttatcatttcaatggccctcttgatagcaagcatgatgcaaagatgaaaatgaccaaaagtgctcaagtcccagaaaaaaaatcagcaaaaagagattaagatctaaccagttatttgagctatcttccagaatgtatatgcgtaaagcaagcacaagagttaacaatggagactaatcaaaatcagagcctcttatgttctaataacattagattaaatgggattgatggaacagtcccttaaccaaagaaaagttcacaggaggcaaaaacaagcagcaaaaagggtaaaaaccatggttcatgtttttcagaaacataaagactacactacacaatgatacaaaattaaagtagtattttcatggttcaatcagatcattaaagttttcatgatcttatcagaaaagtgcgccagaatgatataaagtttagccaggattacagccattggccacaaattgccagaattattgtattaatgagtcaggttaacttttcgaatgttggctagatgcatagactaacagtaatggtagatttcatggacagtcggcagaaggaataaaaactttgagtcggcacaaagagctagatagaaagttgagtcatgatccatcctgtctaacaaactttcagctactatgccttgtcgaatttctggcttttctcacaacaaaacatgccaaaaacagaatttatcgcagcaatctgcataagcataagagaacaaactttctaactagcatgatcaaaggaacaaaatactgtgtctgaataactaaagagcaacggaaatctcaagaaaagtcaatttttcagctgaaactaaatgcaatgggttgatagcatggattgcaactctgtttgatccaaaagaccaaaagaatgatccttctttcttttaagcaggctttcaaataggtactgaaaggttatacgatgggttttgttactatttgtagattgtgaaaccatagtatgacccaaccagctactgataatatatggctgtgtaatttcatgtggtacagggacatctgtcataaaaatataaattttccaacaaacaactactgccacacggtggcataactagttccaaagataaagatttataagtaagaacacattttacaacaaacaagtatcacaccaaattagataatttcataatattattcgaagacttgaattcccatgatggatgacaaacagttacaaaaataatttctggagaagagagtgcaatttagagacagtttacaagaaagttatcgcaaaaatacatctaagagaagagagcacggtactcattggcctcatgagccatttcttccatggttctatcttttctctctatgtccagatcaagtttctccttcaattccctctctttgacatcaatctattagaaagcaaacaagtaagaattttgtggtaaatattgggttgaagtattggataaaaggaggtcgattgagaaaaatgccacaaaccgcatcatatatctcatcatttttctcaaaatctcctttctttctagggatgacatggatgtggacatgtgaaacagtttgaccagcttctggaccatcctgtaagcactggaactaatgagtaaatagcttaatattattatataagaaaataattcaagacagacatgcaaagttatatctagggtaaatgataaaaaggaagttaagaatacttgtatggggaaacgaattcttttttattctacacacaataagatcatcatatttaggacgcaataagcaaaacccatatggtactcctcttgatggtatgattaaacattgaaataattaaaatacaaactcctgctaaccgcagtggcataaatacatagaccttacctgaatagcaaatgtaagtgaagacgctttgtggtactgctcaagccgtacaccaacttcctttgcggtaacccataagtcactagtctcattagaacttagatcagcaaatcgtttcacttcacgcttggggcacactagaacatttatatattgttaagggaaaacaacatataagatatatcatattctcaatataccacagtagaaatcaaaagaagatggttaaccaataaatttatggaagatttgctcgacacggcagtacaattgacagttactccatatcaatcacaaccaagtagcagataaatactacatatggacatcatctcatggtaaagatgacatcctctaagatgatcaatcaagtaagatgacatgtggcaaaataaacacctacatcacctcttcagccaatccacaaaattgtccttaagccagacttgatatttgtcaagtatagaagaagggtaaaccaacacaatcctttcatgaataaataaattccacaggtccatttatttactattaatttgaatgcattgatgaaactttacccaaacacaagccagcaaaagcaagctcattttatcgacgaccccaacagaactagctagcagtgcatgcacgtgaaagaaatcaactgtgattctgtaaatatctccaaaacagcgttttgcagaaaaagtagcagtctcttttggtgcaattgaaggatatgacctgcacaataaggaacggtatggttaagaaagaatagcagaatatgaaccaaccaatatatagcaataggaattaaatgcatgcagcaacagcaaggtcaaagttgacggaatcgcatatggtatagtggtgaaatggtactgtattaaggtgaatctgttaggtagaagaagagatcaattgcagaaaaacactactatatgtgaacagactactccctccgtttcacaatgtaagttattctagcatttctcacatttatattgatgttaatgaatttagacatatatacctatctagattcattaacatcaatatgaatgtgggaaatactaaaaatgacttacattgtgaaacggaggaagtagctagtatctgcgtgtacattgtgcttgttaagcgtgttcaagaaaacaaaaacgtgcttgttagcatttggcaggtaccgtatgattcgcgaactggtcatcaaacaaattagcaatggcaagctacaaaacccgtctctgtaatttccgctacaaatttgggactgtactatggtactactcctactgagcaaggggaacggaggcggctggagggaataaagcgatcaagtggtaaaactgggcaaggggaagtgaggaggttattaccagggaggagtgggcggaggttgaccatggcgtaggagagcggggtggagtggaacacctccctcgcgtcgatcttgtacggcccgaacttgtaagccgcctccatctcctggaccggcggcggcgaggaagaggaggagatggctcgcggcagaagcagtggacgacggcgaagaagggtaggaggcggaggcggagcgagagggagagggagaagggagaagggagtgggcgcgcggcggaggacggcggagagcgccggaagcatcagctgccgtctcgtcggcgaacgaatcgacggaggagaggaaagcaatgtagagttgttctgggcctaaaattaaggtgggcctgcatttttacggcccatctgagcccatgttgttgtctggaccggtccaaagctgagtggtgctaatactcctactttagccctctttgtttagacttagacttattggattagacttttaagtcagcttattggcttatatgatttataagccggtggatttaatgtcctaagtttagtggtagagtcatacatcaacctcacataagccaaaaaagcttctccaacctagcatttggcttaatagtgttagagtggcttatggcttcaaaaaaaccaaacaaataagctgcttgtttgtttaggcttacaccttttggcttataagttgacctataagcctaaacaaatagggccttcaaataggctcacccaaaaaaaaatgcaccgtgatgaaaatgtaatcatgtcaggttgacttgctgaaaaaagtgaagtggatagagtgatgagagtg

SEQ ID NO: 50862 - DNA, 24827 bp, Oryza sativa
  unsure (1)..(24827): unsure at all n locations
tagccagcatccactgcctgaacgaataggagttgtcatgcaaatccactgcanatttaagtgaagtgatgatcgatcatgtgcgtactttctaaagtagtntgtgtcatggatatgaatatgatgcatgcacctgtgaccgaaaagctaccttcactttgcaggcatatattggcattgtttggtgacttgacattaaacaagttgctgcatgctcatcagctttgaaggagtaagagataagtcaatctacaaaggtgtttatacatatatttttgtttatcttcaattgttcatggtagtgcttgctgcgtaggttttgcaatgatcgcctgattattattaatctatctatgtactctctctctctctctctcactacctacttgcacggatcaatcgctgtttgacttcatttgatgagataatactaatgaactagtgcaagatagtgttcagtcaacagcaatggagataatactatttttatgaccttgttcaaaggtttgtaattttccattaagctagtgtttacaaagcaaaccactatatatgtgcacttgttacttagagcaatctagctagctagtgttatcatatcatattccaaaatccttaaatcaggttagatacaacagaaacaaaaacaaattcagaaagctgccagcacaacaaccacaattattttttactagctacgatcagttgtgttatccaaaccaaagtactagtataacatttcaggctttcagcatatatatgcttgctacacctgtatccccatttttgccctgaaacaaacaggaagtactaaacatgatagtatggcttctagcctaattgcactgtaatcggaatgataggggtgaactgtgcaagcacatgtacgtagcatgtagtagcaatataacctgaaagttgtggaaaagctatatattgggacattgcagcttcactgccactactgatcgatcatcacaaccgaaaaagaaaagattttgctggatatttaactatatacactcagctaagctggagtgaccacatgggccagtttggatggtgtgcttttgatgatgttatgtattccctcccaaacctgcaagctgcatgcatgcctattctgtgtcttaagcaccttggacaagcaactaattgaacagctcgcacagagcaatcggcaattgcaacattccaaattaggcctggtttagttccaactttttctttaaactttcaactttttcatcacatcaaaacttttctacatacacaaacttccaacttttccgtcacatcattccaattttaactaaacttctaattttgacgtgaactaaacacacccatatcaacaatgaatcaaagttgtccatatgcatgcatgacctagaaaatgccaagatctctgcaagagacagcccccgtgcagtccaaaatcaatctagctttaagctacagttagagtttgggttaatttgtttggtagcgaaatatcattcgaccatgacatgcatgtggcgaaccatgcatatgcagtttgcaaaaaagatagctacatagcgtggatggaatacttcaaaagcatatcaaaacgatacgatatgcatggtgtttcagtactacaatctttcaagaggaaaaacaaaaacttcatgtgggggcagggagctgcagatgcgtgcctcttcacttccagagaaaactaatggtatgtcagttttaggagctaatacacactgccattacatgtgttatgataaggattttaagccgtttgcgaagacaatttaggtactgctccctctaggttaatactaatacttattgttttgagagaaaaacacggtctaaaacacaacttcagtcactgttttatattataatctatatagaaaaattattaaatatatgattttatatatgatgttattataatatacctagtcttcatatttataagataaatattttaaaaattatttatagttaaaaaaatttataatttgataccaaactcattcaaaacaataaatatcactctctccgtcctaaaatataagaatctagtatcagatataatattttctagtactacgaatctatattagaaaatatcccatctagttttacgtttttttatattttgagataaagggagtatcaacgagagatgtatgcttagcaaagcacatgacttgagtgatcagacacacatgaacgaaattgttaggtaactgtctccatctttgccttcaacacaggcatgcagccagtgtatagaaggagaagaaccctgcttttgccccccttgcagaggaacaagctatccaggatatactattgtcgaactccattccaatgtctacccactagtatatgttaactggatcatatcgagaaggcaattagttaacatactgccaagagttgcacatgcatacttcatatatacaccttctggttacttcatgtgtctgagttctctgaatttgcttaacccatacatatcattggactccggttaattacctcgaactttgtagccaccccaccccttgcatcgatccgcatctggtatttataagatttagggtttattcggatcagagtaatttcacaggatttttggaggaatactgtacataggaattttttccttttttttattcggatcatgaaaactggttgtaagaaatccaaagtaaagtttcctttgatgctgatttcacaggaaaagtacaggaaaaatccatccaccttgagctcattttttgcttcctgcatgcaaatcctaggcaatcaatttcctgtgatccgaatgctatcaacttttgtattcctttgttattcattcctctgttttacacttagggcctctttgaatcgcatgattgagaaaacgtaggaataggaaaaacgtaggattttgataggaatgtaagtgtaaaacagaggattgtaaaacacaggaaaaacacaggaattggatgagagatatagactcaaaggaaaattagcaagaggttgaagctcttgttaaatttcctccaaaatctctataggattgtccattctataggaatttcaaaggattagataggattcaatcctttgattcaaagggcttcataggaaattttcctataggattgaaatcctctaaaattcgtatgtttttcctccaaatcaaaggggcccttagattcctttcatattcctatacttttcctatctatgtttttcctatcctataatccgaacaagcccttaatgtctatacatacaaaatgagtatatatgttgcaccgatcaagcatgtaaggcatatattgtaaaatcaaaggtgttttttattattattttgtgatgaacaattggcattggagattatcagtttagatatttggaatttatttgcgaagtggttttggagatgattggatttcataggtgatatacaggtactgtgctggattgggtacggtcacaccgggcacgggttgccggtcagaccggcgtgtatctcgcggtcagaccggcgtagcccacggtatgaccggccgactctgtgtcagtttcggtttcgggttgtttgtttggatatccgtgattgtttcatgattatgacttctagacggatattatgtgtatgaatattatcgtttgctactaatgagtcaagttggggatagcttggtctcggaatatggtttctttctttgttctatgtgtaggtgactcgagatgtcgggagagtatttgcggtgatggaccgggagtcggcttggggataagacgacgtccgtagtggtcagagatcatgcgggatactaaggctagagttcaatacacgtggttggtgaagattccatatggcatacgatggaggtattgtgtgtgaatgggatgcagagtcgaatttggaaggagtccaaatttggtatgattggttatgtaaagtttgtttcttgtactagagggtttcctagggtgattaggacttctagtatgagtttggttcgtggctttaggctgcctatctcgggtataaatagagggggagtgtgaggcttcccagtatcgcttttgagagcaattgagttgatagttgagttagggtttcgagtttagtcgaaatttttataaggagtgttgttggtgcactttgtaaacccagagagaatcgataaagtcgtcatccactttaagagttcttcgatttgtgtttcaccgggtttcggcgatctaaccggcggcgcaccggcggtcagaccagcggcattgcgccggttagaccggcgtctacgacaggcgacaggagctgatctcggcggtcaaaccggagatacaatctcggtcagactgacggcaaccaggcgatcagaccggcacatctacttcggtcatatcgcgatccgttgaatttgaggtaacttttatttccgagtttcggtttttgggtataccaaccattcaccactctctggttggcttagttgttctgattcgatatatatatatatatatatatatatatgctcatagcaacagcgacagatgctagtgaccatagtatatctcacacgaacaaattagtaaggtatatacgggcaaacatactcaaccgattaacgctagtggaaatataggcatcagcagtttataaagaagaataaataattgtacgcgttattttactatctatattctcaggaatagatgaatagtacatgatagaatagttctcatttgcccaccagtactgcaagtgactctgactacacaatatgtcaattgtcaatattcttccaaatgcatgtaatagtctttagaggttttctttcgtccttgagaggtatatacctctcattgtctgagagctaaaaaaaaataaaccattaaaaagcaagtttatgattggcaataccaataattttcttttatcgtcaccttatagtatatttgttcataggtcagagatatatgagtaattttacggtccttgagaagatacctagatggagtcatagagtatatagtgaaaagcaagtaggctatgttcgatttagatgttagagcaattatagccctatggcttaccggagaagacactccattactgcataattaatatatatagacatttaaaatatattgtttttacaaaaaaaataaagaataaaaagttttttaaaagaaaatcgtactcccttcatctcattttaagtacagccatgattttccgtgtacaattttacccgtccgtcttatttgaaatttttttaaaaaaaataagattcatgttttatcatctcataacagtaaaaatactaattataaaaaaattaaataagacgaataatcaaagttaaacacgaaaatttattattgcactttgaataggatggagagagtactatttagcatttaaaaacgtgcatgtctacgataatatggtagttcagaagcgaaaagaacatatatggctggttggctggctggctagcttattaaccatacgtacgtgtttcgtggacaatatccataaggctcacatggttattttagatgtagaatattctgatctagtagctacttgtgtgaactattcaattgttccaaagtataggatgtccccggcatatctccctgaatcatttcatctgaatcaaagtgaattattttgccagcatatgccggaccagctgctagctgatcatgaagcatttgttctagctagctccaccgtgcatcttccaagatttattttgtgcgcatcttagccaaagaattaggatgaatgtcgtttgttgcaaggacttggatacatccgaaagaatagttacaccttttccccacctacaaatcttgacgagctaatcatattttgggaaaaaaagaagcgttgatcacttgggaatatctgtttttagtttccagtactctagcttcatccatatcaattttcatgtgaaaatactacctcacacgtgtgatttaagagaataaatcacgttaatgtctaattaactttcaaatcaatccgtttcaagatttgtgcttcacaaccttttgcagcaccagcaaactctaacgagctaattggaggtgttcccttgcttagataaatatcctgtataatggcagctcactagtgtgggccagtttgggcccgctgacaatgagggaagctctcgccgtctttcgagtggttaggaggtgtggtgacggatccggcagcgggaacgacgaaggaggatgaagatacgatcaatgaagtccgagaatatggaagatgagggttaggagagagaatggaaggtgaaggcggattttgtggctccataagggtggttgcatgggaacaccagctgatgatgatggagaagatggcagaggggtgacttattatttttcttaagaagggagagggattacgcaatgtatagattgttcttttttttttatccatgttttactgtacatatatacatacaagtcttatcataagtctacgtcacattaataaaacttgggtatagagcatagatcagtatatttattgaaagaaaaacattcgaaaatacaactatataatcagtgctaccaaaatttgtctagatgggtttaaatataaacatatcctatatatacaagtcgtcatatgtacataccatgcatatcaactaataaatatcataaaaaattatacatgcatgtaatttcaatataatatatagtattacatctacgtgtaaattcccatctttaaattcatcgtacatagagaacagcaaaataaacaaaactgacatatttagtcttaaaaatatcagaatttttaatcatggctaaaatataatgaatttaagattaagactttagatgtaacactattgaagtatttcttctttattttttgacatttgttagttagtttacacgtgaaactaatatacacatgatgtgtttccggtttaaatatggtcatttgtacaaataaaggtagatcttaatcggcaacgagaatgaagattagaaggtctaaatataaattagtacaaattatgtgcttagcgaatagcaattaattaagagaaatcaacatgttatcagaatatagcaatatatttgtaaaggcttaaaagattatatttaattagagatgtcgaattgagtacgtagtatgtgggagatgtagtttgacaagccggtgctttggtatttttggcagtaggtcattcaattattatagctttacatgctctttaacaccttagaagactgtgggggaataactttgagttgattgtagaagtaaaagtggattaagtcggtgtgtggctaagtcttagctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcagtcagagaaaaaaatttgtgctagtcaagtgtggtgatgaggttagtttgtcgtgaccgcaagacttctatcgtgacttcgatacattttgatcttgtttctgggagatagaatatacgtgtaaaactgctaaaaaattagtgtacgtttccgggtaaaaagttttaaatataaatataatatactgtaatgtaattacaatataactacattgtaatctctaatgaataaaattatatatttttcagtacttacatacaaacaagttacttcgtatattataagttaattatatactatagaattatcattccgatccctaattaccacgatccattcagatcctacgtggcgctcgcgcgttgcatgccacatggaaacaacagtttatatataaacttcaaacaatatgtttttatttgatattgttaaaaatagattattacaaattttaaaaatagattgattgatattttaaattaactttatatacaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccgccgcgccacagccaccctgcattagcagcatcgtctcccaacaacaagaagaagaggagcccccggtggtgctcacggtgtggcgcaagtctctcctcttcaactgccacggcttcaccgtcttcgacgccaagggcaacctcgccttccgcctcgactgctacgactccaccagctcaaggcgcgccgacctcgtcctcatggacgccgccggcaagccgctcctcaccatccgccgcaagaggatgagcctctccgacagctggatcatctacgacggcgacggcgccgccacctccaccgccacgccgctcctctccgtgcgccgccgccgcgtcggcctccgcgcctccaagtccaaggccatcgcgcacgtcacgccgctctcctcctccctgccgctcccggaggcctacgtggtggagggctcgtacgggcgccggagctgcgcggtgcgcgacgcccgcggggacgccgtggcggaggtgaggcggaaggagtcggtcggggacgacgtgttccgcctcgtggcgcagccccgcctgggcgcgccgctcgccatggccatcgtcatcgccatcgacgagatgctccgcggcggcagctcatcgctgctgcggaggacatgctccgcgtaagtccaaaattcttccttctgtacagtagagacattgagctcgctgcaaggggatcagaagctcggggtcccacctgtcagcgactcagaagcagtgttcccgcagcagagtctagctagatgcagggcactaaacacccagaaaagaaaagcacaggaattatgacaaacttattagagttggtgctgtatgctacaatcaagttttagctagctgctgggttacttaagcatcatccatgttgataggaaattaagcaggactgatacagtcaggcttgtgaaagtaaagcacaagtaggacaatacatatagatacagcctagtacaggggagttctttttttttcttccccggatgtaatattacaaaagattattgtttattattatatggagaaatggaactgcttctccttttccttcctttttttttagtgatctgtgtacacggctagcccatacagcagcatgttcagtgtgtgcgtgcttgaccgtctatccgagcgacgagagaccatttctgtgttaatcagatgtgagtagtaaacagatcctatctccagcaatattttattttgtttagaagtgagaatccttattattaggcgattcttctgctagtatcatattgctacccactctttgatatgacacagatcgatgatggatggagcagagcttagcttggaagtgcacaacccttgacagagatgagtaacacacattataaacaacagaacattattcagctgaacatacaagatgttagcagctaacatgcacttgacctgctactgttagtcccagacttgtgccagctgatatttcttgaaattaatcccagtttgttaatttgtttcaggtctcattcactgtgttgtactgtagagccactcgatctgccttgttcatctcgcggtggagctagtactaccaaccgatctagagtatctatcacgttttaatcaccattcattcttgtttgagacgatgaaagagagaaaaggcagtagatgcctcaaggacgacggatcgaggacatccttgtcgatgctctgtcccaactagagtagcttatagctcgatgaagacacatgcatctttcttccggccgtgtggtgtggatgtggtccttgatttgtttgcgctagaaattcatcgcttccgcgtaatacagtagtactacagtatgagagctagatggaaaattagacgaaataattttgtctatagactgtgcatgcagctgagaaaatcaaactcaacatcgtcatcatctcatcgtacagagagaaaaacaaacgcatgcagtgtccccgcccccttgcaaaacacaaaacacatggacacgatgcagactggtttaacacagagttatccctggatatataaaaaaaaaaaggttggacccaaagaaggacttagagtcaatggttttagtaaggaagaggtaaatttttcctgtggtgagcgcgctcgacaagggtcgaacccgggccagcggggtgcatgccagcgaccctgcccttgcgctaatagcgcatctctatccctggatatatcagtctttcaagtgtaacttttgctgactgcagatcgagggtgcttaatttcttcatatcattaaagggtaatttcatgtgtaactttttctggacatgtgcacttcttttattcaagggaaagggaaggaactcagccattcaatataattacaggaggtgaaaagagcttagaacactagaggaaaacacattattacaagctgaacagccaagaagctgatggagcagctagcacaactaatttgacgagtgctccaaagtgattactctggggctggtgcttgtcgtgcttcttctctcgcttataacaaacttctttgccaaatttgctacatcttcaaccgtaccatagacactgttgaatatcctgccatttcgttgcaaccaaatgctccagatcgtttcttgtgcactttttcagacgataaacagagaactctgcactttctcagcgctttctacatgacgatgaacagaggatcgtgcactttttcagcgttcgactacttggtttagttctcgatccattcgtttgatacatatacgtatgttgtggagattatggataccacatgtccacacggcatgtatattcgactgggtatggtggtaccatatgtagatagaatatatttaaggggctcgagttatattcttaacctgtgtatcaaggaaatactcgagattctagtcggttatgattgtattttatctttacttgcctattttgctaggaatatgggctgtatgttataatacggactcctctcactatataaggaggggtccgggtgcctcttggggcataacttttcccccagatcatacgatcaataatacacttggtggatcaatccctgtacatgagtagggtattacttctcattgagagggcctaaacctgtataaaattcatcgtctccaaacccatccacttttcatgcttgatagccacccctttttgtattgccgaaatcttgtttcgacatatgttgacttgattgggatactgatctggactactaattcacaggtcaggcttcagagggagtgccattccaagtttccaacaagccaacaattaccactgatcatacataaacagaggcaggaaatgacggatttgagcgacggctagcccagctttttcatgctgaaaattttaggcggattcatcgaagtacttgctgtacagaaacataatggatgcatgaatggctgctagacttaaatttctgtctgctcattcaatccaatattgatcagagtgtcattttcagtcctgctcctgcatgcgccactgtacgtgcatctgacctttggcgaacttttgcgcttttagccgccgaaattgcccaactctttgagagaaaaagttcggttgcaatacgttttaaggaggggccaaagtcatcttcttgttatactcgatctgctcatttcatgtgcatgattagaacaaaagcacgcgaactgaacaatcaaggaagctgccatacaaatacgtactacggtactagtacgcgcccttctgtaactccattctgagtttcaagtcttcaaaaaattaaagtggcttataatatgaaacgaagggagagtactagttaccatattcatgtttacatcttcactgataatatatttacatgcttctcccttcgtttcacaatgtaagttattttagcattttccatatttatattgatgttaatgaatctagacatgtgagaaatgctaaaatgacttacattgtaaaatagaggaagtagatgctacgtacgaagtactcctaagtaaaaatcatcatgctagagaaatacgtgatgtcggtaatcctggtggtgatattctcaaaccagacatgtacagtaaactcaatagtcaatactatgggtaaggtatggattgagatccggtaaggtatgcatattctcgaacatgatcagtcactgcatattcgatcgatctcctaatcaagatgcattaacaagataggttcgaagaccatttgctgaaaacctaagctagattggtccttcttgcatgatgatatcttgagaaatactccctctgtttcgaaatgtttgacaccgttgactttttagcacatgtttgaccattcgtcttattcaaaaacttttgtgagatatgtaaaattatatgcctacataaaaatatatttaacaacgaatcaaatgataggaaaagaattaataattaattaaattttttaaataagacaaatggtaaaacatgtgataaaaagtcaacggcggtcaaacatttcaaaacggagggagtactaataatcgtaaccatccttttcccttgtgttttttgctgactggttgtgctctttaattatcactttatgcgcacttttctttgacgccttccacaattaacatgcgcgcgcgatgggtggttttgtttatatagtactccacactattgtacccgtatgatggcaatactagtctgactagtgtttgctcttcatctagaattgttgtgtttctgtacagtagtatgcatggaaagcaaagaagttgtggaaatgcggtcatatgcttggctaggaactgaagagatagcaattgggatggttggtttggcgtctaaataaaccacagcgtcctggaattgtgagtcatgcgtgatgcgtgattcctccagtacagaggagagagctgatcaaggaagataactcgagacaagccagtcagctaggatacctaatattccctcttggggctcctacaacgtatggaggaggagaaaaacgtgtcttgtgatcttaattgcgcagaggaagaacaaattcacctccgcctccgccgccgcgccgtgtcgagggatcccgatttatggatgcaaatcgctttttcggatcgtgattaatggtacggtggcccaaagcattccaggccctactagatagtggactcaacatgggccgaaatatcgggggggcctccgaaagcccatatacaattgccttacctgtccccacctgtcacatgcctcacgcagcagagctcaactcaagtcaaggcggcatttcgaaattcgaaaacaccaacggtttcaaatcctcctcacatcttctcttcccccaaatccctcctccccatcgcggctcctcctccggcagccagccatggccacggtcacgccgggggtgctgctcaagctgctccaggcgatgcacaccgacgaccgcgtcgccggcgaccaccgctcccccgtcctccaggtcaccgccgtcgtccccgccctcaccgcctccaccgccgactccctctggccctccaacggcttcctcctccagctctccgacggcctccactccacctacgtccagccctcctccgccgacgccgacgccctcgtctccgcgcgcccgcaactcgtcggccacctcgtccacctcgaccgcctccgcttcgcccgcccggtgccccgcgccgtcgggatccgccccgtcccgtcctctcgcagcgtctccttcgtcggcaacccggagccgctcgtcgcccgccccgccgcgtgctcccgcggctacgtcatccagcccgggtcccactccgacgccgcgccgccgctcatgccatccagttccggcaatgcggcgcagtccgatgcaacgaatgccatcaataggacggttctcgcgcacaagaacgtccccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcctcccgagcgtcctcacctgcggtcaggggcacgcccagggcgacgtcaccagcgccgtccaaatgcgtggtgcccagccttgttgcggccaaggaggagaatcgccgcacggcgagggagccggcgattatcgtgccatcaaggtacaggcagccgtcaccagtaggagggaggagaggggcggggtcgcccgcacccggtgggaggcgcgcgtcactgtcgcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggtcaggatcatgtttcatttgtgttgcaattgcaatcttggaattgcacttgctatgctactattgctatatagttgtacatgcactgcacatttatcttgttgtagtgaacagacaaatagtacaactctactttgaacaggctaatcgtagtgaaaacagtggttacttcaaatgcttgattcagtacatatgtgaaaaatggcatggttttcttgcagttacttaaaatgtttataagtttattgaggaaagagagaattgaaaacactgttatttattttctttccagatacaatggcagctagtttgtaatctttgaatttgactcatggacatgcccttccctaccatcatcacattgttgtgttactgcaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggtaagcactcccaattcatctttgttagcaatgatcaagtcgcagttcattgatccttgaaacaccacatcttctctgaatttgcaggaagccactgaacgaagagacgcagcagcaattgctgcagctgatgctctgcaggaggcattaatcactgaatccgtaatcaggaacctaaggtaattaaaagccgacttgtgtccccggaatttcattcagcacaaaagtggtttttcctaacactcagcttgctattgtccacagtaaattttctgaactaacttcagcatcgaagacctccaatccccttccaacagttgatatcttccttgctgtctatgaggatactctcaaatggaagaaaattgctgagtctatatccaccaatagaactgaaactgcatcatgggagaattcagttactcattgggttgaagcagcattggcaactgatcttgaagtcctaaagttgatgaataaggcacctgaatcgctctctcggaaaaggggtgctgataagccaaaggctcccttggtggtagaagctccaagaacaaccatatccaagaggcaatcacatgggacttctgcaaaggtccagtcaaaggtcttaccgacctcttcagcgagctgcgcatggaacaaaactcagggcgtgaatgagacggctgagcttgccacgaccttgtgctgtgagatgcatacgtggttcctgaaatttgtggacgaggcaatggatttaggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttatgggttcgtcatcaatcacatgggatctgcatttgatagctcggtctcgatttcatcaaggaattgaggaatgcttaaagtaagcctttaagtttcttctcttgtatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttaaagctacaagatatcattcttacatccttgcaaatattgtgctaggattaatggtatgttaatttgattggtgcccaatcttttcataacaaaggttaggcaaatgcctgacatgccacaaaaactgtagctagtacaatatgtgccaagtatatttggaatgccgacacattttgctagccgaagaaggaaaacaaatcttcagttgctagaggtccttccatgttgctaatttgctataaatgctggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcctcttgctattaatcgaatcaaattactactagtctcccttccacgccacgcacacgcacccaatcccctatcgatcgagagacatggcctccaccaccgccaccgccgccggcaacggcagcggcagcatcctccccacccacaccaccacggcgccacccttcagagcccataaggacgccgacctggaatccacgacgcggcggcgccggcgacgctgcctgtgctgctgcctgctcgtcacccttgtggtgctcctcgtccttgccatcaccctcctggtcctcttcctcacggtgctccgcgtccgcgaccccaccacccacctcgtctccacccgcctcaccggcctctccccgcgcctctccttcccggccacgtcggtccagctcaacgtcacgctgctcatcaccgtggcggtgcacaaccccaacccggcctccttcacctacgccacggggggccacaccgacctcacctacaggggcgcacacgtcggcgacgccgagatcgacccgggccgaatcccgagccgtggggacgccaacgtcaccatggcgctcaccctgcaggccgaccgcttcgccggcgacctcacgcagctcgtctccgacgtgatgggcgggtcggtggcgctggacgcgagcactcggatccccgggagggtggccatcctgggcgtgttcaagcgccacgcggtggcgtactcggattgccatttcgtgttcggcgtcacggagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactagcgactgattcaaaaattcctaatccaagcgccaaacttcagttaaacagacctttctcgacagcatgcccacagcttcaagctgccaagtgccaacactcacagaaaactcggcccggtgcaaaaaaaaaaaaggagcatatcctgacttctttcactagcaaatactgagttactaggatttaggaccctcacatggtcaaacaacaaacatactaaacattgttacaggtttcaaaacatataatgaagccacatgtataaaccaaacggccatttccagcggttttctgtttaacctcaccactaacagtcacatcaagcaagcagcactttacattatcaatcatgattttcactactccgctgcattcatcacataaatgaaaacatttaagcacggcacaccatctcacagttcttgtgaaagaaaaatgaactactattgagcagcattcagacgatccacatcatgaacctgcaacagactcactagttcaaccagacacagctatccattttaagacttacaaaaggtacgtggtcacagaccacaactcctaattgtatatgactaacccacccaaaaggaagactgattaaagcttacatgtataacttattaaactgcctcctactcctttagcatcactacctacatgtttcagttagcaaagttaccatattggcacagggcaactgaaattggtagccaaaaactgccccaaaatgctgttcctgggcagatcaaaagggtgtcaagatatcacttattctctttaacgaataaacaccttggactgactgaatcaaagtcgagctttcgacaaatgcttgggctgagctgtaccgctttaagaggtcgcctcagtggcgcatctgggcaggtgtctgcaatgcctgtaagtagaggctctgaagaaggggtctcacagcttctaggtgaattagaacctatcagatcctttccagtcgtctctagtgcttgatttgagataatcagatcaataaacatcatgcagatccgttcgagaaactgatcctcctcctcagcatcatcgaattcaaaacttaaccttttaacagggtaatcacctgaatcaaaacttagctgccttcgcgaaggaagttctggtgccttggtcaccttcttctttggtgcacaagctaactcctctggtcctggagcaaaaggatcaaagatgctttcgcgcggtgtctgacatccatatgaaggatcttcatctgcaacactttttgagatatatgattcaatcgcttcattctctggtggtgtaatcacctcagcaacaccactcttgttattttcatgatcacataccatgccaagggatcttgtgtccttattttcaaagggagattgcacagaaacttcttcatctacacacttttccaacttttttacaacagggaaatcacagtttgaaactagcgaattatcagtaacattcttatccacgccttgatccatttgggagtaatgtggactcaacctctcctgtaacttgcaaaatgaaaacctacaatgaaataaggaatagaaaatttaaataccacaaactaaccaggacataacagaaaatgatcaccgaaacaaacaagggacacccaagaagagtccaaaaggtttctaggagaaaataaggcaaaaagggtcataggagaaactaaagcaaaattaagtggttatcgacaaaacactagccccaaatgtaactgcaactgctatgaatgtaaaatgtgttctaaaagactatgcaaggcgccaaggtagtcgtcagccactaataagcagaacccagcttcaactcttgttagaagccgagtgaaatcactggcatcatctgatctaatataaccgaagccgtttttgtcgataaccgtttttttggccacatttcaaactgttcaaccatcactctgagtccaagtatgtatacaacaattatatatgtttctttacttctgtaaaaagatatcaattaaccatcaacatctattttataaagcaccttccgactgtctaattggataatggggaaacctaaaaaataaaaagctttctatgcattagctccttggaagaccttcatccacactttttgcctactatatatgtatcaatggtttatatgcagctatgactcatacataaaagattaaaaatattctctatagccagcgtttttccagtatatctacacttgatctcacaagtttttccattatcacattttcctgaaacatagtaaaagtaaacaggataacctgtacctttgaaatagtacaggatctgagttgcagagatcaggttccaagagcatcaacacttaatagtagtatgatctttaccaaaagagcaagtgcagagtgtatcggtttcatataaaaacttgatcatgtcaaaatcaagtgtggttacctaaaaaaatgagtacatcagttgatatcaaaagatgaacaaggaacttgatagtatttgcctgacatcaataactcgaaaatgtagcaaatatgtgcagaaatttgacatcattgagcctcatttccagcaggtaaataaatgcagaacaatggcctcagatatatgaagaatgtgaagtagctactgtcattggtatctgttctttccagtatctatcaaatgtagcaaaagaaaaagtacaaggaaaaggaaaataagaccaagtgtaggaaaaaagaaaccgcaagaaaatgagaacaagtgtagagcaaaaatctattcacatgcatcacaaacagcagcatatatcatcattggccatctttcccagcctaacagcacgaaaaaaagaacaagtgtagaaaaatctgttcatgtactcttataaattctgctcagttcaagtgtagaggtggcctcagttctgctaagatcatttgaactataaaatactgagaaagatcacagaaagacagaaacttagaaagggcatgtttggttgcctgaccttatcgaataaggtcaagtgcgggcatatctgttcttatgcatcacaaataagcactattaatcaagtgtgtatctgtcagtatcaatttaaaagaaggcactattgtatccggccttatcagtaacttgtatttgtagccaaagatacaatggcataacacaaatcaacaggaaaaataggaataagtgtaggaaaaatgaaaagcaagccactagacatttcattccatcgaaatcaaccaagaaagatgtcagcttttagtagatctagcatatttatgaaggggacacggtcggtctaatccaaacaaatcggctaaaatcgaaggaagggaggagaagacaacctagcccttaccagagagctcaacggaaagagtcgacgaaagagaggggcatagcagagagacggagagagcgaaccagtggaagagagcgatggcggctagcgaaagagagggaggatgcagtgctgacgacgaccggccctcccgccactcgcgagtcggcggaaccctagctttccactggtttggaacaaatgaggagggatggtggtactggtgagtggtgaccccatccatggcttctgcaagagcaggcaaatctgctgggaaccaaacacgtacacgccctaactgaacaccacagtgaaatactcaaagttgctagtattataatggtactaatccagagatccaaatgtcaaatacgtgtggtctctacatcaagatctattgtagccctattgggtgtcttggcttgcgcatgccgccgctgaataacaccataaaccttacccgagcgctcgcttgacggcgacgtggtgcgctaagaagtttggatttgatccctcacaccacaaacaaaggggacaagactacaacagatatctaattaagcaaaacagggttccttaccaacaaaagaagaaatcaatccaagcccggatggatcttccagtccaacccaatacatgagatggggagcaaaccggataagagttccttgttggcgcacctagaaattagaatcacatggtaaaagaagtagatttagggctttaagaagtgagaaaagccgaaaaatcacatgaaaaaaagagataaagctcactagaaccctaacatgtgaaaaccataaaaaaatccatagaaagaagaggagcattttggatctgcgtgagagaaagattgagaagtagaaatggttaagaaaatggaagaaaggaaatacctcgcggcggctctggattggggcacgagattggtttgggtggcaccaaccgggattgggatgaggcctcccgccgccaaaacaatcccctctattaaaataaaacaaagatttcacaaaacaccccatagaatgtctcatttgctaattttattcctttgtacaacaactagcgaggagcaaggcagctctgctggaccactgaggaatatatgtgaaaaataaagaatcagtgggttggagagtaaaatgcaccaaaaggagggaaaactaatttgggcgggcaaccttggcgcgcgtgtagcaatttagcatatccttcccgcgaaataggcgtgcctatacatatcatcattttggtgaaaaatgaaagtttcccactgcctaaggagttttttcttaggaaaaaataataaaataataatggtcgtgattatttagaaatctataggtgcaaataatcattaaatgagtgggtttcatgtgtatactatgttgaggctagtttgcgggttatcgaagatcataatgattaagagacagttaattttatgttttcctggtttaatggaatttatctattgcaagcaaaatacctgtgtttcatgaccagtgaagaaaattataactttacataccttgttttgccattcatctctccatatgaaacacacctgtgatacctttgttccgtcatttatgtattcgtatgaaacacgccagtcaggttaaagaataagcctgtgagactttgatactcaattttaacagtacagagaagtttatgtgaaaatacatataaactcaaggcatgcattaaaaaataattgaatgaataacttttcataatattaacaaaatgaaagggttaaaatgaaagattgacaatgaatccaagatattttatcatctaatactcatagatagaatccgtttggtgatgcatggtagaggcattatccagcctctctcattgcagctcacgagggacggtggtggtgctcccctagccaaccagcccctctcggcacgcaaggtcctcccttagcgcgaggtagcagtg

SEQ ID NO: 50863 - DNA, 3835 bp, Oryza sativa
catatcatcattagctagttcaaattggtgaagaaaagtgtgacagacgcttctcatcagtttagtttagataaatccggcaataaaaatcgctatcgactaccaaacaaggaagttgtcaaatgagacgttcacgacatctatgttttgaggtcccgatccttgcagcctttgctctaggctctgattggtagatttgggaattaggatgactaatggaaatttggaaagatttaatttcacctccttttctcctattagtgattcccagtttaattggggagaggggtggagcagacgcgaagtctccgttcttgtggaacaaagaagcatgcaaagaaaagaaataaggcataggagttggggcaaccacttggatggagtgagggcagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcatgtgcactgcactagtagtacatagtagagtattatattctacacgggcggcacattagtgtcgtaataaccaagggaattcaaaggtttcaaatttttcccgatcaggaattcaggattcagtgctaccattttcttcaatatttcttactgcgtgttgggattgatttgattcatgtatataacacggtgtcagtttggatatatatacagtaatttcactattctctatttcttcaacgtatgcgcccatgatgtttactactccctctgtcctataatataagggattttgggcttttacttgcactgtttgaccactcgtcttatttataaaatttgtgcaaatacaaaaaacaaaaagttgtgcttaaagtactttggataataaagtgtcacaaaaaaattaaataataattccaaatttttttgaataggacaagtggtcaaacagtgcaagtaaaaactcaaaatcccctataactagttgagtgcccgtgcgttgcaacgggtgattaaaaatacatctagtgttatatgttgataagccttaaaaaattctaatagacattataaaacccaaaccccaagtccatgatacacaatattttaaattcaaattgattacaaatgcagtgctacttttttatttcaaatccatcaagcaaaatcaatttcagatttaagtccataatataaaatcaatgttaggtctcagtttagaatctgttttaaattttcccttccactgaccgtaggctaatgattagaatttataggcagaatcagacctttactattgcctctaactgtacattgcctaggtgaagcacaaaggatgccagtaattgagatggcctcgatgggtttatcctcccctattgcagtaccacacgccgcaggcaaattcatctggcaaaagacaaaaataagggaacaatttctgaatatgtatcactaaactgcagcagcaaatgcaacaatgctggaactgtactaccgaagtgatcacagtaagagtctcaccatagatagtggccaagcaagtaggagcagaaagttggaggccatgtagagcaccatcccctgcgctgccaccaccagcaacaacgacggcatggccagtgcccaatgcttgaaagcaaccaccccggtgcgcacaacgccacccatgagactcaaatcactcatccaggcgaagcgaacaactgcatgcatgctaggagtggagacggcggccgtcgctgcatgtagtaccgacctggcggggtagtaggtgatgctgagggagcgcagccaggcggcggcaatactgcctctccctcaactgagttgatctgaaccttggtctgcatgtagtaccgacctggtgaggtagtaggtgacttcgagggagcgcagccaggcggcggcaatactgcctctccctcaactgagttgatctgaaccgtggttactggaattgcgctgcatatcttcttctttagcaatcaggagacaagttaataggtgattgaatttaaaaccagttacaaacaagatccatcagggtgaaaagaatagaaagtacaaaggcactcacaattagagttcagttcttcaataatttatctccaagattcagtctcactgcacctaatggtgtggcagcccgaacacttcccattgctaagaaaaggaaaatattttagtaaatatttctattattagaagctttaatcagttgctatataggatatgtagtggtcattgatatattagcagctttttcatttgtctgaattaatattgagaacaaatgtggatataatcctggtgttgcagaaatcacaggacttatggcctttcagtttgtgttctacttgatagtgtgctacaaaattcaaataatacattaatgattgcaaatatttagaaatgcacaagctgtaaataaaccagcaatctcttttaaatcctgtcctgcatggactaaaaataaaagaaatacttcctccgtcccaaaataaagccattttttaggttggcacgggtattaagaaagtaggtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttaggacggagggagtacttaagttcagtacctactgaataagtttgtttgcagttacccataggtccatacaaaggaaacatggtctttataaaatcacagggtctttataaaacaatcatgccatttaaggacaccaaagctacatatcaaatttatttgactcagtacaaatgatcaaaaaagagtaggcatatgaagagtagaatctacgtagttcgaggtggacagtactatttggtcaatttgagcagaggaacaatgagggctccagcatttcttactaaatccctgactcgcatttttcactaaccatatgaaaagcataatcatatataaattcaatattttttcatgacaatactttttgggatatggagtttgcaaactaacattagaaattgtaaactaaccccagactaatgtgtttgatccactaaattttcatccacaacaaacaaataaacgtcgctttatagatgtactataaactccattataaacaaatgggggggaggggtatggaagaaatcataacatgaaaaaaattttacaacgttacttaccaccggctgaggaggaggttgccgcaatagagggcgccgtcgttggtggccggggctcgcagaagggggacgcggaggagatcgacgcgggattgatggttgcgcggaggagatagacgtgaggcgactcgtggaggcagcgacggaggataggcgggcaacatggtcatgggcgatgggatcggctgggaaataacggagagaaattggtacaactacaactccttcaactccctgctattgtatatgaaagccatacaagttatgttatcagcactcctgatgaatacaaaaaggtcaaatcaaatcacagcgaatttttggacacgaaatccacctaagaaacggccataaatttcatgaacacaaaggataaaacaatggatattagtataacttgcgccaatggatattagtatgttagtataacaaaagctaaatactcatggcatactcttttccccaatgttaccattatttacactgtgaaacatattcaagtcatctatttatatgtacgatcc

SEQ ID NO: 50864 - DNA, 10449 bp, Oryza sativa
  unsure (1)..(10449): unsure at all n locations
ccaactgcatcaacctgatgctgtggtcctagaagaaatgaactttttttttaactcagttcagacttcagaacccattttcttcagggaaaaaaaaaagttcagaacccattgtatttagttactgttgctgtgcttatgttcaatctgtccttgtgttaagcattatgttatgggcatgcagtcacaatcaaattacatcggttgatgacaatgtgtgtgcctgcctgtatctgccttcctatatgtgcccaaccaaggttaatatggattaactcaccaatagacgtcgaaccgaggagagggaatagattaacatgtgaatatgcagatttagagacctagtaccaagaggaaggggagtacaccaaccttgggaatagttggcgccggccttggggaggaggcaggatgcgacgacggcggaggggcggcggtcgagggcggtgcgggtctagggtttcggcgcgatgagggaggagggaggagtcggcggcgtcgggtcacggggtgagtgcgagagagaggagggcgtcgatggcgaatcctcgacggtgacgatgggggcgccgacgcgtcgatgtggggagtcgcgagggtggattggggggcggcgatggtgtggaggaggcgggatgcgacgacagcagaggggcggcggtcgagggaggcgcgaggatggattgaggggcggtgatggtgtggaggaggcggcggtggagggagagaagtcggaggaggggcggcggtcgagggagaggagtcggcgccgtttcctttttttttttttttttgttgcggacgaggagtgtgcgccgtttccttttctttcttttttttccgttgtagagtggcatgtaaattgttgatgtacctttctcatgtttgatcgtctgtccttggcttcactatcaccgtaacgaattttttaaatagtaaagatatgggacgaagggagtagctactgattcaaaaattccgaatccaagcaccaaacttcagataaacatacctttctcaacagcatgcccacagctttaagctgccaagtgccaacactcacagaaaactcggcctggcgcaaaaaaaaaaagaaagaaaagaaaacaccatatcctgagtcctgacttctttcactagcaaatactgagttactaggatttaggaccctcacatgatcaaacaacaaacatattaaacattgtcataatgaagccacatgtataaaccaaacagccatatccagcggttctatttaatctcaccactaactgtcgcatcaagcaagcagcactttacattatcaatcacgattttcactgctccgctgcattcatcacataaatgaaaatatttaagcatggcacaccatctcccagttcttgtgaaaagaaaaaggaataatcattgagcagcattcagacgatccacatcatgaacctgcaacagactcactagttcaaccagacacagctatccattttaagatttacaaaaggtacatggtcacagaccacaactcctaattgtatatgactaacccacccaaaaggaagactgattaaagcttacatgtataacttattaaactgcctcctactcctttagcatcactacctacaagttttagttagcaaagttaccatattggcacagggcaactgaaattggtagccaaaaactgccccaaaatactattcctaggcagatcaaaagggtgtcaagatatcacttattctctttaacgaataaacaccttggactgactgaatcaaagtcgagctttcgacaaatacttgggctgagctgtaccgctttaagaggtcgcctcagtggcgcatctgggcaggtgtctgcaatgcctataagtagaggctcacaacttccaggtgaattagaacctatcagatcctttccagtcgtctctagtgcttgatttgagataatcagatcaataaacatcttgcagatctgttcaagaaactgatcgtcctcctcagcttcatcgaattcaaaacttaaccttttaacagggtaatcatctgaatcaaatcttagctgccttcgtgaaggaagttctggtgccttgatcaccttcttctttggtgcacaagctaactcctctggtcctggagcaaaaggatcaaagatgctttcacgcggtgtctgacagccatacaaaggatcattgctagcatcagtagcaccgaatttagtattcagtgcatcccacaactccttagcgtcggtcatatacatatacacctcgaccagacgatcgccaagaacgctaagaatgcatcccacaaagagagtagtggcttcctcgaattgcttctgctgatcagtagtaagaattccttcaggtttaccagtactcacccagaagcatttcatagccgtcagccacagagtgaccctgatctgccatctcttaaagtgcacaccggtgaatttatccggcctcagtgcatcggcaaaaccagccatagtaaaatcacagtgcctataataaggtttttggattgttgaaattataagcacataatgatttaatttattccataaataaatcatggcattgcagatgtaaactagattgaacgcatcattcgatctacacatgtaaactaagcagtaaaacatgaacagatcaaatatgcgcaacacgtcgaacacgtaccgaggtggcggaaagactggttgctcggcaggaactactcgtggttgcgagcgtcgacaaaggcgcgagtggctaggagggcatcctcccttttaaggaggtctccctctcctagaataagtaaggtgataccaaaatccgcatgcatgccatcccatgaggtggacttttgtgattttccaaagaattaatcttcgaatgggccttagcccatctattaattccaacagaaccttggcaccggcaatgcgggctagagggcgcatgatgtgggtccaagagaagaccgacgagccaaacccatgtaatagcactatgggcaaaccaatttggttttggtcagcgtttgtgatgccagagtctggagattggtcactggaatcctcatgggtgcaaaccttgtggtggacccttacgccattgatctcgtagaagctgctgtctgggtcagcgagggcatcggggtcaaggagatcgtcctggtcaatgccagccacactccggcggcggcggcgtcgtggtggcatctgggcactgtctggaattgaacctgcattagttgtagggtttagtagtgccaaagctgttctgctagttttggggacgtttaagcttttggtgctagctttgccccccagatgaaaaaaaaggctcaataatgcgccattttaaataggggaaatcacacattctacttgcagagagcacatcaacctcaaaatatcccatcttaataacctcctatccaaatgctgcaagtctttcaccacagagaagttacctgggaactcggcagaggcaaaggctgggggagaaccattgggacggcgagggccggaggccgcgggagaaggcggcagaatgtcgagggtgtggagccgagggtggggattggaggtagcgtgggagagcatctgaattgacctgatcaactgcagagcaggaaactcacgttcgctggactgaacaattgtgtggggtctcaacggaagaagcaaaccgaaaaatcaatctgcatccacacactgcaaatttgtatcgtcatcaaacaaaacggtgctccaaataactatcaatctatattagatgaatgcacactaccatgctcggcaatcgcatttcttggatttttctcatcattgattcattgggcaacaaaatatcaagtcttaatctccctaaaaaaatatatccaatcttgaagcaagtaaaacatctgtgagttaaaagcatgtgaacaacgcaagcagaggaaaaaaaaagatgatatcaaaatagaaaagtttggttatagtaagcttaagagcatgtataagatctgagacaactatagtctctcgtgcactatagacgataccgaaagacagttactacaacagtttgccatatataccatgaaacgaaataaatgtgaactacactcgtagctttggaaaagagaaaatccatcaaatgccatcgatagacaaacaccataatcctagaaatgccatcgacaaaggcaacttcccaaaaatgtcattgcacaagcctctttctcccaaaaatgccatcgccgtcaaattgctgttagcatctttccgttaagttgcatgaaaagacaatcttaccgctaggcaaccatttgctcacgcaacatcatttttgcattgtttgctcacaacaaattatatttatgttagcttacaaatttaccaacatcatttgatagtttccttctgttttcatccctagtcactccccaatggcaaataggcagctcccgagagagagagagagagagaacgcgccgtcgccgccgcggaactcctcgccgcgccctgngacgccgccaccgccgccgtcgacctcctcgccgtgccctacgaggctgccgccgtggacctcctcgctgcaccctatgatactgccgcgccgtcgccactgccgtcgtggacctcctcgccgcgccctgcgaggccgccgccgtggaccactgccgcgccacccctgccgtggatcctcaccgcgccctgccgcgccgccgccctggtcctccttgccgcgtcctaccgcgtcgctgtgctggtcctcctcgccgcaccctgtcgtgccgcccccgtggaccgccagcatagcggcgccatggccaccgctagggaccgtcgctgagccaccattgtctagacgccgctggggagagcgctagatcgggatcggttgcggtagggttagggctagaaattttattttttttctttgacagtgaaaattgggtatattttgcattgagggcaaaatggttattattaaaaaaaataatggttgtaatggtgtggagttgatggtgatggcatttttgggagaagggcttgtgcaatggtattttttggaagttgcttttgtcgatgatatttctgagattatggtgtttgtcgatgtcatttcatggattttttttctttggaaaattatgtgttagtagtaccagacagtagaaacaggcagtacagactacagagcttggtcccctctatgtggaaatggtagctacagtgatggggtttgaccatttgggcaaattctacaaatactatagcgattggcatgaagtatgaaccacctactaccataatctttatgaaaacatacacagctatgaacaccatctattacttggtgttgagttgtgatccaaattaacttgcaaataaaggccaacttctatcggagcgcagcggagatccgtcgctggaggcttgagccgtagcgaaaaagataccgaaagaaaaaaagggaaggcagaaagaaaaacagagaaaaccaaaaaagaagcgaaattgaaaaaaaaacaaaaaaaaaaggaaaaaagggtcctccagtgctgtccgtcgctccttctccgcgcgcgacaggtgactggttgctaaatagctttctcgggagaccactacacttcggacgtctgatggataacagaaaatcggacgcttgttatgttatatttttgacacatacactaacatgtgcaaaaacactttaaactatttttttctcttaaattatttatccaaatcatgatccgattacaccattaaattcgttgcaattaaatcttcaaaacaagaccacacatgaatatattccgacgaatttttttagctaattattgaattatttttaaatattgcacgatgttccaccatgtatatcggaattgtttcactaaataaatcaaaaacgtttcaatcgtttaaatcaggcgttgtttcaccttatataaaaacaatgtttcagcaaatagcgaaagaatgttccagttcactgcaacatttgatccatacatagtgaaacactataagtacactaggtgaaacatttttggtagaacaaaaaaaataaagcgaattctcttgatagagggtttctaaaatatgtgggtaatttcttgcaaaagaatgttttaattcactgcaacattaagtctatacatagtgaaacattgtgagtacactaggtgaaacattttttgtggagtatgtagtgggaacacgtggcagtgttgcaggggagacgtggtggggcccaaggggagcatgtgcgcacgtggtggttgggggggagcgtccgattttctccccctcccccgggcgaccgaggcgagatcttattgtaaagatttaattgaaacgaatacaccgaaataaatggatcatagactgaatgagtagttttggagaaaaatgattttaaagattacaacttacatatgcatatatacttgcacaaaagttatgcgtatatgtatcctgagttcctgacatgacaaagagatgaggaggcattagcatgatgaggcgtccaaagtttcttccgtgatcggacgctagatgggaagtatttccggcattctcgaactatcgtaccagtttcaacccgtgggagagggttggccgccagctccgatgctagcgcgtatgcgccagatagcagcgcccgatattttctttccggggcgtgggcggaatcattcaatcatcgatttcttccccaaacctagcctcctccactgctcccaacctgccttccgtcgccgccgcctaccctcgactactgatctacctttctccgtcggcggccgcgggtgcccagcgcaaccgcaccctctcctctccagcagcggcgacccctcgcctcataccctttcctgggcaaggccgggaggggatcaatctagggtttccgccgccgccggttccccggacgttgctgcatgacgatggaagatggaagctgtccttcaccagtcacccccagcgaagccgaagctggagccgaagattacgaatcttggacactgaagcagaagattgaggatctcgtcaactgtgatcctatccatggtatcgtgccaaaaaatcctaaatataaagcatatttcgaggaaaagttccaggtacgtacgtacatattttcttcgatccatcatccatggatgcaaaactaattaattaattttgacctcaccagctagcatatattttttttattgtatgcaatcgatcgatgaatcaagtggtatcatatctattgctattgtaggagaagttaagtaagtacgtccgtgttgtattgccgaaacttcgtccagcaattcagaaggatagcgtcaagcaattctttcaagtctacaattgttggtcaggtttcatgggacggggaaacttccttttacctgatatcctcaccaacatggccaacgagaacgctctgcgttgtgccagggtcgcactccagggcacctctcctctgttgcgtcgccgccgcgctgaccccaacacccgccaccgctatggcttcgcccccctacacatggctgccgagaacttcagcgtcgacatggtcaaactcctcttccgttacggcgcatcggcgaacatctgcaccaagggcgagtatgtcattgagggcctcctccctctccatgttgctgtcgagaatgccagcatgcacaagtacattgaggatcattgggctcatggggaccatatcatcaacctcatcttcctcctttgtcttcctgagatggtttcttcattcaattcctatccctattatattactgccagagcatttagcctatttcaaatactagcttggaccaataattaatttcagccaccactgacatgcagaaaatgttcttggacacgactagattaattgccaaacagacagataacattgtcgacgaggtatggaattacattcgtgaagaaaagcatgtccaggcagcaattttgctgctggctgctcaaaagcagctccgtggccgccttaacaacagcagtggcaaagcctctctgaacgggtttgatattgttaaaagccacattgatgatgctcttaacaccatacatcttgaggggttaaatatggttaaggagggaaagaatggcagggcactaaagagattgaaagacaagaaggaagcccttcttacagcacttgtactagttggcattgttcacaaagccggtgaagctcttgagggatacattcaaactcattcacaggtaattgctgaaatttccccattgttaccattgctttctgatacctgtgggttttgatttttccagtttcgttttctttaaatttgtgtgatgcttacttcccatgactttgatctactagtgactcattttctttaaatttgtgtgatgcttacttccatgattttgatatactagtgaaacctcgaattacccttgttttagaaagctgtggtgggtgtggatcgcttttctttttctttttggtgatatgtaaacagttggaggagctcctgctgcattgtatcaactagtcacatccatattataaaaaggagttaaaaagaactggacccatgcagttaatggcatcttttagcctccattttcatgtaaatccaagaggctgaatagcaggcccagcatagtggtagtatactgctaggttcaggtctaatgcatgagtcaaaaatatatggaaacatgggagtagatgcagtgtgttcttaatgcgaagcaaggtggcccaccatcttttagatgcctacgagtttaatgcataagtcaaggtgacaccttacatctaaatctatacaatgttgccaacttctgtattacacacatgcttaccaattattgagcccatgtaccattcgtttcccctttctaaagaagatctaagaggaggggaagaggtcctcttcagtctcagcagcagaatgcaagaagggaaaaaaggacatgtatcctgtccaaagaggcagagcaaagcgcaagaaaaagaacatagatgagggaagaggtgccctttccaaactagcagagcaaagcatagaacaagaaacagagcagagaagagggaagaacaagtacctgtcctgtgcgacggttgacagctggggaagtggagagcatgaaggagaagcagacccgtcggagaaataggggcgttaggaaggcaggctggtcctctgcatctcccccttctccttttctatctctaggccactagcacccctcacacaccagcctttcgactgtgcacgccacacttgctctccccacatgtgcgtacccccatggcacttgcggaaggctaagcgagcaatatgctctcttccactggtgcttgggcgcgaaaggcgatgcctttacgacactttaaaaaccaagaattgatatttgcatgaactatagaagagcataggggtccattgaaggtaagtttatctttttgggatcaggaacatataaaatttgtagggaagatcaattgttcttaagtatggtttgagaataaaaatataatagcaccctcccttggattgggctaccttttaaagtgggaccccatgtaagtttagcaaagcaagttttttagcttggaaactgagtctttgagtttttgtaaatattttcaattttattcatgaatatatgcgtattcagcaattttaattatgactccatatatattcagcttctattcttttttttttttaagttgagggctaacataatgggtaagatgagcaagaaggtgcgtagttgttatgtgggagatcatgaggctaataaagggaatagcacttagattatgtcaaggtaacctgcaaaagggtagagatgaatagatgatagtgttaagggtgatggtggtttgtctttagccccattggagtggaaacctgatattggatatgctgcccttgttaataatatatgtttgagtggaagtttatatattctttctctaaccatgactatgactaggaatcatcatattgttctctcaacaagtctttcatattttaattgaattcaagctctaagaaatgaacgaaacaaaagctggactaccctgaagcaacttctcataatgacccaaattacatgaccagaaggcctgcattatggaagcttttgttggtgctgaccagttctttttcttcctcatttatttcttctattcctcacctggcatgttcatgtaaaacgcaaaacacatgtcggattgttattttctttcttatttatttgctttattctacgtgcatgttaaagtttagtgagaatgcatgtgtcaaaaattgtgaccctctttcaccccacgtctctatgcacacgaagagtgggttctaatattttctgttcaactttacttgggtctgtttcgaaggcccgccatttcacagcatccatatatgccatcatgccacaatgaatatatca

SEQ ID NO: 50865 - DNA, 1414 bp, Oryza sativa
cttttttttttggctttctccccagttttcaacctgtaaatttgctctgcatggtggtgcttgtaaggccctctaattttcacagtggtcttatgtgttgttgactgtgtttgctctgccaaaaccggcaaggtttaaccccagaaatgaaaggctgaactaagagtggttggatggttgctatgctactgaaacgttgtctatcatctgtatcttgttccatgaattgcctactttctttgtgcattttttgttgagctttactttctgatattaaattgctggtgttatgttttcctgacgtagtggtcatctgtattgctgctgtgaatcattgtataatttgttcctatatacctgttctatcatgatgctatcagtgtttctcgtattcaaggctgcgtcagttttgcactccaggtgttgtgttttcccacgtcaacactctgtttaagatatggaaatcactcattgtctttctgttattttattgtatacagaaaccagtcattatctgttcgctctcttgcttttgtaattaacaaggagccctcattgtcttatcatctgtcatccaccatgttactccattcctaattctaaagatgccgactctgatgcagcactatgataaatgtttggtctcatcagtcgggacactgataacaaacagcactttagagtgctaaaatacagtaaccatagattccccttaatctttcaactgaaaacttcagtctaactaaccataatttaaaccaaattaattagcggttatttttctgactctataaccatgcatatactgtctgaagtagattcagagatggttttagaattaaggcaaaagattgttaagcgtatggccacctgtctgttagtataatgctgcagtaaagagtagtaataagcatatatagacaacagtggtagtcattttcagtcactaaaatacatacactcttattgtactgtaattcatggttcccttgagccatggtcatcgtcaccatcatcactcgcacttgcgtcgaaggagtgattaggagatggttatcgtgtgtgacgtggatcaagccagataagcatttcaatgtttttatttttgagagagagcagggataagcatttcaattagcaaatgaaaggtgtctgctatagctttttctgcaaggacaataattaatgaatctgaaagtgtgtcgtccttggaaggaagatggaaaggaagaaccactcattaatcaaacaagtgtcacaaattggatcactgactgcctgactggacaggaatgttggtgcattatcatgttataactaaaagatgcgtgaaaatcagtgagcaatcatagaaaaatcatcaagtgcactgttccattgttgacaagaaaggtttttcctcacaaactaatta

SEQ ID NO: 50866 - DNA, 2428 bp, Oryza sativa
tatctctacctaaagaaagatattcccctttggtattgacacaaaggaacatcaatcgctctcatttaactggcacgcacaacggttgcttcatcttcaactgctaattaactttctgaaacgctgatgctttttaatcctcttcttccccggcccatgcatattctctctgctttaatggtgtgaaatttcagaacaagaatctagtttccgcatacagagttccagaaatttccgactgttcatctcatcgatcatccgcgattctttttttagtttttgatggtgatcagccacaccgctagctagttgacacatgtatgcagtagcaatatttgttagctgaaaaggaagcaaggaggaaagcagcaaatcagctttgttgccaagctgcttggcaggtcacatttttcatttccgagttgattaatttgcaaccatcatgcatcaatacaattactatttaagcatattagtaaaattgtgtgaagttttttttttcaattaagccatgtcatgtgtgggggcgttaccttgcagactatataaatatgagtgaaattgacttgaggcgtcgagttgccttattgccaaacaatagtactattcattagtagtatatctgacccaaaacccaaccatttttccccctttgcgttgcatctcagtgttcttccattctttccagagagacaaagtaattgaccatggcaaaagatcctcatgtctccatctctctcaccggcctcgccatggtcgtcctcctcatcttcagctcctccttcctccaggccgcccaaggtacgtacacaccttcatcttcgcctgcttcatcatgcatcttggtgatccttcaagtcggttctgacttctcaattgatattcatgcatgcaggatcagacaagaagatggcaatgaagtacgacgtgccggtgaagaggctggtgtaccggccgtcggcgatgcaggcggcggtgatcggcacggaggcggcggcgtacgagccgttcgagctgtgcatgggctgccggtgctgcgcgtcgtcgaacgcgagcagctgcgtggacacgagatgctgctacgccatcgactgcaacatccccggcaagcccttcggcgtctgcgccttctctccccacacctgcgactgtggtgccaccaactgcaccagccaacagcagccatgaccacacacctcttgctgctgctaattcaattcgatctcttccatgatcaatatacttatgcgcctgaatcattcaactgttttctgatgcgattgcaaacgtattaagttttttcagagattcttgggacttagatatcctgacatgagcatgttgatctgaaagtttaactgcatatagaatcttcagaaagggattaattcttgatctaccagttccacaaacaatttattcgtgctttaaatctggatttgcattctctcttatcagagagtaattaatttgagggtctgatctgattaattgctgtagaacccactttgatgtatggatatggctgtgctgcctgtgcagactactagctagactgtagagaaaaggcggctgttttgtttgactattgcaggactagcacctaacactgttgttgtttgtatcctgttcttccttttcaaagcctacgtgccaaatacatgatcagcattcagcaaggtggatggtctagaaatcaagttgggcagtcacaggccggcacacgcttgatttgacaatcacttgttaggtggaaatgcaaatgaattgtaggtacaaacccacaatgttagtagcttaattagctcatcagctaaacgcctaaacctactctgaattaacttgaagtctgaaacgtacgtgatcgagggtactcatttcagcacgattaagcacacagcaatcaaggtgcttatatataagatgaagatactctgtctgcctgtctgtaagtgccagacatgcaactcgatcatcgccctagaaaacacatctctgtcaggcctgagcaaccactgttgttttgcaaataaaaatttcagattctcctttctccgatgatgcagcattggtttcactgatctgaaactagctacgaggaatggttagctttgtctaacaacttccttctgtttgagctttgggtttgcagacaatcatgtattctatggtcgccgggatcgccacggatcaaccggtgcagtgctctacgtacagcacactatatatattgcaaaatggatacggcgtttgttggaaaaatattttgtagaaaacacatatatagtaaaaatttggaaactaccgttaaaactaaaactgaacacctgagatttatacacatcatcgagagtaaaattttactcccagacaatttttttactctcgataacgcggacaaatattatgcgcctatttcataattcaa

SEQ ID NO: 50867 - DNA, 2564 bp, Oryza sativa
gggtggactcgacgtcatcgacgcggccagcgccgaagagcgcggagaggagcgccgagagggagacgttggagcaggcaacgggcgcggagtcggagaacgcgcggagggcgttgttggggcccgagaagagggagatggcgcgggtgagaagaccaggggacgccagggcggagtcgaggagggcgcagaggagcgagacggcgaggtctaggcggcggaggcgcgggagacaggacacggcgagggaaaagagcgggcgggagccgtggaggcacgggtaatcgtcggggcgggagagcgtggtggctacgagggagtgcatgcgggccagatcggcctcgccgcagacggcgagctggaggtcgaggatggagtagcacgtggaggcgggggtgggggtcgaggtgggcagcggcgggtgatcgacatcggggagcgcggagaagcgacggaggaggtgggcggggacgctagcggcgaggagcgggttgggatggcggcgaaggagggagaccatggttgagacttgagaggaatgggggtttgggaattgggatctcccctcttttttctcccttctctaggggaactcgtcaaggagggcgaggccatggtggcagtcacctcctccccttctcctgtcgttggccgccgacgccctcctccgcaactgccgtctccccttctcccgcgtcgccgccaccgccggtcgcccgtcgtcggccgtcgacaccctcctgctctcccgcctcaccccgcggcctcctctccactcgccgtccggcctgcagaatcccagtgagaagagtgaggagagagaggaagggagagaagaggagaaagagggagggtgatgacgtggacaccctgacttgtggggctcacatggtttactcagccgtaacgttggataaaattgggtcaaaatcactaaagaatctaaaataaaataaatggtttcgtagttgaggggtatcgtatatagttttgtggttagaggatgattttgcaactcgatgacaagttaagggacattcggtgtactttttcctaactgctatagtagggagcttttagcccatctgcatatagtggcctggcccacgttaggcctgtccattagtatgggccttagcccttcctctttaccgaaagcttcaccttttgaattgagcccatatgaacaataagacactatccatgttatttccttaaagataatagaattcattttagtctttacttttttaaaagaaactataaccaattatatagaggttacagaacgaacgatcatgaattacgaaattatagcttgatttaaaggaataattaaaatcgcaccattgatgtctatacatttcaatctttaatttctcggcacagtcgcatgcactcgcgttgcctcccaaaaagctcaaacagtttttgatttcgacatgcatagatacaagttgtggacaacttattcaggtacagtgcttacgtagttcaagatttctttatgacctgctttttttcttgttaattatggccttaatttgatactagtatatatcaagtggttcgcaacgcaagcaaactaaagttgcaatcacgcgggaaaagcagcaatgctgaaatagctagctagttagctttcacaattctgaaactattttctcctcttcttctgttcataatgtacggacacgactgtgagtgtcagagtgtcggcacaacaatttgattaatgatgcataggagaatgttttatgttgagcatgtaaattgttgaatacttccagtcggagaatgtttgatgttgagcatgtaaattgttgaatacttccacattaatatgcacgtagtatgggattaaaagcaacacaatggaaaacaaatttcggtatggtatatccttccccatatgtcttgagaatatgagataagtttagttaattaattaatttggttttacagatggaataaaatgaaaatatacgttaatatttgcatgcatgggttatatttgaattataacctgtgaaacagaaaaataacttttttttaagtacataataataggatctactatgggtttaatggattcgtgccggccggtttgcgcaaaccggcccagttgcccccgggtagcctacgcgttgtaggcttgcaactttttgcgagttggactaaaaaattggcttacagcttttaccccacctggcccatatccagcacacatacctttaaaaatttctatatataaagtttttatacagaaactaagtttctactaaaacgtcgtagctaaatcagaattggatgtgcccgcgtacgtgcattttgaaaatgtttctcaaggaaaactttgtgtataataaagtttctatgtgaaaaaatgtttttgtgtataataagaaatgtaaatacgtgctcctgatagattcacttaagtgacatgcccacgcattagacttttactaatagagtgcgtatgacacgatagtcattaagtcttttttaaaaattcttttattcagttttatctacaactaaaatctaatgctgactttcct

SEQ ID NO: 50868 - DNA, 1331 bp, Oryza sativa
gtcgggaaacttatggtatgcatatgctagtgttgtgactttgtccatgattggctcttgcactcatatgttcatggctcatgagtagatcagattgatgataggatcctgaagtttattaatgacatgtcttggagaaaattagtcacctacaactgttgaagtgaattaatgaattaccatggagaagcaggatcccaaagtatccttgctattaaaatctagtttataagcctgaattgatcatttagtagggagttggagggcaatcataatttttttaatctctcctctttttactgtttttcaacttttagtaggatatcaaattatataaacagatcagacacttttcagcgaaatggtgccatcacacatttttaaatatatatctaatcctttgttttgtaattttattttgtccattttggatgctatttaccatcctacgaagtttctgtttcagactctaaacaagctcagatgctagtactgagtattattaaacaagtttgtcaggatcataattattgatgaatagtttatttagactgtgggacccttttacagcttaatataatagccattcaactcttgacagtcatataaaggactcagtagttgaccatcaattaaaattttcatacacccattttatatgttatctcgagttttgtgttgaataactaaaaatttcccaactacttgtagattaagcaggatctgatctactttggtagtgagaattctaatacaataacaatcatatttatcatttcctttgctccgaaaaatgcaagtttgacaaatgatttcaatcttagaatagattatgcttttcatctcattttccctatattcatgtcaaatttgagggaatgtccatgttgagttcttcttaatgaagttaatttacatgtgtattttgaccaggcccagtgtttctatactcaactggagctctggagatactacaagtttctcacccagatatggtgaaggatataggccggtggacaccatcagagcttggtaagcctaattatctaaagaaatctcgcaaggccctctttggaggaggtttatttacagagaatggtgatgaatgggcctatcagaggaagataattgcaccagagttcttcatggataagattaaggtaccattaaattgtgattgcttgtaggtttcatggactgaaaactagaactcgtatcacgcgtgattgcagttgttatttatatatgcatgcagggtatgatccagctgattgaggatgcaactgttacagtgttagaagcatgggaggatatgattgacgatgtgggag

SEQ ID NO: 50869 - DNA, 6169 bp, Oryza sativa
  unsure (1)..(6169): unsure at all n locations
ttcagtagagacaaataggtagaaaacctcgccgtaaactgttttcaaacagcacatgcttaaagtattataattcaagcatggcataaactagacttacatgtcacaatcacagctataagtgatcaggtatgctaatttagatggttcatgctatattgctgttgtaggaaatacctgccaaccaagagcaaccaagaaatacagatgctggatgaacaagtccgcttactgatcctggatgtcgcaaaggaacaacaccactaccaagactcacacaacagtcttgtcaacgccatcattgatggtgcgcaggatggtcgcagcgctgcagaggctgaggactttatcgtcggaaactgtaagaccatctacttcggaggtcacgagagcacggcggtcaccgccatctggtgcctgatgctactcgccacgcactctgaggcaatggaggtttgccggggaaggtcgacattggacgtggacgcccttcgccggttaaagattgtgagaaattaacatcttaaaccgcattgttcatcgtagaaattaacaatggctgtttactgatgatgaatgacaacgatgtcgaaatgatgcaggtgacgatggtgatccaggagacgcttcggctgtacccgccggcgtcggtgatgatgcaggaggccctgacggacgtgaagcttggcaacatcgaggtgcctcgcggcaccatcgtgcaggtgcccaggctgatgctgcacctggacaaggaagcctggggcgccgacgccgacgagttccggccggaccggttcgcgaacggcgtggcggcggcgtgcagggcggcgcacatgtacgtgccgttcgggcacgggcccaggacgtgcatcgggcagaacctggcaatggcggagctgaaggtggtgttggccaggctgctgacaaagttcgccttctcgccgtcgccgaggtaccgtcactcgccggcgttcaggctgaccattgaacccgggttcggcttgccactcatggtgacaaagctgccatgagctagcagccctgttactcacacccacccagtcgattcatgacagctccagttataattgctggccacagacagcaatgcttgttataataaagctccttttttgagatgaagttgttaagcactctaagctcgttgaacccaatcaaagggttttatgatggagaacattgttgcgatccattcttttgggttgaaaaagtaagagaggccatcactcccttttgtatgaaaaaaaaaaaggcatttgtctggtttgccactgacgtttgggtccaagcgttgattgatgggagtctaacaaagtgacaaaacttagcaagtagacagacagggctgtttctggagactgcatctatctggaccgcagattcttcttaatcagtcagtttcctcatcctctttgcatcctccgcgccctcgcgctgatacttgtaatcaatcaactcatcagcatggtcttcgcatggagctgctagctgcagagtcacagagcccaattgttgagctcgaaatgccacggtgcgtgccctcactcatctcatctcatttattttcttagtgcaggctaacacttcctttaataacttgtgtggggaatgaattgagtcctctactcttagcagaggcccgtagttttttattcaagcaaccaattgatgttatctctctatattctagcagcctctaggctactatatgtctatatcttgtgcaatttcttgccaaattaatggggctaaactatcatacaacatcatgccgaaaagtcttaatttattgtttgttgaaagctctttactacaaggttattgcccaacctcataatctgttgaagatatatgaaacccccaaattgttcctttttatgccatgtgaataatttggtcataacagaccctggtttccttaaaaaaatgcatgttaaattaagttttcctaccactaaccttggatttcttttctatgttgtaaatttgcagtgttgtatgatcgttacatgctaactgctcagagtgagtgaggcgcttctttgcggctttatgtccttttcagctccaagcttcacatggagatggatcacccagcaaatatgcagtatacagtatatggatatgctatgaacatgtagtctccctcttctctcacacacacacccagatacgtacacacaaaaatggagctattctcatcacagcaatggctagcacttctacctccgatcatcctctgtatccttctgttctcctatgtgtatatcattctatggctaagaccagagcggttgaggcagaaactgaggagccaaggagtgaggggtcccaagccttcttttctctttggaaacataccagagatgaggagaatccagcaattggccaagtcagcacatgaacaagaagcagggagtaccgacatgttttcatcaaattatgtggcaactcttttcccttacttcctccactggagcagggtttatggtacgttaagaaacttgtagtgcataatagtttcagtaaaataaagtttattaattcatctttatattcgatgttaaatgtaattcattggaattttgttaagaggaatgttttgatattgacttattttttctctaaaatttctctttttattgtcccacataacaggattgtttttattttggggtgatgcaaacttgaattcagagagttttaggtacctttgtattttggatggtagttcgctctgcaaccatcgaaacataatttctttgattggggcctgtttatggatagctcatggtttcatatacgttctgatggtgtaccatatactgtctcatcttgtcgaccagtctcattgttaccctcattacatataagctatttaaattactgtaaattcttttgttgtatgttctgtaaccatgtcctaatagatttatttttagaacatcgacggatgccttgtgcatttcatatttaaaattaaagctgataagttcctgaaacattgatgttgtgttaggttccatctacctgtattccactggaagcatacaagttttaaatgttactgatccaaacatggtgaaggagctagccaactgcaaatctttggatcttggaaaaccttgctacttgcaaaaagagcgtggagctcttcttggtatgggaattctgacatcaaatggtgatctatgggtacaccagagaaaagtgattgcacctgaactattcatggaaagggttaaggtaattatctgcaggcacttgtattgggccatggatctctctgtcaaaaaacaatatttttcttggagcaactttctagtacactacatgtagcatatactaaaactcaatttattgttaaaatgacatccatagggaatggtgaatttgatgatggaggctgcaatgtcaatgttgaactcatggaaaaatgaagttgaggacagaggaggcagtgcagagattgtggttgatgagttcttgagaaccttttcagctgatgtcatatcaagggcttgttttggaagcagctttagtgaaggcaaggagattttcataaaaatacgacaacttcagaaagcaatggcaaaacaaagtatgctcattggtgttcctggaagtaggtatatttcagaaactacacatgtactactgtggcacatatttcaatttgagacaattaaaactcaaaagaatgctgtctttgaactgctcaaaatcctctgttgagctctttttttagataatgcttagtttgaatgatttcaatacccaagtagctgcccagattcaacttctgaaatcactataattcagataatgtgttactgttttggtttgcagcagtatcagaataaccttttggagaaatatacagcttctattttgtctgggctaacttacatgtcccattttggtctgatctacctgcaattcctacatatcattctaaatggatataaggcctaaaaaataatattttatctagaatccgtgagatactacagtagatccaagagtatcataacatgtattttccaatccataccatgggtgngnataattatatgaaaataagtggcttctcatgttttatcatcttattgtaattggttaatcatttaaggattttcctttatttttgtgctgggccgactaggtatttaccaacaaggagcaatagagggatctggaatctggatagtagcatccgtaccctcattttaaacatatcaaagaaatatgaacatgattcatcgacctcagtaaacaaggatctcctgcactccattattcaaggttctaaggatggtccctttgcttcatgcacgcccgaggatttcatcgtcgacaactgcaaaaacatctacttcgcagggcatgagacaacttcgaccacggctgcttggtgtttgatgcttctagcttcacaccatgaatggcagtcccgtgcccgggtggaatcccttgacatttgtcaagggagaccactagattttgacattctacggaagttgaaaaaggtatgttttgtcctctcatcctcttccagtaacagaagagatgaaaacaatccgttcattagattacagctaacaatggtgtgctgttgatacttgtgcagctgacaatggtgatccaggagacactccgattgtacccaccagcctccttcgtcgcccgggaagctctgaatgacatgaaacttggcggcatcgacataccgaaaggaactaacatctggatcccgatcgcgatggctcaccgggatccttcagtatggggtcctagtgccgacaaattcgatccggacaggttcgccaacggcatagcaggggcctgcaaaccccctcatatgtacatgcccttcggcgttggggtccggacatgtgccggccagaatctagccatggttgagctcaaggttgttctgtcactcctgctgtccaagtttgaattcaagctttctccaaactatgtgcattgccctgcgttcagactgaccatcgagcctgggaaaggtgttccattaatttttagagagctctgacttgagattcttgaaggttatataaatgtttcccttttccccttgttatatttgtttggtatgtgtttgcaacaatgctgcaactcgagtgtaaacagtagtatattctacagtatgcaattctgtacaccgattgaagtgttacttatttgtggaatgaaacttttacttctcgtctgtcaattaatggtttagacaacatcaggtgaaaaaaaactgtgaggtcaggatggccgagtggtctaaggcgccagactcaagttctggtcctctaacgagggcgtgggttcaaatcccacttctgacattatatatatttttttaatataatattcattcatggactgataaacctacgtgcattgcccttcgtttatgtttacgattgaaatagtatttatgtattatgcacggttatttacgtttggccatttgttttatttgttgacttttagacatacgtttaactatttattttattaaaaagattatgtaattattgaaaaggaggtgaaattaaatctttccaaatttccattaaccctatctcatctagtcatcccaattccaaatctaccgatcagagccgagagcaaaggctgcaaggatcaagacctcgaaacatagatgccgtgaacgcttcgtgctatgttgcccatatttcttggatctcatttgataactttctcgtttagtagtcgatagcgatttttagtgtcaatttatctaaacaaaactgataaaaagcgtttgtcacacttttcttcaccaatttgaactagctaatggtgatatgtgcatatttttatttgttttgaaggatatttgcttgagtgtattttggaagtttgtgacaaatggaatatttggaagtttctaatgaatggtatactcgtgataatattgtaggcaataacttattatgttttaactagtccataactacgtactactcacgaatattctctatttattaaggaaattatgtgcaatacattttcggaagtttttgcactagcaagatgggcataaaccaacgaaaaaagacaaagacccaacaagataggctaagactggtggagatgggtgaac

SEQ ID NO: 50870 - DNA, 1340 bp, Oryza sativa
aaacaaacatgtccacatggttgccaatccaaaaccttcaaaattggaggaacatgaccaaaaatcggcaacaagaatagatgaagctgcaaacgctatccagttatatgagcttttcaccatagtagaagacgagaacttcataataaaataccaaaaattcgaacaactcaataacacacaagaaagtatagtacacttgtatcttagcaagccacctcatacacttgccatcgccgaatagggaggacggggagcactgccgtcctcaccgcctatggaggctgctggcgtcaccattgtcgtctactaaggacaggggagcaccgctgccctcgctgcctagggccaggtgagcactgctaccacgcgctaagggaggacgtctatcgtgcccaagggggttggttggctacgggagcaccgccaccgtccctcgcgagttgcaatgagagaggctggataatgcctccaccatcaccggacggattccatctatgtgtattagatgataaaatatctcggattcatcgtcaatctttcattttaaccctttcattttgttaatattacgaaaagttattcattcaattatttttatgcctgccctcgagtttatatgtatttcacataaacttctttatactggtagaattaggtatcaaaatctcacaggattattctttaacctcacttgtgtgtttcatatgaagagataaatgacagaacaaacgtatgtttattctttggcctcattgacgtgtttcatacgaagagataaatggcggaacaaggtatgtaaagttataattgtgatcttcacccgtcgtgaaacttgggtattttgcttgcaatagataaattccagtaaacaagaaaaatagaaaattaactgtctcttaatcattatggtcttcgataacctgcaaactggcctcaagccctcaacgtagtatacacatcaaacccactcagtttatgattatttgcacctatagatttctgagtgatcacaaccattattttttttcctaaaaaagaactcatttttcacctaaatgatgatatgtataggcacacctattccgcgggaaggatatgctatattgctacacgtgcgccaaggttgcccgcccaaattagttttccctccttttggtgcattttactcttcaacccactgattctttatttttcacatatattcctcagtggtccagctgagctcgtggatgttgtacaaaggaatagaattagcaaataatacattctatggggtgttttgtgaaaactttgttttattttaataggggggattgttttggcggcgggatgcctca

SEQ ID NO: 50871 - DNA, 10504 bp, Oryza sativa
  unsure (1)..(10504): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgcatcaagagcaaggccgggacgtggcaattaaggagctctccctcccttgttaagctctcgaaaagcaggcagatacgatttcctgcgatctgaatatctgatcctccttgatcggatttatagagattccatctcattacactgtttgtactaaactcttaactttttgtaataataacgagtggagtacaatggcaggtatgcctccaagtaatagtatagcagccaaaattgcatggctgcagaggcgtttctggtcagcaatgtgatgtcgtgtatcgtccgctacttgcatgtagccgttataagttggtcgcttcttcagttcagtttccattttcctgcaactattctgaacttctgctcactactcttcgctagcttccatcttgatgatggcaactttgtccgtcaaactaaacagatcatgttcactagtacgtgccatcagcatcagacttggtgttgatcaagacaaggtgatctgaacttctgaaccatggaatggaatgaatagttcttgcacggataaatacattcacaaagctacagtttgcaatattgcaactctgatccactgttgataatagtcattgatagtggtgctaggctcatctccgtccacgcaaacgatcaatgcagtactcttccaagaaattagtgggaataagaaaagtggacgtggcttgggacttgccacgtcggaggatatggtttgggtcccacaaaattccgtacaccagttgaacgaggacacgtgaggaaatggtggggacgggtatcctgtgatccatcgggataagtccaaaagatacggacatctacgaacgaattcaggtatacagagaatgagaaagttgaagagatgctggagctttctcctttaaacgaaagttgaaagatgctgtttgcttgcactgatgatctaagctgcatcatgttcatgtcaaagaatcttgttttgcttttcattcaactttgcacaatgaaatttggtttttaatcctagcttacgaacaagatctaattcaatttcgttcaattcgtccattgcctggtgtacgttgcctgcacgtacgagatcgaagataaagaagaagcaactcgaatcgtgtccgacgttggcctatggtgcaaatagtatgaccccacatgtcagagaaacaacaaataacaagccggctgctctactacttgggctctgggaaggatttaggcccacggccacggcgattggaaatcgcaggagcgcatgttgctgctttgtttttgctgggagagagtttagtaccacctcggctattcagctgggagaggcggtcgcgagagctataaaaggagccggagggctccgtttcaactcatacctttctcggccttttggctaagatcaagtgtagtatctgttcttatcagtttaatatctgatatgtgggccatgtgtccactttgatattaaatttattttttgtgggggagggtccaccacagtggcttgccactggggccctcgcgtgtcgcccaggcgttgcactacagcccgggcctggcgcaccccaaccaaatcaatcttaaatttgaacgacaataatgtataatgtctttaaatcggtttcaaatctacttctctgattaagtttaaaattttaatttaaaaaattagtctaaagaggtgctctgcaaaatattcatgatttggatttgtagtgttcttttgcaaaatttgcctccttccattagcgcaggaggccgcaatgaccaagaaaaagccacacccaaaatgaaaatgttactacttgtacaatagaactagattagcttatctaataaaggagtgttaacactttaatctcttcacctagctgtagaattttacattttccctgcccatcttttccttgtaaaatgcattcatgcagtaacaagagcaagcatgcagtttgatgatgattcaggaggcagcagcgtaggtgacagatgacgccttgtgcctccgcctgctgctcatcatcatcgtcttcccgccaccatccgacgaccactgagactgcgagtgagagctcttcttcgtcttcgtcttcctcctcctctccgctccgccctgcgcccccaccccgagcatggcgatcctcccgatccctcgcgagatcgacgccagcagcgcccggccgtgctccccgccgccacggccatcccgcatcccctgcctcatcaccccctgctcccgctccagctccgtcagccgcacccgcatccgcgcgatctccagcttcagctcccggttctcccgccgcagacacgcgtagttgtcccgctgcggcgacacgcacgagctcgccaccccgctgccgccggtcatcatcatccgctgcgacagcgacccgccgcagccgtcgccgccgagggaggtggtgtggggggtagttgacgacaccgtggacttgaggcggagctgctcgaagtagaggacgcgcaccaccgtctggatggggaggcggtcgttctgcgccgcgtggctcgacgcgtcctgcgacagcttctggcagtcgatcagcttgcacatcttcttgcactccgactccgtcagagatggatgagcctgtttgttatcacaattcagttttttgtcaccacacacagcaagctatacatcatcggacactatacagattgcaaatggttctaaagattacatccagaattgaaagtattcgtgccacattttcatcaacattgaataatgttgtaatgctgacagagtggcagttactgaatttgccattggacataatcagaaagagttatcaaggtttgcagtacagttagcttaccttcaggtatatgtcaatggcacggtagagtccgtcatcaacaattctcgcatagtccggtaagagttcgatgagagccatgaacttctgcagtttcagatatggatctggtgctatttctgcaaggtaaccatccatcagtcttccaaccttcagaaccgagctgtggctcggagactttagtccatcatcagactcatatccgcaaggtgataagttccctgaatcatcttcctctatcctttgcaagaagttcaccaatatgcgatggacagtgtcgacatcaaacatcgagtcactcgtctgcgttgcagggatcagaagatcatcaagtgatgccatctcaagctgaagtccaatccttttctcaacttcaatcctataatctagtcctgcatcaacttctattgccattctcagcatgccaaacaagaatgacaaggtaaccgatgtgatcttttctgttgccaacagatcaatgagcgtctccacaatcactcgttggttgtctccaacaagaggacctgagtcccatacatggcgcctttcgatacccttcagagctgtttgagcatagtgcacaatggatgtgccaatactctctggcctcaccccagttcttctcattgcgacgataacacgctgataatagtcaattcttagtgcagaaagatcctcaacccaccaatcttgacaatgcatgcgcaactttcctgatccgacatcacattccaaatgagccaagcctgaaaccagctgctccttgcttgcattcatcgcaattgcatcgacgcacatgtctacaagtccaacgtcttccactgttggatccaatccatcacaagcacataggacttctagggatttatcaaggttcttgactacaatctcattcaagtatgtctccgtccgaacaatgagattctcctcttggtactcttctgtcatttccaaatactctgcaatgcaccggagatgagccacattgacagtattaatttcaaaattactcccataacagaacttggcagcaagttcaaatgctaaagctccccctggtacatttactagctccaactttgagagatctggatccttggattcagctaccattcttcgtattcttccacacctagagactagagggaactgcaaaattggtacagaagtatactatgatcccattttgcaactttacttcagactatataatcttatattagttatgcagagataaatatgaaatacattttccttgctaataccttcctatgaaagctccttttcaccaaaaaaaaaaaaactccatatgaaagctcaaaaagcattactaatgtacaaaagaacatatacaaccttaaccctgattttcccgttaaccaattactgctttgtctccaattacacactcttatattgactaacaccttcagcctatatgatcagaaatccctgtcgacccccactaagaaagatatatgccttttgcagagcgctacatttaagaaattgtgaatattgaacactaacctacagtacaaaaaattatatgcttgtataattatcacatcagtaaggatatacattatgatttttatgtccccaaattgtaataaggtgttcacttcaatcacattggttctcatgttaagcaaattaatatggaagtcctactccacttataacattgtcaggtaattaatcttcctgcaaagacaatccaactgcccaactgagcaataaccccccaaaatatacttggcaggcttgtgcagtagttgatgactaatgataaaaaaaaatgcaacaggaaaaatgacaggctacagagaatgggtaagatgaagctattgaaatagataaggcaccttatgtagtagaaaagattggccatccaccgatactgttaaatctccagcaacatcagaaaatatcctgcacaacaaggaacattcttgaagttttagacaccaagaactgcatttgcatttgcagcatgtgaatatcaagtttgatatgcttctcatggtagttttgctacactcttctgggaacacataagaattgatcacatccctttttacagaggaatggaacaaagccatggtaactgctacagaaatcaaatagctggtgcagattatttcagtccactaagacatactaccaatgtaggttccaatcacaattcacaaatcaatcaaacatttcgtccaaacaaatcacataagaagtagatcctttgagttaaattgctaacgtttgcaatttttttctcccaaaattgactgcattttcttttaggaaagagagacagagaagggggggaaaaaaccttcattgacttgttcagaggttgagaaccagatgcagcataagaaaagagaatgctgaggtagggacctgaatctagacaagtgacgggacgagataaaaaaaaaagtgcagacgttttgtgatgcccgggaccatccgatattccgatgaacatttttaaggcttgccactgctttcttcagtaatacaggggataacttcagatgtcatctgataatctgaactctgaaggtagcatttgcgagaaaccagtatttcagcgggttcggagaaatgaactccgacccccacctcccgattccagtatttcaggggttcggagaattcgactccaaccccctgttatttttcaagggattcggagaattaaactccgaccccacttggccgagctcgaacacctccggcgtggcggggctgagattctcctaccaccattacacaaggcaagtgaccctctccaatctcctctcctcatggagtggctgcacctgcacctgcacctgcactgcagcagccagcagggtctatgcctttctctgcttctttcagagtcccagagaaatgtaacatgaacaatccaaacttgcgcagcaaaatgaacaaaaactagttgcaactgatctgaactgacaaaggacaagtttttgccaaaactagcaaactataggaacaccagcatgcactcgccattgcattttgtgcaaaagaataaaccgcggcaaaaccacacccgagctcagaaatggaagggaaaggaacagcattggtacaagttacctcctgctgatggggttgcagaagcgcggcgaggcggcgagcttggcggcggagaaggggaacgacgcagggctgtcgctggccagccccattgctcagcctcagataccaaaccctcctgcttcttctttcccttccctttgtgtagaaaagaaaagctctgggcaatggcggagcggcgatgagtgaggacgaaacaaaagaataacggatgtgtggcctgccatcattaagatactagtaatattttaaacaaatcattaagatactaataattcaattcaatgacagacattcttccaaaaatccattctttaattctttcgtctacttttcttcttgcacattgcacatttgccaaatttgccaataggcccccctgtctggctgtctctgctttccctttcttctacaggccactcagctgcatgactgcatgtctgcagataggaagaattgcatctttcaaggtgtaaattagcaaagagggtctgtgtgttggattagctgagaaagtgacactgatggaggaacagttggctgactaggggacaaaggctggtctactgtcagcttgtggatgcttcaagaattcagtcttcatctcatgtggccatactactagtgcctttgcttcttgttttttgtattttagatgtgttacattctaacatttattctttcttttctccttaataactaacttatggtatattttttactggttcccaagtatgttatgctctgtatctgttttagaggtgaaatttcacaatgtttcaagtgccatgtaactctagaaaatccatgctactgcaatatgtagcagcatgcactagagagtggagagaggagtggggttgaaggctgtcggtgaaggaaatgattcggatgctttggctgccatggctccttgtccactgatctactcgtactagagtagagagaatggacagctctaacttttcttcctttggcttttacttttgcttttgcagagaggatatcgaggagaagagctactagctttgatcgggctttgtttggtcaggtccaccatgagaaagccacaagacaacccgactcgattactcagcagcctatactgcttgttcatactccattgccggtcagaagcacgaaccgtgccattgatcatttcctctcacagattctttgcattcatgcttgtctgcctacagattttgcacatcaagcaagcatccaggctactgttgcgctcgtgcaaaacttaccctgttatttgatcatcgagaatacatatgatccaagcagtgattatgattcacttgatcatcagtctctctgtccgtgtgtgttatttccctccctccaaactttctttgtgaaaaatttcttttcagagatgagatagatcaaatggggaaagtacagcaaagtaaaatgcaaatgtgctaaagctttgagctgtttttgctgctgattgatcgatgctttcaaattcctttctgaaaagcaatttacatttgctacaaatactaatagcgctctgtgagggtcatggctctttaagttgtcttttctatatatggcaccatgtaatatcacaaactgcatatactactgtaacatgcctgcgcgtggttgactgtctccttggcatgcaggcacaagttgatcatggcagtggggagtaaaatgttagtgggctggacacgttgagacatgttggcacaaaattcgatgaaagtaagagcatattcagtagtatatgataagaaaatgtgtaaattattttatgaactattgcgacgatacggattactcctctaaattacaaaactaaatatttttcaccctcaactttttataccggatattcttcgaccttcataagaatgacaaaataaaaaaaatatctcgatgtatttctagcctgttcccctccttcaaaattgatattactctactatgcaagaaaaggaggtcgaagcgtggaagcttcatgtgtatcgtctttacatgcacggtataaagttagtagtatagatttgagctgcatgctttaacgacctcgaaattggatcaaaggcttgctttcactatctactcttgcatagtagtatgtgattaattgtacttttgtgtagctcgggatctgagattatatattattcttctgtatgtagtgcagtcgttcatgcagtaccgcgcgtgtataggagaaaatcggtgcatccattggcgtgcatatgtcctagaatttacgtatattacagtgaaattggttacttttgcctagatgtacattcagaaatccattctatgtgacagcttataatcttatcaaaatttacagaaaaacttgggaacggagtcctgtagacatcggataacttctcctagtaaatatctagccctctcttttcacaccaccgattcaatcttatcctctccattatctcttctcttaatttcctctccacacgcgcacacacacactctctctctcacactactaccctcatgagcacggaggcgacgatggcggccggccgtgcggggtggcacgtcgggcgttgaggaagctgctgtcatcgccgccgccgttgctgctggtgtaggtgtgggcggagtagagaagatcgtgaagctatttatggggtaggtgcctgagcacatgatgaaggtgaagctgctcaccatgttccaggatgtggccatcgtcgacaaggtcaccgtcatcaaggacaaggcctcttgtggtgtggatctgtacacccagatttaggcttgtgactctcgagctcttacattggcttgtttctaaggtttagtttggggttttctacatgttatatgggtgtttctacagttatgatgactttttattgagctctttgttgatttttcttgagttctctcttgatacatggatatccttttggatagactagggatattttaatagtatcatgatactctagtatatcacgttgatgatatcatgatacttaagtatcatacatgatacctaccaatatcataggtgatacctatacaattatcaggcatggtacctaagtacccgatacctgctacccaggtatcatacactcgataccaaggtctggtacctagtacctaggtacccgatacctactaccaggtactaggtatcggatttggtacctataggtatcaggtctggtatcccaggtatttggtaccaagttgaggagagaagggatgcatgtcgttgccttttggctgccagcgatcgacatgccattggctcttcttctcttcctctcctcgatgtctccctcattccttgcagagttgcagttgatgtggctaagcgaggaagcaagggggagcgttgctgcttcattgtgttacacgtagttgcttaggcaggtagagaaaatagaagggttcattaaagtgtatcattataatgctattccgtactgtagcagtcctccaaaatttaataacaccaaaattcgaaatattataaatcacatataacaaaataggacttgaactactcctgttagcaacggtataagcctagctaaataattgaaaggaataagttcacttgaggtctctcaatttatcgccgagttcgaaagcataaaaccaggtacaacttatccctcaacttataaaaccgtgtaaataacgtccctcggcagtattgtgtctggttttagctaacgtggcgtatacgtggctcatttaacgaggtcttcgttccacgtgcattgacgtgacacttatttgatgttgaaaaaaataattaaaactatgagaccgacatatcatctacacaagaaatacaaaatggtggggccacatatcatcctcactcctccatcttctctatccctctctctcttcttccagcagcacggcgccgctggaaaaccgccttcgccgcctcggcctcgagcgcgtcccgggcgtggtcctcctcgagctccgcgaggcgtgtggccggcaccggcggagcaaaggagtcattagggagctctcgcttgcctccgcgaagccctcgcctcgcgccgcggtggcggcggctgcgacggcatcgtcgttcgcgtactccgcttcgtcgctgcagcggcatcgtcgcccgcgtcctctgccccgtcgctgtgggggaggagaggaggaggaggagggtgggggtggtgcgctccgccgtgcccgggatcgccgcggcggggctgcacaactacgtcgccggctgcgacgaccccaccaaactggagagcagcgaggtggaggccatcgtgagcgagtgttggatttgca

SEQ ID NO: 50872 - DNA, 11812 bp, Oryza sativa
  unsure (1)..(11812): unsure at all n locations
ttctgaaactcccatttgcggttggaatgctagtaaaacttttgttctagcttgtttgcgcaaattgccatgcctataaaattaaaattataaatcacatattgaatgtgtctctcttactccgtcaaataattccttttactgtcaattattcttagatacggcgttagcacacaggatgccctctgcccggcccgccactgttccgccttcttcttgcagagttgcagtgcaggggtagagagaagaggtaggtgtgagaatgacatgtgggtcctacggttttaattatttttctgagatcaaattgccacatcaacaccacgtcaatgccacgttagctaaaactgggcacaatactaccgaggatctcgtttgcacggttttgtaagttgagggatgtgttgtacctggttttatgctcaagagacgaatttcgaactcgacgataaattgagggaccttaagtgaacttattcctaattgaaaaggacgtactccagtttcggcccactaggaaattatgggaagcaagtcttacggcgcagaaaagaattgggctcatggcaactatgataatctagggctccatcattatcattaactaagttaattaaatgcacaactacaccgagtccacgatcctcactgtcttgttgccactagttgtggaccacttcacctacactctccatttgtattaaaaaccgtacaatacctgggcattaatagtttcagatagactaatttcaaaacaattgtctcatcacacatgctgatcacgactaatctcctaacaacctcataatcttcaatccgaggttcagttcatactactactaccattgttagtcaacgatttatcaaatgcatataatctacctaccaagtaccaaccagtacatatggtaaccttactcttcaaaaattatcagaagcaggttaacgccttttctatttgaatcttgatggaaacagtagctctgaagctgtgccactatcctgctacccaatggttttacagtcgctccaacaaaacgtgtcaaaccagctgcagtggttaattaacacacaaaaacaacagctcatactccaacacctgatttaactaaacaagcactccagtacagcattacaaagcgaatgcaaccagtcacattagaaaacacgcataatcatgaggaaataggcggccacatgatctatgagctgtgatcagtttgtgtgacagcaaaagattctgcttagctgagacgcaccaccttcaaaaattacctgacacaaaacacaaaaactaccagcacaatcaagtaattatacattcagttcagttcagccatacattcttatctcccattacacaaaacactccctctctagccagctgctggtttctccagccaaacaagaggcttggcacacttgttttccctaggtccctaagcattttgtttgatccatttcagctggctggctggcatatctggctggacctgcccttcagttgtaaggctatcaaagatgccactcacatgtgtgcagggctagctaattaccctagacacatgcttgtcaaagcagcaagtgttactaatttactactacaggttgcttctgccaaacactacaatatcaccacagtacagtacagctaaaaaggaactttcagagaatgtgggcacctaatttgaattgggaactggattccatcaatacaagacaatctacaagcaacagctaaattcttcatgctagcatgatgtccaacataaatttcaagatgcaaaaagagcagctcacgccccctaaaaattcagagcattatccagaactcatttgacagattatacatgcgctcttttgatgtgcttcgcttttatgacacattttgagctacaaaactacaatcgagttcagtatattttcctctttcatagttcagtgaggacaataagaaacaaatgaattatgtaacatattgccactaatttatacagatagaacgcatattgtcttcctcattgatcatccaaatccccaatgacacctctacgcttgacaaaagtagaccaaccgaaattaaaccaaggaaaaagatacggacttattcattttgctaacagagctttcttcaatccctctgtttaattcatcgcctgccatcagattatacttataataaccttatttttctgtttcaaatgcttaaattcaagctgctaaaagagaaatatgatcaacagaaactcaggccaacaggaactaaaaggatatcatattagttctgaagaataattctggtaagtatcgtgtttagacttctaatatttctttagagattggccataatgtctgacctagaagaagataactaggaagaagatgatggaaatttgtcacagcatacagactggtggttaaaacaagcaaggatgaaatctaatttatcagactagttatcaaatcaattaaacaactaaacatgtacaattgtaccttacaaggtctctaaacatgaggagccaaaatacacaaaaacgaaatcgcttaagcttgaacgaatttcactgaagtagcaaaatgaaatgcacaataaaattccctcacctttattgccaagcctatatccttttgaatacagcaatccaaaaaataagggattccaaatctgacacaacaaccatttcttccccattgcttgcttggagatgaaaagagctccccactatgaacatggcaattatgaacatcaacatgagccattgtagaacaaataaccctccaaacaaaactgttaaaagaatgtgttaagtctcatgagccaagactatgccctacatctagcaatttgtgccgcactcattgatatggaacacttgttgcctcatccgaccgaagagcaatcccatgcttgccagcataactggttacccttgttgcctgaattccgctgaaatgtcaagaaaacatctatgcaacatactcgctctcaatcaccggttgtgttcttgtccccagtgctacaggcgcttgtgacctcccaacctgtgccatacgcaatgtctccccagtctctgcattctgttccatcagttccaatttcttatctcttttgtaccttgccaaacaaaccacaagcgacgccaacaggaccaatgctatgacgcccccaaccacgccaacagcaatcttccaccccttggagctgcccttagaacgacctgtaggagtcggtattggcggtgtaatgttgcctgaaggcactggaccaggaggaatcgcgctagagttcaccactatcgagaaatgccctcggcggtacgtcgagcacacattgcttgcctctaagtcccggaattgtggcacaccatccaaatcaaaccacacgcaccgaggagctggaccgcctgccggcaccgatctaacatcactgaaatttatagaaattgggctcccggaggcgacaaagctcagctcctgcaaccccaccgccgacaagttggccgcgtcgtagagaagcagcccgagcaccggcgagaggtatgtgtacccgggcagcgggtagtagtggtcagaccaattgccgagattgtggtagacgagcaccaccctctcgacgtacggctgcacgacgatgccggtggggacggtgaagtcgaagtagtcggagaaacctttcctccgcaggctgccgctgcgaaggcggaccgcggacagggcgacgccggtgaggttggccgggacggtggcgttgtagacaatgccagtgtgcgggtgcacgaaggcccggtacgcgtggtcctgcagcattgcgtccagggccctggccggcgacgacgcctgcgccgccacccgggaagtggccaagaagagcaggtggaggaggcagacgcaggccaagaaatccatgctcctgcagggggatcagggggagtggagcagcagcagccaggagctgaagaagaagaagaagaagaagagtagatcaggaggaggatctcctcctcctcatctacgaccgccggtgacggaatctccaccacttaagtcggggcagcaaggacgagatttggggcggaaaatgctgggaccaagcaccaccaaggacgcgcatttactccctgaacaacacaagggcgagctagctcccagtcccagtctctccctccaaagagaagactttagcagcaaaagagcaatggcgatggaagcgaggcacggacagataggaccgagtccaagatatggtgggagagggagagcgagaggaagacaaatcgggaggaaacaatgcaaaaaaccaagattggattggaaatggatagaggaagtgaagaattgggagggaacgaatcaatcttggagaaatccaatccaagcaagcggggaagctggctgccacagaatttggggagggattaacgcgccccacgaatgattgcgacaaccaagacgaggacttggagagaaggaggaggggtttggggatttgatggcgagagtgaagcaatggagagagagagaggctttagaaatggagatgatggtgagggcttctatgtgaattgcacatttttatgagggggttatatggaaatgtttatgttgtgtttccgggtaaaagacacgggattacagttggcacaccgcccaccagaatttactgctttgcccctggcctggacggctgagttgtgggtccaggctgtcagttggtctgtgtgcgcttttggcgacgtgtcctcttttctaacgtttcgattcttccgaggggcttttgtgcaactccctagtccctattctgcaaggtgagagggtgcttgatgtaaaaagtcctcagaggctgacctgtagggcccacctgcaacttcaaggcgtccagcaaagcaagagcttttccaacgaccagtgagaatgataccgaaccagaacaataatctcttttccaacgttaactgtcgagctcaggggcttttccaaaaccaaaacaaacaaaaaaaataaaagtggttccacgtggcaaagaagctcatcatcttcttgtgcggttggttcttgatcagcactcggaaaagattgtgtgattggcactgctcttctttgtttctttggcactttgaggatttgtttttgctcaagagtgaagctagcattagtgcattatcatggcgatgagatgatgtcttatatgtgacgcaatcaacttgtcatcatctcttccttccatcttgctcgtgtctttggtttcatctttgtctttgtctagtgcgaggtggatctaggaatatttaattggaggtgttgaacaaactatacaaaattatagccctctctatgtatgaaaaaaaattagtgcgagcttttaatcggggctctccacccatggttacaacgtcggtagcaagggctcgagaccccaccgcccctacgatggatccgccaatagttactaataaacaataatattgttcacttcgtatccaagggatcaaaagaagacagcactagacgctaccaaatggatatgcgcatttatatacgtgaagtgatgattgggctcattttggaacatgattcataatccagttggctagaaacaatgactaatcacgcactcatcactgactaaaaactttataacccacttacaccatatgtgacaaaatgctcacaccaataatctggtcgaatgcacaaattaactaatcgaagcgtccggccattacagcttctaattaagcggaagacactagctccgatacaaacgataaataattttaggtaatttgtactctttgaattctaaatccaagtaattggctaagacttataggcaatagcttaaacaatagttagtgctacaatattgtaattgcaagaatgggccgctctagctaggtggttttccggagactttgcagcgaagacttttattgctgactctagtttatcctctacagtgtcttgtgcatcgatcatactttacggacgaacggagtagtacagtactatcagaggaggtcaacttaaattacaaaacacaagtcaatgccattgatgaaacctaattattgcaagaaagtactaattctaaacattaacaatgctcttgataatgacagattgagtaaaggagctggtcccactttgcctcgcgcccgtgaagaattatttatgcaattaatttaacaaatgatgtctatatgaggatgacaacgagctcaaaatcatctgcaatagggagaatatgaatttatcaaaaacagtattcacaagtgaatgatgggttcttctatataaacgaaaatgctatacgtacgacttgagtgtccgaccggcgtacgactgtgtattacacgacgtcaagagctgtgctgctgctgctgttctgtcatacgccgttaagtattgtgccgctcagccgtttcgtcgtacgccgatcggatgacgcagtcgcacgtatagcagtgttcctgtataaattcagacattagacagtaaattactatcccaaccagcaccttaatttgtacgtaaatacaaccatagtggtccagaacatgcaggagaaggtttgatagtggtgttattgcaatcatcaatgtgcaatacatttgatccccaatgcgtggacttatgggtgcaatctatgggtactactagctaccagggtgatcaatcaaaatttgtcatgttcttggccggcctcacacatgcatacatgctggcaaggaccattgtcctcttgttctttctgagagtcataaatatgtaccgatgtacacaagctagcttaggccacaaaattaaggaggagaagtcagaaaccattctgctcttcaaaattgcttttacttccccaacttgatcaagacagagtacgttttaagcagtgaatatacggggtgtgaaaatggtaggaaaataggtttaaccatttccgtaatcatttcatttttctcggaaatgaaattaaaaaggtagagcccaaaataaaaaaatgggaatattagaaaatcataagcagaatgacagaatcatactggtattgatcataaaccgtgtcaaaaacattaaaccgtaaaatcacatttgtaatttattgtgactatataatatgaccacgtaaattcaagttcacacctacgtaatttacaaaccttctcctttagctatatactcaaattagagatttagttgaggagtcaatggacctctaaactatgagccaaatagagacattgaccaaagataatatgttatttttagaaatacggtatttactgtattatagaaatggtaatttccacatctaaagtattgaaagaactaatctttcttgcaaaattaatgtgccacgccatcaaagaaataaggaccgttcgattctcgctctagacgttggtggtcgttggatcctctaattggcatagtatattctagacccttgatgaaactcctatctatttctagtccttacacatccttatacctcttttgtttttcgggcctgttcactttgatattattttcaaccttaccaaattttggcattgccaaaattttagcacatgcaacttgccaaaattttggtaggatttcttatatagttactaaaatttggcagcaaactaaatgtagccacttttttagtaactttatctaaatttaatatggttgaaaatgacatcaaagtgaactgagccattcattttcacccttccccctcccacaccgtgagacacccaccataacgctctgtcttctcgcactcgccgcgccgtctcgcactcatcgtcgaccttggagccgcccgccgccgccgctgcctcatcgactcctctccaagactccatcgccaccgctggccccctctccatctgcactgctgcacagtacgtatcctcccatccaaaacctccttctgtccagcggcaggcgcggcagccacacctccttatgtccttcagtccttcccatccaaaacgccaccacgtcgattcattccctcctggccgctctctagctcctcctccatggtgatgtctcctggtggcttggagctggcaacaccggaggaaggtagtgatgaagccggctcaagaaggcccaaaacgccggtgtgacgaacaatgcgtcaaatccgatagcggacaaagacgattgtagattaccattaagtaacttgagtacagttgaggaactatcaagtagtagtatttggatttgtaatatggatgcttatgttcagctgaagcatcaacaattgcaacttgctacttctgaatatcactatgagtttgtcctgattagtgtcggtttcggatgaaggtgtctgaacctttgtgtagacaatagaagggaaattcgatgaaaaataggaaaatgtgcggtttaattttggtttcatatagtcatcctgatttttaataggattattcttacatcagagtgagttagtgtcacaatgttaacccctacttatgtaattcgtgagtttctctgcaaagcttgagcatgggtcaaaatgattgcaatctatttgatgtatataatttttttatcaaggattggggcctcactaccttaaaaataatttcattaggaagcagcgaattcatggttgccagtaatggctatcatttgtagatcttttgaacaaagctgaagccatatccagaattaaccaatggatacagtgcattaggagaagggttttttttttggtggatcatggatagttgaagcctctatgttgagagtatgtcattatttatacttaacaggagagcttgctactttgcttgatatgccattattctttatttcctatgccccttcccttccagagcataaatggtcttttagtttgaatctactaagcatcttctgctattgtcttttagtatttctgcaattggtttattacttataaaatcatggtgttaaccacctaatttggtttacataatttctctctcatgcataatccttttcagggcaatctactgcatgaacacactggtagcagttgtacgtatatacctggtcctggtccaaggtaatactccctccgtttcgaaatgtttgacaccgttgactttttagcacatgttttaccgttcgtcttattcaaaaacttttatgaaatatgtaaaattatatgcctacataaaaatatatttaacaatgaatcaaatgataggaaaagaattaataattacttaaatngngggaataagacgagcggtcaaacatggctaaaaagtcaacggcgtcaaatattttgaaacggagggagtagctgattacacttcttatatatccacctcagattgcatgtttttgcagagaagccatgtgaaagtgttcctggagtttggtggatatgggcaaagtgatattcttttaagaaaatcaaagacatggtgtgtatcacagtgagtccaattgtcaattttcttttctaactcatgttgtgaacggagacatgcatgttagtggaaatcctgagctatcacgcaggttatgaattcctcattcaagttgttcgtgatagaaatactaaatacttcacctttttatttcaggcgctacaagctgcagaggttccatttcaccatgtattgtacgttaaaagtcagtgtttccaatgtaattgttggccatacaaattgcaggatggttgcagcagagcagtagagcaattttcaaactacataatagggtaatcaaccttttctgaacctccatggacgtgcttgctgcactactcaacattgaattagcacggatgtgacagagacaacgagggcagattaattacatgccatcctttcttgatatttctaacaataatatttcattgaatcatccaaaatttcctcactaactcaaaattgatcattcagatcattgggcattaaataggtgccgctcaattatttttcctgacaattcctacatgatatctattcacgatgacaaaatagagaaggtacttcttttacaatgttttttttttgaaatttacttcttttacaatgttggtattgctatttttgtatagaagagcagtagacatcaatacaagtcacagtaaagacattttcctcttttatctgtctagctttcttaattattttactgcagttcagcactctgaagaaccggacaggaatttcatcagcacaaaacaataccagattggacaaaaactggagatgaacagagactttaccggttgtaatcgccctgttatttcactacccaagtatggcatctcctgcaaaccaaatatttcagtaagcatgacatctcgtgcatcgaacagtaaaaaaaatttagactaatatgatcttaggctgcttaaccatggggaagcttctaactgctttgctccataccatcagcgtatgttatgtaacagtttatatgtacagagcttttataacggtatgtaaaaagtcgcgcaaagcgtgactaatgtggctagtaaatatgataaaaataaggaaacagaaggtagaatagcaaaattatttccgtattgtttaccacttatatttttatttttattggttatcgtttcaaaatagttcattcgagagaacatcggagacgagcctcgatcggtcagaaatttccaataccattttcgcccccatgcaacacagcacacgatgatccttttgatggccgacattgcgaaggaacttgctaacacaaactgctaaatccttttgtgtacgtagtgaagctggaattaagcaggtgactatgttcttcttggcaagcctaactagtttagttagcatggcgtactgaaagtctgaaggaaaaccaacggaaagtattctacagtggtttgatctcgcaacggatctgatattcctcacctaacaaatgcaagcatatatactctacagtggtctcatctcgatcgatcaatcccctggatgtgctgaatgtcggcaaataatttatcaacagctctgtctggtaacaaatgcactcctgcttatcaggatgggcttctgcacatacaggtgtaaatgtggcctttactccctcgtttttggcccaatatttatatttggaaatgttggttcgagccatcagcaattacaagagcaagcgtatgtatgtacttgtaaacagaataatggatcatgcaacttgatatgataaccaacaggaaatcgaacaccagaatggaagaatatagattcaaagggtctagattcatgcacaatgtgaagtgacaaaactgcatacaaaagatacgcattttgcgtattcccgaaaataatttgacaaaactgcatttcattagcttgatacactaatctcgatatacaagtggtaaactcacccttgaaaattttcctcatttcggctattcacaccagtcagttgtttcaccaacccaacatagaactcaaaccatatactgagaattgcagactttatctatgtattcacaccggtcaatttcaccaaacctagacagaacccaaaccatacacaaaaccaaaaatctataattaaattacatttgcaaacaaatgtggataaagaatggacaaaaaatatatgcacagcagtcacaaccaaaccaattccaggcccagagaggacaacgaataacattcgtcaatctgtgtcaggtaccaatgcatttggctttgagacatagcttggtaaattggcagcactgcttttagaattgctggatttgggggatgatgactcacatgagctgaggattggagattcaggccttgaggggacaggagatagttcttcacgg

SEQ ID NO: 50873 - DNA, 13542 bp, Oryza sativa
cttggctcagcaatgctgtagcttgctgcgaacatcgttcagagtaggagtagcagcaaggacacacgacaagcaagctcatccacgaggccaatgcaagggatgctgcctcctgattttcttttttttcccatctcatagttgatagtatatatttgggagaattttgtttggtaaatatttttttcttgtgaatgcgatgaatccttggtgaattttttgcgccctgtgcaacttctgtaaaagtgatatccaagctctatcaaaatttgtcaagtttggtcaaatttgagagcaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgcaattgccctatgaagttaataatcagcttaaagtactgaaagaccaagaacaactataggggggttgaatatagtaattcaaatcttgcccccgaaaatactcatcaagccggatttctcaaaatccttactagaaccccggctattagagaagccggatctagaaaagaagaaagaaggaattcccgaaactagaagaggaagagaaaaggaattcccgaaactagaagagagatgaggaggagatagcaaaactcatcatcgcaaagttcaaattgcaagcggaatttaaattgcggaatttaaatgaacaaggcaaaaacgaaatctttcaaatcatttcattcataggtgatgcaaaataaccgctcaactaggagcaaacatacaccttcagaggaacattaatacaaacttaaaatctctcggacaaacacactccaaactaatcctaatacaaaagcctctcgggcaaacacactccaaactcacaccgaaactctcaccgagcatctcaaaaggattaaaaaagagcaacctccacccttgcatccatttctctatttatagcctaagaccccctaagacattgtcacaaatgcccttaaggcaaaccctatctcagatgcaatcctggctgttcgttcttccttacatccgaaggaaacctcctggatgcttgccacggcgttgatccaaagcttcacatgcaaatcaatctgcgtgctccctgtcttgacgaatctgagtgcgacacgttgccgcgccgaaatcccgcgcacgcgagaccgcgctctctcctccatgtcgggcccgcatgccagcgagccacccagtccgaagccgctcccgcgcgcgctccaaatttcacgtgggtcccgcgcccgcgcgtgaaaccgatgccgcgtcgagggagaggagcgcaccaatccaaaagcgccgcgcgtctcgccgatccaatcccgtgcaccgtgtgggtcccatgagagaccgcgtctcgcgcgtctccgcttgcttgtcgaacaggagaccaccacgtgtccttgtgccatacgatctcccgcctccgcgcgcgcatgcacctgccgagccgagctgggccgtcgtcttgtctagggctgctcggcttggcctcctcccgtacatcaccttgggccagccacgtgccagcccacaagccaaatggccagctcgggttggcctccctgccaactgagcccatgcatggctagctagcttgacttttccaccgagccatgctagtagcaaccggtacagtgcaagctcctccttgcacatgtacagtacgtgtacatgcatgtatgctagctacagtaagtagcagcaatgcacttgcacagttctttctccttccgattttttcgcgaatcctggcgcttgcacacttgaccttgcgaagcccgttgcgaagacctcctcacacggtgtccgcccaccgtgtgcaaccttgtgtctaatcttgtcacccggcatccttgatcgttctggacctcaacccctccctgagtctagtcccgatccaccgttgaccaagatcgactccgatcatctgcacacacatgaaccaaacaaccgttgtctcggcacagatgtcgcaatctgaccaatgttagtccacgcacacacttcttgcacttccagtacttgtcaattttccatcacaaaagaactataaccacacatggttttacaagtaccaatgcttaatagtttatccgacatgatatagtggttcaaattttcatcaccaatacatcaggctttcatatcaaccaaccacattgtgcaacgtactgcaaaatttgcatatctttttcaaaattgtccagaaatgcaagggaaagaagaaatttcacacttttcaatggtcatagccagagttttgggatgagtcatcacaaattcaccatcaagaagaatgtagttctgataactttatcatgagaataaaataattccagggttgcttgcttggaaaacattaacataccaggtcatcatcctcttcagttttgctccctttctgctttgcttctcgcaagaacttgttctcctcttctagctgagcacatcgctgcttcgcaaaagctagatcagcttttactgtttttagttcacggagcacaagttttgctttagcagccattgcattagcaacctgaaacattttggggggatatgagaaaggcatcactaatctgaaaatgtttgtccaaatacatgggaagaaaaaaaaaggtcttatttcaagccatattaaccataaaaactgataaccaagaacttagcaaaaggaaaataagtattaatactttttaagtacaagcatagcaaaggttttgccatattaaaaaggtccaagtttctgtacgttaaacttccactactagacccagcatgtggcaccttacatcgcgagaagcttttaattgggtttcctgggctgcagtttcagcttgatcatgtgaaagattaggaggtcttaatgtatcaaatgctgggttcggcatataagaattcgaattggcttgcttccttctaatttgtatcttctttgtctcctcaatgatattggatgtcttattgtccacaattgtgagtccttcctgttaaagaaagaagagaagaagaggttattgaaaccaatgtgatactaaacgagagaaaatggaaatcccagaaaatccagaacaacagcaaagagagatgtagagttgagaaatcaatcagatgggttgtgccattagttatactaaatataaagagctgaattaagctaaaaataggacattacttccaacgcatctctgattcttccaccaagttggttgacagaagcagcaagagcttccgaccttgtccgggatccagtatctcctgtcctgctgtggttttcaaatgaccagcgagatcgagattcctaataaatatcacaaattttgagaacaatgtgaacataaatacaacttggaacatcaagatatcctacttattctgctttgtttttctaatacttgccacctcacctgagctccagtggatgaatcaaacttgcgaggggtcttttgttttgtgtactcgtcagacttatgtgctgtgccatcctcatcaagaattcccttggcttttcttgccaaagtttcccatagcccaagcttgggctcgttcatacttttgattgatgtgtaactgtacgatgaagaagagccctattcagagaaattgacatgcttaggatacatcatttgtgacttgtgagacacacacagacatctgaaaggacggtgcaaagtgatcattagagaccaacatcagttagtgatttcttttatccttttggaacaaaatgttttgtttatctgtaggtgataaacaaatgggatgatttaaggagtttgtacattaaggaacaaaatgatcaacgaaccagcgaggagccgaaggtggtcgaatcagcacatggtggtttcttaaggaactgtgatgatctgatcgataggcctaagaaattgattctaattatctcacaacaaaacaagtaatcttgcggttattttttttcccagagtaaaatagtagtaatctgcagttaaacataggaggattactgtactggttaaggggaatcagtgtccttttgctaaacaagcttgtcctcaaataaattaagatgcacgatcaatcaaggcagcgacaaaaaaaaaatctaatttgatccgatcaacagggattgaaaactgggatatactactacagtactagaagcaagctgaagagtgagagacaaggaggggggagaggggcgcatgcctgcggcggctgggggtaggagctccggcgatcatcggcggcgatggggccctgcttccggcggtaggccatggtggcggcgcggcggcgggtcgtggcccggacccggagtaggagagcaaccaaccaactctgaatctccctgatgcctcgccaccttcctccctgcaaactgcatcgatgcttttgcatatgaaaccctcgcctctggataaattaaattatttaccaaattaggtacagttacattttgtggggaagagacattcaaattcagtggatctccagagaaatgaaccagctggcggatagtttggcaaaatcgacaatttccaagccaaaatcaaatggcttttgactcttctgatatttccaatatatgtgaaaggtctgattatcatgttaaaaaggacttcttcttactcctaagggagatgtaactatagattctgttttaaaaccttttattacataaataaatatcatgagttctaaaaatattgtgattggataagaagtataggtagttaaaaaaatttaatagtaaatggttatgatcggttaagaaaagaatattggtacataaattgttatattttggaataaattctaaaagctaaaaaataatatttttttagaacggaggagtaatacatagtaataatcaaatatgaaatatccacaatgttggtaatgcaatatgcgaggaagtagtgggtgcagatgcataaacataaaaaggggaaagggaaaaacaagagagaagaaatgccctcctcccttctgctggtttgctttaaaagctggcaacagcgatgacagtaatctggagcgggaggtggggctccactccacgtaccgaacccaatagcaaaaagtacactgaagtccctcaacttgtcatcgagttacaaaatcatcctccaaccacaaaaccagatataaccgcttacttttgatccttccgtgtttttgacatcggttttatctagcgtggcagctgagttagcgtgggccccacatgtcaggctaacagcgtcatttcccttcctctcactttcccctctttatctcccttcctctctctctcatcatctcctctctgtgtgggctggcccccggccggcgggtggccgggtggggaggaggtcggcagggcgaggcgagagaggcgcccggcgacgggcgatgtggaaagaggtgctcgcgtcgatgcggtcgtcgtcgccgccggcaaggtggggggaggtggaggcagggaaggggaagagtggagggagtgggaagggcggcgaccggcggcgagagtgcatggagagggaggagacaaggaagccagcggcgagcgcgcaggtagatcctcttcatcgccactttgggccgcctcgtcgcccgcaggaggtggccaagtcgatgtcggcagttctacgtcgcctccatgtactggttcatcaccaccctctccaccgtcggctacggcgacatgcacgccgagaacaccggagagatggtctacaccaccgcctacatgctcttcaacctcagcctcaccgcctacatcatcggcaacatgaccaaccctgtcgtccatggcaccagccgcaccaggaaattcgttagtagtcactttctttgatcgatcccttgctgtttcttgatcaacagcaattctttggtgttctatcttggttcagtatactctagtactcacaagtcacatcacatgatggtttcttggcgtgtgttcttggttttaatcacatgatctcaatgtgatcatgtgatttttatttctttccaattcttgttggatgttcgtgaggagtagttgatatcttctgtggtgtaatttgagtgaaggtttcagagatgaatgccgagtactttgcgccgagagaggatatcatactgcagaatgaagcgcctgcagatctctacatctgaagtggcggcgagcttggagagctggggtagggctcctcgcggcggccggcccggaggcaggaagccctacctcgcgcgccggatgcgggcggcggggaatggccggtgaggtggtatggcgcgtagagcgcgtcatggcgccgatgaggtcgcccaccaccgctccgtcgccgcggcgaagaatctcctcacggagctccacccgttgcccacatccccgctgccacgccccgcgctgctcgcgctccccgccgcgcgcgcccgccacatcggcctgttgtgcccagctgctctttgccgccacagcggcaccgcccgtggaagagaggaagaggagaggggagaggaagccgaggctgacaaatggggcccacgtgggttccatgccgactcagccatcacgtcggataaaaccggagtcaaaaccaccggaggacctaaagtgaacggttttgtaagttgagggatgatatatatctggttttgtggttagggacgatttggataccactagctcgcgccgacgggcctggcggcagcggggcgagcgacggtggcagcacggcggccacggcggcgcgaggcttgcggacggcggtgaccggccgggcggctagtaatgaacgacggcggcggtgccggtggcagccgcggctatgggaggcagcaacggcaacacccgtggtggcagcggcggtggctgacggtgcggaggcagaggcctcggagctcgtcgcagcggtggtgtcagcggctggacgacggcagcagcggctgctgtggcacggtgggaggaggcacggtggtgcgttcggcagtagtggttgcggtggcagtgaccgcggtggtaccggaggcatggcggcctcggacggctagccgagggcgtggcagacggctgcatttggccggtttacaaccctgtagggtcgtaaccaggaaaaaggaaaaatataccaccacccacacaccgacaacgtcaacacacaacccgggataaggctagcaccggaccgcccgctgctaagcgtgaccgaccgccactaagcgtgaccgaccgccactagaccaacaaaggaacacagacgagatcgccccctaggggatgccaaaacgacgtcttcaagaagagaagcgacggaaaaaaccgcctccgccgtccgtcggggctcaaaggagccaagactgggcttttgcccggcaaccgcccttgaggagtcagacagcacgacaacaccctcagaagggggaatgaaccatcgttgtcggcccggccaaggccgggctaggttttcacccgccgctcacgacctgtgaatccatggctaacgcaccgatgctccaccaccactctagctctgccgacaagtgagactcctacaccagcgtccctcgccggctagccttcgtgcgccgaagactgcgccacacccatcgacagttcctcctcacaccaaggtcacttccaccaccgctaaatccattaaaaaaggacaaattttagcggagggggctgctacgggcaagttgagtactcagattcggcgcttgcttgacatctctctttgaattttggacaaagccgaccaggaatccagctgaatgacacgagttactctcccgagcctcctctttattcagaaatgaaaccaagcgttgagaataagtccttcccttttgtgtgaattcccgccggccgcgcctctcgcgctaagccagcctccatctccgcctcccgcggtttgaagccaaattttggcatgcctaagaaaataggccatttcaatattgaacttaggctattttggcttcaatccaaacacaactttacctcaccaaaattaggcatgccaaaacttaccaaaatttatcaggcatttttaggcaaaccaaccctcgatgacaagttgagggaccttcttcgatgtactttttccaacccaataacgtggaccgggccgacagatctggcccataactagcatgcattgttttccaggccttggatgggcttttgtgaaaatacggcccactcggtggatgtcttgtctccttatctgcaacgtgcccacccaccagtccacgcagtctccttgctgtgattgtgtttggcgtttgcttctgcagttctgctgccacattgttgatttgctcccaaatcccaatccgccgccgccgccgtcgtcctcgacggtagccagctccgacaggaggttccccgtgctatccctccctctgcaatactgtggttttgctctgacttccatcggctagcctaggcgcaaagcaacccaccatggcctcgcagccgttgctcttccggtggatgcaaccccactgcaaggtactcctgccactaatctcctctgcactcgattcaactcattcccaactgatagctggtgttcgtaactatgtactcctatgtgtttacgcctttacggtagcaggtccaatcgctatagtaaaaatactaccgtgtggaatttgctcagatggtcaaactccaaacactctggctaccatttccattcatttctcattagaggggaccggccagtgatggtctggtactgttaagacataatttttcaaagctatgagtgtagttggcatttgtttcatttgatggtatatatggcaaaactgttgtatgtgcacgagagataatggttgtctcacatcttatacaagctctcttaggtttactagaaccaaacttttctactttgatatcatcttttttttccctctgtgctcttgcattgttcacatgctattaactcacttactcacagatgttttacttgcttcaatattggatattttcaagggagattaagactggatattttgttgcccaacgattacaacagcgtacaatttaggaagcagactgtttttctgaaggattttttttttaataaaaggaaccatactgttaatctgtagtgatttggttacacttgtagttttcttgtctttgcagttcattagatcaaatccatgtttctacatagaatgactgaataacttattttaaacatgttttgctaaagatagagaaatacataatgctttctagttatacgcttcctctgcaaagtactaaaattatttccatttcccattctacgctactagcaggatttacacagccactcattcatttagtacttgacatgtttttgagtagttcgtttctgctttggtcatcttttcctccttctcttcgttaatctagttactttcatggagtataagctgggcatggttttgtttgataacgattcaaatttgcagtgtgtggatgcagattgatttttcagtttgcttcttccgttgggaccccacacaattgttcagtccagaaaatgtgagtttcctgccttgcagttgatcaggtcaatgccgatgcatctcccacgctccctccaatacccaccctcgactccacaccctctacattccaccgccttctcccacagcctccgccctcgccgtcccaatggtcctcccccagccttcgcctctgccgagttcccaggtaaccatcttctccattgtggaagacttgcagcatttggataggaggttcttaaaatgggaggttttgaagttgatgtgctctttgcaagtagaatgcatgttttcccccatttaaaatggcttattattgcgcccttcttttcatctgggtagcagaactagcaccaacagctaaaatgtccccaaaactagcagaacagctttggcactactaaaccctacaactaatgcaggttcagttccagacagtgcccagatgccaccacgacgccgccgccgccggagtgtggctggcattgaccaggacgatctccttgaccccgacgccctcgccgacccagacagcagcttctacgagatcaatggcgtaagggtccaccacaaggtttgcacccatgaggattccagtgaccaatctccagactctgccatcacaaacgcggaccaaaaccaaattggtttgcccatagtgctattacatgggtttggctcgtcggtcttctcttggacccacatcatgcgccctctagcccgcattgctggtgccaaggttctagcctttgatcggcctgcctttggtctgacatcccgaaccatctggtctggtgatgacaccaagcctatcaacccctactccatggccttctcagtcatggcaactttggcattcattgaccaactcggtgccaagaaggccgtccttgtcgggtacggatgtaacacaacatgtgttgttctatactttaatctgtgtgcattacttgatgaattacatgtgtgtgatggtttggattcaggcactcagctggttgccttgtggcagtggaggcatactttgaggcaccagaaagggtagctgcacttgtgctggttgcaccagccatttttgtgccagttttcaggaggaaaggtgtgaaggagaatggtgtaggtgaacaagaatggcagaataagaaggattccaatgattcaaatttgcctacaaatccactcaataggatttggggaaaattcctcgagctatgcttgtggattgcagggtttcttatgaatatgattagggcaataggtggtgttgttcgatctttgtattataaatctgttgttgctgttcttcgatcatcagttggcgtgatgctggtaagttttttttaatctctagtgttttagctgatagcctcttcaatggatactttagtaaatgtgtcaacaaaagtaagtaaaaattagctaaacttgaattatcaactctcactgactaactgaatagcagacttttccagttcacaaacatttctttatgaattgaaaatagtcaggttgaattcttttcttgattggactttggtgacataggtaagattgatcatggataagtttggtatattggctgtccgcaatgcatggtatgacccaagcaaagtgacggatcatgtcattcaaggttacactaaggtgacttatatgtctctgaaaattctgcaactatcggatccttatgcaaagactgaaaactatgtcttttcttcagccattaagatccagaggttgggagatggctcttttggagtacactatatccatgatcatggattctatatcatcatcgaaagtgcctgtctcagaaaggctttctgagatctcgtgcccaggttttcatatacactctacttttgggatccttcaatgatatacaaataagcaaaaaaaaaaactatttgttatccatgtttgaatttgcattcaggtttaccagtgaactatcattattttggacaaatggttggaattatcttgcatgtggctgataaatgatgttactttctggatggtttgtgtgtgtttaccattgcagtgctagtggtgagtggagacactgatcgccttgttcctcgttggaataccgagcgcgtagcacgtgcgattcctggtgcaggatttgaggtgatcaagaactctgggcacttgccacaggaggaacgacccgaagaatttgtctctgttgtcgaaaggtttctgagaagagcttttgggagacccaacaacgagcaagagcaagtgttgcaagcagctgtatgatatgaaaccagtacctgtagataagcatctagtactagataaccaatacatgtttagatgcgttctgtactagttctctgtaagccgttaaattttatttgctaaaaataatatcattaagttaacatttgaatttacttttatatggttatgattttagtacatgggaaatttaaagtaaaaatttagctttggagaaggtatcaagtttgaccgcaccttatttagtgggacggaagtatacaagattagtagatcacaataatctaatcaaatcaacttgctttttagcacaaaaccatgcttccaaacttaaagtgcaatccaccaacccccacgactactccagccatggttttcaaaacagcaaaaaaaaaaaaaagtaaggccagctacatgaaacaccccttgttttttttttaggggggggggggggggagcttagttaagaagtatgcctttcttccgtaaattagaacgagcaggaaacattggaacatgaaagaaaataaattagtcatggagcacagtttgtggggagccacgtgaagaaaccaatgttattaatatgaccaatcaacagccgaaagaaatgaaattacatactccctccgtttcaaaatgtttgacatcgttgactttttaatatatgtttgaccatttgtcttatttaaaaaatttaagtaattatttattcttttcatatcattttattcattgttaattatacttttatatacacatatagttttacatatttcacaatttttttaatgagacgaacggttaaacatgtgctaaaaagtcaacggtgttaaatattttgaaacggaggtagtatataggtaattctaggtagtgtttggtttcgggactaagtgggatgtgatggaaccatccctgatttttgggttgggatgattccactcacatgtttggtttataagatgggacaatcctaattttttgtttggttgaagggatgagagagggaagggatggatgccgtttgcaatcaccgtcaaccgatcgccggatctgccaccacagtcctccccatcgccagaggaagagcaagaggatgagccggcggcgagcaagagcaagaggaaaagccggcggcgagcaagagcaagaggaaaagccgccgccgctccttccatcgctggatccgccgccgcccctcgacttcctcctcgcacgccgccgccgctcctcccccgtgagctcctcatcacaagccgctgcagcacctccccatcgccgaatccgccgccgcaccatcgccagatctgctgccgcccctagacctcctcctcgcacaccgccgtcgctcctcccccgcgagctcctcctcgcaagccgccacagtccccatcgctgaatccgccgccgcccctcgacctcctcctcgcatgccgccgccgctcctccccgtcgctgaatccgccgccgctcctccccatcgctgaatccgccgccgcagtcctccccatcgccggatccaccgccaccgccctccccaccactggatccgccgtcgccaaacccccccaccgccgcggtccgcgttgccgagccctgcgtggtcgccgtcgccgagcctgccgctgtcgcacgagccgtctgccgctgctcccgagggcgagcagcgcgagcacggtaggaaggcgt

SEQ ID NO: 50874 - DNA, 2192 bp, Oryza sativa
cagtgtgatcatcaacaccagcaaaatcaaacccttaggtgcccgggatatgagcaccatatgcctctatttctcctgttttgcgagcaaaatcgatctcaaaatgtctatctaactctagggcgtgcgaatgtgattgtgcatcacctagcctttttatagactttttaatgtcgatatttaatttgattgatgtgcatatatgctagacaatgaacctgactgctgcctgcaaggatggcaaaaagcgcatattaatggcgtacgtacaaatgtacaaataaggcaaattaattataattaatacaaattgattatatttaatgccaaaaagatacactatccccatttctcagggttgctgtctttagagcaaggctaataatacaaccgacctgctagttagggcatcaccaatgtatatgacaaaagtggtctatatagatgggacccatataaataaactttaactatagcaatccttacaatgtatatggatacaatgtaatattaggagaagagagagaagtagagatatataatattatttatgtcatatgggtagtccatatgcatatggataccttttgctatttcctttatatggactagttgcacaatgttactagatggctgaatggaatagtttattccctatggactacttttgtagtatattgtggatgccctaaggtttttttagccttctcttatcctactcatataatagttagctctttacaattaatatagagcccacttttttctctcacagagtttcttggttcttgtgtccaagccgactgtaagtttacagctcgcttctcctctctctcctctattctctcatccatctcagcatttagccggcttatagtctactattatacttgctcttagcgagcacgcggttccaatgaacactttactttctctcttttatgttttggattccatctcttctttctatttgccatttacgacccgagaattctcaagtagacaagataagtcacaggatatgtcgatcctcccggtttatttctcgttcacaatgaacctagactgctaccaaaatggcagcaagtgctatgatcgttgctatcctacttaatggcgcacatatgtgtgaaaactgcaaataatatgaattaattggatttaatgcaaaatagatatgcctatccccatccatgtttcgcatattcaccataaccctcggctcgtaggacggagcagactacaagcgacaacgtactacagaggaggcggcaaaaaccctagattttgtttttgcctatgtgttgcgaggagatggcgactcgatttatataaagataacaagacacgtaatcaggatacctgcatgatctccataacatataaccgaaccggataagtcgcaagtaacatatccggactccacgccgctagctgcctagctccatgcaccggattattcagagtgttttcaaaagactatgtttccaaaaacaaacactaaatttcgcagcaaaacaaaacagtaaaaaaaagatacatccacgcaaggatgagaaactaattatggcggaccattcacgctcacgtcgcgtacacgcgccacctggcctagccaggcgagcgagcatgtgtgtgtttctcttgtcctctccaccacacatgcctcaacctaagtggctaggagagcactctccctttgaaggaggtcaccatctcatataataggtaaggttatactaaatatcctcatgcatatatccccatgaggtgggattttgtgatttttcaaagaattaatctccaaatagaccttagcctatatatgaattctaacacttccgttgtagggtagataccagtctcaaattgctgttctccataggatggcccatggctagcccccatagaaggatgtcgcacagagacgccgacgtcacctatgatgccaccgaccaacttaatctcactacaggtagtgacggcggcggcaacgtcccagcagctagacctgtcgccactagcctcggccctgctagctgtaacgccccgattttcgttcgggattaaaaatcatttaataatgcattttttagaaattaaataaaagttaaagcaatttaatcaagtgaaataatgggagaattaaaattttcctttaaaaatcattggccaagaatattttgtaatat

SEQ ID NO: 50875 - DNA, 3014 bp, Oryza sativa
ccgccgcgcccatgctcccgcctcctccgggccacgtcggccacgcccgcgcatgcgccgcacctcccgcacccactctccctcccgctcgcccgcacctgtgcccgagacggccgggattcgaaattcgaatcccgcctctctctccacctccacctccccacgttggccggcgaaatcgggccactcccggccgttcccgacctccccgcccctataaaatccatccccgcatcctcctcccctcttttcctttttccgccggcctctcccgagctctccatcgctcccgcaccgtgcacgcggccgcctctaactgctgctcccactactccggccgcctctaaccgctgctaggttcgtcgcagcaccgcaccgctaccgccgttgggttcgtgtggtcgaggtccacctcgtccacccctcctccgtcaggttgccgcgagccccatccccgtcgtgcgccggtgagtgacgccatggccgtcgccttcggccggcgccctcgccctctcgcactctcctctctccctctaacccctctccttttgttcgttaggaggttccggagctcgtcccgccgtcgccatcgtcctccgtcgctcgccgtcatcgatcgtcgtcggtgatgcctctcctcctcttcctctctctctcccgcaccgtttagccgtcgcgccgctgcttagccgcgtagccgccgcttcgccgcgacgccgccgctctccgtcgccggccgccgtctcgcgccgctgccgcatgcgcgccgtgccgtcgtgcgccatggccgccgggccggtttgcgccgtgcccgcgcacgccggccgcgagctcccgccgccgtccgatctaccgggtagatcggggccatcggttcggctgccgtgtggccgccgcgtggtcgctgcgtgtgcgccgcgtcggcgccacgtgtgcaccacgtggtgcgccgctcctccccggtctgtggacccggtccgccgtggaccgccctcccagagtcactgccatgtggggcccacctgtcggcgcccttccccttgttgacgtcagcgcttatcatttcctttggaaaaatatttaataattgcgcaataattcgttaataattctagaaattcatttaaatggctcaaaacttctaaaattcatatctaattcattagaactccgaattgagccatttaacttgcaaaattcatctaaaattgagatctacatgtttgtttactttttatgtactgttttcttggtttttattagagtttttcctcattttgcgtgccagcgtgtagaatccgtcgtttcggaagtccgcggtcgcgcaaggcaagtcacgcattcccctttagcatgttgatcccaatttataaatgtttttaccgtttgcaaataaatatgcatgttttgctaattacatgggatccgggtattacctatctgcttgcttgtgccatatttacttgatatatgtcctttgtcaaccttgggtaataaatcgactaggtcatgttacttatgtgacctagctagagctatatgcttagccattcttaattaccactagcttagttgatgggataattacaatattagacctttttagtatcagaatgagctgcgtgctcgagacatctggccatgcttcatcgtcgtaattatccaactaaaatgtgacttcatggtgggctgtgggtgcatggttttgctagtcgtgcccatggcaattaaggaccggttcgcgggaaaccctggaagaatttatcgtgcttaccacaagccagcgtgggcaacggctgggcttgtagtgtagctttcctctagctgacgcatccaggcaagggtgggcgtgatggagtttggatgggccctgcgacggcctatgcagcttccggattcacctaggcacgagaggggactgcccgctgccttgcgaggagtgggggtgaaacctgaggtgtggtgtgcttggctagagggagttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgtggttattcaccgtgattagtcccaccttaataaatcgactcaatgcactgtagttcaggtgggttggttgggcctgttcaacgtggtgtagcattgatcagtggagatttaatgttactttaattactcaacagttttattgttttgctcaataaaatgttttacaacagcctttatgcaaatagccacaaaccgtccttgtgtcccattgcacgtctgcatcgttggtgtggcttgctgagtatggtggttgtactcagtcttgctattattcccccttttcagaagtgtagtgcttctgagctgaagacgaagttagaggaccaaggctcagaccccagttgagttttgcctgtggagtggagctgaagccccgctaggatcgtcttttccgctgccgctgcttttgtttcggtgtgaggactaagtgcctctcctgtaagtattttacgctttatttacgtttggaactgtttattacttgtcattttgtgtaccctggctggtcctggacagagatttaatacacaaaatagtctgaaaatttaggctaaatttctgggcgtgacactagcccataaaaggatggtctttgttgtactgcttcaacaggtcgctgcagctctcattatcacggccgcaacggtcgccttcgcggacatccatcccgtggctcctacggccattgtcggagcgatcctccttgttgcggtcgtctttcgctctatcttccttgtcgtggccactctcgttttcatgattagagaggaactaatagaagcgtggcgacgacaggtgatgagggaactcattgaaccaccgatctggcgctggctcgccatccgccacaccaaggtgccatggcgggagttggagcttagcggggcaa

SEQ ID NO: 50876 - DNA, 2305 bp, Oryza sativa
ccactcaagattgtcgtcaatcggtctctgcatatggcagttggttcctcctgcccaccaccaccagccctagtttaggcctcccccatcaaatctactgccatccccgactagtatacctcaactcttcaatttctcttgattcaaattcaaatgagggggatgcttcctctgctctgctgcagtagcgcttaattgacaaggcgggggtcccgttgtttcgcgctgcgatctctcatcacttcttctccgcaatctctagctggtaatggtattcgtcttgttgagcatatatcctataagcattttgctactacttcactgcagaactggcgctaatcacattctttctttctttttttatgttttgttccgcaggtctactttgtccaatagcgaactgctgaccaaattcagtgtgccctgttcagttcatcaggatatccatgtctgaccatcgaacacacgcgagcgactgtcatccagttgccagccaaccagatgttcagtgcctagtttgcacaaggccgtttactttggatgctcaggtgaccgatacctttgaagctttagccatatgcagggactgcaagatgacagtactcaatgatgatgaaagagatgaaataaccagcacttatcggcagaacacacggaggaggcagatatccaggactgcaagcattgatttcctggaggacgcattcttgcaggagttttctcagctgatcgacttagcaagaagacaaggtcgtgaaacggatattgattcttcgtcggtcgcgccgcaacatgcatcgtttaattcaacaccaagccaatctcaaagatggcatgcttcagatgatgagagcgatggccttaattatgttgattctgtgtttggtgaaattgaatctgccatcagtcttggtgactatggtggagattcagatacctccatagaggaacatagcgtgatgacaaggaggaggatttccattcaacttgacaatgacagctacatgaacacagatactgatattgatcccatgaatgctagactggatcagtgggattcagatgaccaggaagatgtggaagagtctggttttgatgaaatagtcaacaccatgacccagcaccagcagcaatcacatgatattcagctaagtggattgagtgaggacgaatctgaagatggtgtatggaattggagtgtgagtgtacgtcaaagagcaaatgtgaccaacttgctagatgacatggaagagccagaaatgaggacaacttttgtcgggaatccagatgactatgttgatgcaaggcagtttgagatgctccttgagcaatttgctgaggacaacgattccagaagaggagctccaccagcagcgacatcctttattgaaaatctcccctccgtgattatctctgcaagccatcagacaaatggtgatgttatttgtccagtctgcaaagacccaattcctaccagagctagagcaaaacagctaccatgcatgcatctttatcattcatcgtgcatcttgccatggcttagttctagaaatacatgtcctgtctgccgatatgagcttcctacagatgatgcagagtatgaaaggtccaagcaagccacaaccaatgtaagagacattcaggttgtggaagaaatttctgatgaacaagaggtccaggtaactcgtcagatggctgctggtgtgatcgaagagactaatacaagtgaacacaatgttcgtgttgatgagcaaccaaacagtgcacgcaggcgcagtggatggctttttattgctgctgctccagttgtaagcctcatcggtttcgctctagttttatgctttacaaatcccgctaggagtggtagaaggcaactgtactgtagatccccaagtgccactgaagtacatgtggacaccaaaaagagttggtggtctatgttctagaatgttccgttggtacatctgataacaaaatgactatatggtggtgtgtgattgtttctttagaatagttttattttaaaattttcaaacgttgtagttgctgcagttaccggtcggagtgttgtaaaagaattcacatgccaccggttgtaaaagaattcacatgcctactttcttctgctactttgctcagtcaagcaaagtgtgtattgatacttgctatttgtttaacatatatgtgtcattggatgtcctatgcttccttctgttgttgccacatttaaaaatcaccatggaagagaagactccatttgcgttcagtgcttctgtcagaattctacccagtgtccagtggagag

SEQ ID NO: 50877 - DNA, 983 bp, Oryza sativa
tttcattagcttgatacactaatctcgatatacaagtggtaaactcacccttgaaaattttcctcatttcggctattcacaccagtcagttgtttcaccaacccaacatagaactcaaaccatatactgagaattgcagactttatctatgtattcacaccggtcaatttcaccaaacctagacagaacccaaaccatacacaaaaccaaaaatctataattaaattacatttgcaaacaaatgtggataaagaatggacaaaaaatatatgcacagcagtcacaaccaaaccaattccaggcccagagaggacaacgaataacattcgtcaatctgtgtcaggtaccaatgcatttggctttgagacatagcttggtaaattggcagcactgcttttagaattgctggatttgggggatgatgactcacatgagctgaggattggagattcaggccttgaggggacaggagatagttcttcacggtctaaatatgcttcaactaccggaaacatatcttccgagtaagtgtgattgctatcttctcctggtatactgtcttccatgtcatcatccaagggggcaacatcgtgggtggtgaattgatgaaaatctactatctcacgcaagaaacgattttcgcgtgcgtacatggaattttcctgcgccagtcttgatttctcggccaataaggtctccagttgcacacgaatctgttcaatagcatgttcttcaggcatgtattttaaatatgcagaagacatgttgtactcattacttaacagtgataagtaaaaaataactaaagtctgttgtacacaagcaatgaacctcttctaagtatgaagttagggacaatcgtgttcttgcccttactttagttgcaattgtgattttgcccctcttttttagggtttgtgattttattttttaaatgaagcttcagtttgcccctgctttagatggcgttaggtgggtccaga

SEQ ID NO: 50878 - DNA, 3939 bp, Oryza sativa
tacacattcatctaagatcccttatattttaggacggagggattagatgattatgatattaaacttgctctgaaatatggttagtattaaaaaccaagagagttgcacagttaaaaagtgattaaccaaccaaccaatccatggtgaagtgaaatggcagtgcttttaaaggagacccacaccaaacagcagcagagagcagagtctcttgctcccattatctatctctgtctctgtctgtcaatctcacgcacaccagcacacagccttttcttctcctcttcctcctcctccagttaacggttaaggcgttggtgttggtgcctcctctccaccaccgtccatcccactcccacgcgcacacagcaaagcaaaccaaagcaaagcttcgtttccgctgccccccacaggccactggacgaggaagagcacgcagcttcgcctctaccggcggcgcatggcataggcatccccaagaatgagagcttgggcctccactacaagagagagaggcagacccaccaccatcaacaacatcaggaggagtagatagatgggcaactgcgggacgcgagaggagaatgccgtcgtcgcggcgcacgcccaaggtattcttcgcttcctcggattgatttcttgggggatttcccggtgattgttttcttaaggatgctggttgttgggatgggatctcgggttggatgatctgaatttcatcaaaaaatttgatcttggtggttatttctaggtttcccctgatctcttggttggtgggttcagtggggaattgacaaaagcactgtctttcctttttgctatatatgatggcctatggcttattgggacctttggatgggtgttttggttgcaaatgttgattcttgttaggtctattccaaatcggcattttggtactttcggtttaggtttgattaaaatctaatatcaacatttgctccaaatgttcaacattgtctttctgttagttgcatatggggattctgggattttggtttacagtctacatttgctcaacatccatctttctttctttctttttctcttttttttttgttttttttgggggggggggagcctaatctccttaagctttctggtgtgattgctctatgatttcttttctgctgcatatcccggccaagttacgatcttactgtctttccttatcttcttggttgctgtatcagaaattctgcttcattgtgttcatcgggacaatttacaggcacttcccccaatagtgctgcaatttctgtgctctctgcttcactgaggcactgttgactttcagtttaacagaaatagagttatgatcctgcaagttggaaaaacataatcacttcttgcagtttgctgcattctttaagcaatttggagccctttttttattgcatgcaactctgcagtagatctggtctcctgatcctgtttacctcttgctgtaatcaacttgcccatgtatgtacttttttacagtatttttaggtagaataccattttataattgctaggaatcgccaacgctcgtttccagtagttctcttgttagtttgtgattatagcttccctaaatgtatttcagcaggattagctctctttcatccaaccatctctgtgaatgctgaaaattcaatatgaaaaaaaagttttatttttatcttatatgtatgagaatttatggtaaccttaattcgtttttaccttgactattttttctttcttgttgttgaaatgtcatcttctcagttcagcagctccatttgttacaacatcctgtcaagaatgctgttgcagagaggaagcatacccgcatctcatcagatatgagtgatccttcaacacctaggaaaattgaagatgccaagaacatctccatatacaacgatgtgattgatttcacattgtttgaactcgagaccatcacaaagagcttccgtgctgactacgttcttggtgaaggagggtttgggactgtttacaagggctacatagatgagaatgtcagggttggtctgaagtcactacctgttgcagtcaaggtgctcaacaaagatggacatcaaggacacagagaatggcttgtgagttgccaccttgttcaatattcactatggttgctgatgtctgttatgtacatggatacacggaacgttaacaattactcgtacaagaacatgatatatcttaattatgtaaattatggaaaaatatttgttgatgctaactatgtatttcacatcaatggcacatgcagcatttagttgtactcatgttaacaagtacgctagcaaataaatacaccatttcatctttcttagtctgttccctttttggaatagaaaatttctcaagaagctacaatacatggttagaatgattcattgggcttgtatcatgaaaaatgtgcaaacttgataggttgatgaaggctaaagtattaatttcattggccgaatgcatgtagactgagtcatactgttagatagcatatttcttgaaagtttacaaacagaacagtgtatctacacatgctcagaataggtgaaattctatttatttttaaaaagagaataagcaacattgtccataaaagaaacatgatgcatttaatttgacgtaagcaattttggcaattttcgggcatattattaacttggaaatccttaccttttcattcttgtcgttatgttataagaattatcaggaagtaactcatcttttgtttctttgtcagactgaggttaggttccttgggcagctaagacatccaaatttagtcaagttgattgggtattgctgcgaagatgaccacaggctgcttgtgtacgagttcatgtttcgaggaagtctagaaaaccacttattccgaagtaagaatccaactccttttcatcacttcatgatgatatcatggcggaatagtttctgtgatcacactttttaaatatatatttttctctctataatacaatcaagcaccatagctgaagttgaccatattgtggataatagtgtggataatagagtcgcaacgttgttctattaaatatcgttgatatgagcaaattgatcagcgttctaaaacctggtctggtaggatttcatttcaacttgctgttcatatggggattccaaattgtccagagctttttgactgaacaaccgatttaactgttcactgctagaccctcagtaagtttaggccctcttcatatttatcattcttggaaaactttattgacatgtttttaacaagattgtccaaagtgtccagttaaccatctgaactatttgtcttgccatagctaaatgccatgattttctttgtttgtatacttaatagaatcattcgtgatagttcactaccatgcatagagtatgcgagctacccatacttatctgctaaatatcttctgtattttttcttccaaaataaatgaatactattgaatactggcatgtatgatttgaaatgtcggcacagtatttcatcgattcatttgtaggtgaagtaaattatatgccaatactgaattaatggctgactaaagattgtgctcaactatattttgttcttgtacattgtggtgaacttgtattcaagattaggaaattttctgacattgtctgtgcttttcctttttcttctcagggacagctactccactatcctgggctactaggatgtcgattgcattaggggctgccaaagggttagcttgcctccacaatgctgaaaggccaattatctacagggatttcaagacatcaatattctgctggactcagttgagtagcatttcttgtcaatgtcttgttttttttttcctttctcttctatgctgttgggaatatgtaaatatttttcataataacatttatcttttatttacacttacacaggattatactgctaaa

SEQ ID NO: 50879 - DNA, 6122 bp, Oryza sativa
  unsure (1)..(6122): unsure at all n locations
tgccacctcaaattcaagccgatactaaaccagggactcgagatctctcattacgggatgaggaaggaaaggggagatatggactctgcaggatgcagtacctttttaagtcccctctaatatatatgttgctagggatcacgtgatcacactatatatagaacaaaacggtaaaggttgtcgtggtaacttgattcacgttgtctgtgaccacctccacattaagggctcattcggatcacgggatagaaaaaacgtaggataggaaaagtataataaaggaatccaaatgtaaaatagagggttggaaatcaaaggaatatagaagatgggatcattgggagtagaggatgggattcataggaaaggaacagtaattaatccaactccgtttttcccacactcttttgtttcccgttgattcttcacgagccgaggagcagcagccctccatcccgtcgccatcgcctccgtgtgcaggcagccctccatcccccaactccatgccattggccgtgcggcccgtcttaattcttccccagcctggcctcctccaggaccacttcgtgctctaccccttctcttcgactccgacaccgagctcgctggctgccgcgccatcactgaccttctcatgcggtattcgctccacgccggacgccaccctcgatacccatcgcgtcggcctccgttcgccattgacctccgctcgcaacctccacgccaacgacctggcctctcctccatgctcatcgttctcctatgagatgtgcttctttgtttctttgttcttcactgatggcatcagttattagtgtttgattgtctcctttggatgcgaaggaaacgggaaaatgaggttggagtggatgatttctntcatgtgttttcccatggaatgaggaaacgcgaagcaacaatttttttgcatcgaattcaagcaacacttaaagtagtaactgatggaaaatttctataaactatggtgaagagatcagtttaatgtatcttgttttgtcttgccagcgagtttacagtccagttaaagaaaaatgtttcctagagatccgtttgcaaatattcgaattgaaataatttcactctcctgcgcaaggcctcatttatttatttatttattgccggaacagggcctcgtttgttgatcaatattgcatttaatcaattaataaactctcttattcattagtacctatgtttttgtatcatatgttgctttgacttttattctaatcaaacttctttaggtttgatcaagtttatataaacatttagcaacatctataacaccaaattagtttcattaactataacattgaatatattttgataatatgtttgttttgtgttggaaatatttctttcctttttttataaatttggtcaaacttaaaaaagtttgacaaaaataagttaaaatggcttatattatgaaacagaggaagttataagtttatctgattgaggagtagttttttttagagcgagtggttttctctttattatctcccaatacacaataaatgatttctggtttattcataggtttgaaaacatgtacctaaaaatattcaaaaattgaactattaaccaactaaaattagctaattagtacttgattaacattagataaactggtctatggattaattcaagtaatgttaaaattggtgtaaattatggtggagaggaccagtttaatgcgtcatatttgtttttgcaagaatccaaattgaaataggcctcatttatttacttatttattttggcctgaacaaggcctcatttattgttcaattttttgtatttaataaattagattaataaactcttctccattaacaaatctctacaaagatcctcctcatcatctccaatatacatagtccaaaaactactactaaatcatactccttccggttctataataattaacgttttagaacaaggttgaggtcaaacttttataactttgatcatcaataacattaaaaatatttagtttaaagaaactagaacagcatatgtagatttgtctttcaaagcactataataaaagttaaaatgtatttatttattgtatatattataatagaaaataaggtcaaaagtatattttgtagaccgtgtcattgtctgaaatgtcaattaaaatgaaatcggagggagtagaaacttattaatcggagtaaaatgattccaattgattcaccaatttaaaattaagtgttgcacctaaaaattctcccaaatcaaactatgtgtttttttatggttaacacactcctcaaaccggagatttaaaacctcgttaattgcacgattaaaatcgatcaaacagattcatggaataattcaagcaaagctaataaataacttatgaaacatttcgtgtaaattattggtgaagaggatgatcatgcgtacgtacctccctgtctctgacagagaacttgagcaccttcacacgcgaaaccagccagagagtgtcgagaaaatcttcagttccgaggaaggcgtcgacggagatgttcgccgcgttcagcagcgggagctcgccggcgacgcggcagccgttgtcgacggccggcgtccagagcgtcagcgagtggagcttgggcgcccggatcgcccacgcctccggctcctcctcctccaccttcttctcgcccccggcgacgacgccggtgatcacgtccaccaggagcaggtcggcgaggtcgggcgcgccggcgatcacgcgctcgagcagcgcgccggcgccggcgaacgggagcttgacgctgttgagcgccagcctggtgaggcgcgggaacccggcgaacaacgacccctggcccggctgcggcggcggcgggcgcgggagctcgcagtagcggaggtagaggttggagagctcggcgcgggcgtagatggcgcggccgacgccggggaagacgccgggctcgtcggcgcgggaggagccgaaggcgagctggagcgagcggacgcgcttctccgccagcgcgcggagccagtaggcggcgcgcgggcggagccgcgggcggacctcgatgtcgaagctcgccacgggcgcggcgcaccgggcgagcacgccggcaacggcgccggcggagtagaacccgcggaaccggacgtcgaggcccgacgccgactcccaccgccgcgcccacccgcgcgacaggcagcacgtgcggaccacctccttcagcggcagccgcgtcaggatgtcgtccaggatctccggcagcagggacagcagaatgtccgtcccggcgacgtccgacgccgccgccggcggtggcagcggcggcgacggcggcgaggaggatgacatcgacatggccatctctagtgacgcgggtgcgagtgtgctgcgagtgacccccaccgcctacttgtattgtatctgcaccgaatgaactgcaccttttgcgtttacgtcctttgataaaagaagtattcagtttcacgccgtttagggggctatttgtgattctgggaaggaagagagaactgttcaagggaatactgaaatttgggacgtacatccttgcaaagttgctcccccgttcgagcgtgagttgtttggaaggaagcgttacattttgaattgaatgtagtggtgacgtggaattttcttgctgaggcacaaagtgccaaagggaccaactgatcgattgtaagccttgtaggcgaggaacttgcacgctgagtacgaatttgtgactgtgaacgatttcaccatggcattgagtcgtggatcgatttcggagatcgatggtatgaatatctttctcgactaatatctaatatacgaatgaactattttaccaactaggaaggtagcccgcgcatacgcgcgggcatgcaccgtacgtaggataaatttgagaaacttataaaggcggtataccagcgaattaatatctgcaatgttttaaaattatgttttttcccatgaattttcttcgttagaattgcatgacgaatttaattgttatttataaaattatctattggagattaggattggtatcttacggtataaaaaatggtacctaagacatatgactcttgaggttccacagggaaagagagaaaacttaagttataaaagacattacatatacaaccatatataattaatggctctacccattttttagaaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttgatgtatatacatgtaactacctcatgcccctcttttcattaaagaaaaaaagttctatacccatgcatgcacatcgggatgcaccgtttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagatataattaagttggttgtgagtcaataggtccattgatgctataattaaggttaaggttagcggtttataagttattttgattttattaaaaaactaagttggatattttgatttgtaatgagaacttttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaagatttacagctattgaagattctttatttatttataaaacataccaagatcaatatgtatgagatatattatctatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatcttaagttttttactaaagataaatctaatggtatctgatggtaaaaaaaatattaggtccatcagattaaataaaaccaatggttagatgttctcctttttccatagattttctaggaattaattagagtgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatatatagatttgataggttcaccggtttaaaccatctatatacctaaatctaatggttttaatgtttgtttatatttggttttcatgcaaagcacaatgttctatggtaaaatttagggaagtgtttcttttatatatagattaatggg

SEQ ID NO: 50880 - DNA, 2078 bp, Oryza sativa
tgtgtgtgtgtgtgtgtgagtgtgtgtgtgagtgtgtgtcctctatcctacctgtaggcagattcaatttcagctcagctataggagtatgatactccaattactcatacactgtttgcaagcaagtagatcaagttgcattgatgatcatatatcagtctaacttaaatttgtcatgattttcaggtcgatgaaaatccattggagagaattacatggaagttccggaacttaaggacttcaaacttgagcgttgattttggcaaaatctcaagtatcatgtcaatcttttctttactgcgttgtgctccacagattgaacaactgaatattgaggtaacactggatgcatctcttcaagtcacttttaaaataccttcacagcatagaacactgcttttttttcttgtagattggcctattgtaaaattataattggcatttcatttacttgacctatatatgttttgtaggttgatctgaaagaagcacagggagatgatgagattcatgaagggattctagaagcatatatgagtgaagatttggttagaagtctcaagcgtgtgaccctgtcttttatcaagtgcttcccaggggagatgagctttatcaagcttcttctatccaaggcagcatcccttgaatcacttaaagtcatgatgttctggcatcatataatgcccgtttcggatgcgtgtcttcttttcacgacatacaaaaaggagtcatctacccaggtgaagtttatagtggagcatggcatggacacattcgacatcggctcttaatttgggagtccaaatattttccggaataaacggaagaacaccttctctggacttgcaaactgtgttggctgtagagatggatgttgttgcacaaaccattgtttgccttttgtttttccttgagaggtgtctctgatactcatgtttgtgacttactgtcagattgctttagatgtaacacctgaaccaaattatggtgttttagatttctgaaatttgttagtagacatgcctgaatgtgtgtgatttagtatacttagactgcggtagataaggcagatgtggtttataccttatgccaacaaaaaaaaaatcatgttccaatatgaaattcaggagctgctgaatttctggaacagatttagatctttgtaaagcagaaatttcataaggatttttgaaggaatcaattaaattcccacacatatcaagaaaattaccacatttcatattaaaaatatgtgtcgaatatgtaagtcctaattggttataggtagacatggagttacattatggtacatagcagagttgtggtgaccgcttgttccgcacctgtgcaacttttttctaacatcccaaaaataaaagagtttacgttacaaagcctaacagactagagaaacaaaccattttctcatcatctccatttcaaagttttttcttgttttttactcaacagttgatttgcagttcaaattctagttagggaatagtactaattatgcatagctacaatcctcatcagcaaagcctagccttgagcccacagtgtcatacactaccctcttgttcttctgctggtagttgccaataatgggcgtctggtcttcgaatgagaggctcgccatggccaagcacacctgcgacccatccttcctcgccatgaacagcatcccggcagcgtcgacggtcatgtcggcgccgccctcgaggcgcagcgtcagcaatggcaccttcacctcgtcgtgcccggtcaggttgtagcacgcgtcgagcagcgagaagggcggcgccgccgggtagcgctccgccccgaactgccgcgcgaactcggcgcgcacggcgcggtacaccgacggcgcgaggcgcgtgatcaccgtgccggagtcgaggaggacgttggcggcaccgagccccgccgcggccaccgcggcgccgccgacggacgcgccggtcacgttcatgaagtagaacggcggctgcgccgggtcggcgatcatgcgggtgtaggacaccggcgtggcgttgcggtaggaggaggtgtcgccgccgagggagagggagccc

SEQ ID NO: 50881 - DNA, 5111 bp, Oryza sativa
tcgccgtaggccagcgagtagtagcacctctcgctcttcccgccgccgccgccgccgccgacggtggcgcaggatcccggcacgccggtggccgccttgagggaggcttcgcaggcggaggcattgcaggggacggcggcgtaggaggcggagccggacgggtcgaacagcgggtcgcgctgcgcgtagcagacggagcacggcttgcactgcacccaggtgaggtcgctgccggtgtcgacgatgacggtgaggttgccggcgccggcgcgggaggatccgccgccgccgagagcgatggtggtgacgtagttgagcgtctggaagcggatgccggaggtcagggggacctcggcgccagcggcggcggcggcggccgccgtcgccttcttgccggactgcgtgaacgctgccttgttgcggagctgcaacgagttggcacgcgcctcgtcggcggcgaggaggcggcggaggtaggtttcttgggcggcggggtggtcggggatggcggtgagggagtggtgcttcagctctaggacggtggtgctcctagtcctcgttcttgctgctgctgctgctttcttgtgttcccctgatttaagaaaatgaagcagagttattgaaaatatttgaaattgtagaaaaaatttgatgccgttaattttttaaacaacgtttgaccatttgtcttatttaaaatttttgaacaaatataaaatatttaaatcatgctaaaagaacattcaatgataaatcaagttacaataaaataaataataattatataaaatgttttaatgttgaatggttaaacgtattttaaaaagtcaacaatatcatacattgaaaaaggatagagtataaagcagagtaatgtaatttaatattggtttatatttttgcaactaatattagtgtctaatatatatataaaaaagaagggctctacacgatctagattgatcatggtggattggtgatggtctttattttggggttgtaaaattaaccataaccgaacgtactgtactgcatatggatttataaaaagatgaaattgaagctactttagaaaaactcggaacatgaaatatattttgtagggaacgccaaattcaggtggaatttgtacagcccaaataaatttggagcgaagatgtggtacactgaatccgaatggaacttcttgtgaaaacacataaaattcgaaattaacttacactattattttcgagaatacgcataagtcttgcatatccttgtattagggagggggcaaagttacaacttgccaatttacagaaaaaagtgtgtgtagctttaacttgtatgggacaattcgaatacataattggagaaggtttggtaggtaacagggctaccaagaaagcagagtaaaatatagccctcaaaacaagatggattatatcgcccgagaggatgctgctttcccttatacaattttctctcaaatgcatcggaaatatggttatgaaaatttttgaaaagaattgacaatacacactacagtgatatatctatcgctctaaaaaaattaggactgcggtgaacactgtaatattgatgttgataacaggggagacacaattctccagtgaatgagaaagatggatcagctaactctctcaactctcagtacctagcattacatgagatgcctgcaggttcataaaataatgagaatattatcactgtaattttgggcttctctctgaagctaaccttaaaagccaaaccccacaaataattcaactgctgctcagacattatttagcaactacttattccgtttgtaatatattacaagtcgtatgatttttttcttaatcaaacttgtttaaatttaactaagttaatatgtagaaaaaaatatactaacatttccagtataaaacaaacaaattatcaaaatatattcaatattaaatttaataaaattaatttggtgttgtaaatgttactaattttactataaacttactcaaatcaaaagaattttgaccaagaaaaaaacaaacgatttataatatgaaatggagggagtagtaacttgtaattacctgtcatcttcttctcaaagcgctttgattgggaataccggacctggccggacgagccccattgcagctcgcgcagctgaagcactgcgctgtccctgccgacgacggcgcctccgccggcggcgaccaccaccgcaagaagaagaagcgcgaggacatggaggaggagaagatggcggccatccattgccaatgatctgatctcgatgccgtagcagtagtcagtacagatctctggctcttactcttaggcagcaatgcaagatgagaggtaagaagctgatctgaactgaaaggtactcctagttcgtagctaaggttagctaagctagctagctagcgaccaagcaggatgcggtgagtacaagagacaagagaatgtgaagctacctgctgcttgctacatgacgacgaagacgattatatatatgcagatgatgaatggctggatcatggattgggatatatagttttagttgtgcagagagagagagaaagagagagagagattattcctgaggggtgagggcacctgcaagggtagctagggaacaagcagacgactgagatagtctctgcacctgctttggatgcacgcctgatacgaacgagatagggcacacgagattactgtagcgttgcgaattatttgcaatcacgagcatgcatgcacgagagtgagagagcagtagtagtagcagcatttctctcttcgctttaacttgttttctaaattaaacttcattaagtttaaccaagtttatagaaaaatacagtaaatcttataatatcaaactggtttaattaaacctagctaacattaaatatattttaataatatgtttgttttagggctaaaaatgtttctatatactccctccattttaaaatgtttgacaccgttcactttttagtacgtgtttgaccattcgtcttattcaaaaaaatttaagtgattatttattcttttcatgtcatttgattcattgataaatatactttcatatacacatatagttttacatatttgacaaatttttttaaataaaacgaacgatcaatcatgtgctaaaaagtcaacggtgtcaaatattttgaaacgaatggagtatatgttttttctataacttacattaaacttaaaaaaattgactaagaaaaacgtctggacagacgtagggagtaatctatgcatgtgttgtgttgtttggttgcggagaggatggtagtagggcagcataatcgcatatgtgcacatactatataggcatatgcgagcactcgctcaactgctcccgtgaactactaatccatgaacatgggcgaaagggatggatggatggatcggagggatatatttgctagaggaattgatgatgaattacattcgaatcgatgaaggcgagatgaacatctttcatattctttatagcttatgaactgtcgcacgattaattaattatgtgaccttcatcttcatcttcagctccctctgattcacaaatttcgatgaaatcacgcgtctccagtggattttttttcttttgttaaactgaaaatcaatactccctccgtcccataacatagtaacctagaatcggataagacatatcctagttttatgaatttggggatacttcttatccagattcgtagtactaggatacgtcccatatcatactagatggctatattctgagacggaaaaaatataacatagactgacatatgatctgcgatggaggtttacatagagatgatgaactattgtgagcaatcatgcatggatttttttgggtgtgctaatccttagtactacctccattcaaaattagtgatcactttgactttttgcatgcaacatttgatcattcgtcttatttaaaaaaattaatgtaaatataaaaaaaatataagtcatacttaaaatacttttgataataaataaaatcacaaacaaaataagtaataatttcataattttttaataagacaaacaatttaatattataaaacaaatttaaatgacaagtattttggacggaggtagtacaaaagttccagttgctgcatcatgaaaagctaagagtgagcattaattgctatattaattgctatacgtacaataaaacttcatacgatcagagtacaatactttgatggtgttcttttctcctgaagatgaaaatgaatattaatttttttacacaaaacgaggtggtattaacgtatgattgattgagttttaattattataaacttgaaaaatagattaatatgatattttagagtaacttttagatagaaagttttcgtgcgaaacacaccgtttagcagtttaaaaagtatgccacgaaaatcttaatattcttcaactcttttggagaaaagaactggaccttcgtagtctctggtgtgtgctgaaaatatgggatccaacctgttcccacccaatcaaaaatcattcatggtaggatcgtactaaaatcgtacaaatttcatcgtaacgcaaagcaatttccctattttgttccggtgtgcagaggcagcctcatcatactggataaaactagaataacggtttaatcccgtccaacagttagaacggatctctttaattcctactatctcaaatcactacccaattctcgagggagcgatgcaatgctaaacataatttaaagttcatcttaggctctgtttatttgtaggggtgaaaaattttggtgtatcacagcagatatatggacatacatttggagtattaaacgtagtctaataacaaaataatacagattccgcctataaactaagagacaaatttattaagcctaacaaatccatcattagcaaatgtttactgtagcaccatattatcaaatcatggagtaattaggcttaaagattcgtctcgtaaattagtcacaacctttgcaattatttatttttttagcatacaggtgttcaaacgttcgatgtgatagggtgaaaaattttatggagggatctaaactaggccttagaatcctt

SEQ ID NO: 50882 - DNA, 973 bp, Oryza sativa
tagatcctgcccaaggcaacaactcggaggcagtgaacaccagtaacataaatcaggcagataaagcaccagatttacctgaaataatgcgtgaagcaccatttgagggccctgaacttaacttgccagatattgatgaggtaaacaatgatcccatggatgtgactgaggaatcttcaccatttgtgtccaagaatatcacccctccggcactggaacgaactatatcccctggtcaaggtggattatctgggacatccattcccaatgcacgaggaagtacaagcaccacatatgacaatatagaagatgttataccaatggatattggttagtattttgcttgttgactcatcttgttctttccagttttgttttctgccttcattttttcataagacctaatagaaataagactacattgcaattccaccagcattacttatgtgggatgctagaatgttgtgtaaaatgtactttcccttgatgttaaacatgtcttctcatccaagttcttttccttctgtgattttaggaatgcctgattttaggattgaaccatctccacctcgagtacaagatgagatgaatgcacaaccagtacaaggtgagataaacgcacaaccagtacaagatgagatgaacgcacaaccagtacaagatgagatgaatgcacacccagcacaagataagaggagaattagatatgacaatgaaatagtgttctccaatgcgtaagttcgactttacaaattatcttcttaagcaagttcattggtggaaataacctcaaattaaatattatatgtttaccaggacttcgatgaatttttgaaattcatattgtactatgtcttgcctgggcgttttgtttaaaatctaccaaatgacatcttcatttctaccatgtcctgtctcctctgatcctattactctgtcccctcacctacaccacccttcgaatattgttttt

SEQ ID NO: 50883 - DNA, 3104 bp, Oryza sativa
  unsure (1)..(3104): unsure at all n locations
atatgacatagccttacgatcccttttcttctcatcgttggaccaatcctgtgtcctcttgtcaaatccagaaagcgcatcatcgaggtcttgttgtgcaagaacggctcgcatcttcacttgccaaagtgagaatcttgtgtctcgatccaggagcggtagatcatacttcaaactcgccatgggaattaatcctgaaatttgctagaaagaaattagggtaaacctagcaaaaacgcgaaacctgggtgcacttcctgtgtgcacttcctgtgtgcacaaagcgaagtatgtagatttcctggtacacaagctttggtgcgcttagcaaaaaaaaatcgccaagaaattccttctcaacaggaacgatgtagtccctgacttcctcgggtcgcgtgccctacagttgcagtaggccggccctttttcctcctcacggctgtgcggttgctgcagcttctgcttttctcgcgcgggtgtgtgaggacggcgcgactcggactcgacggggtactgcaccgaacagattgattcggcgacgacgaaagcgaaacaggcggcggcggcggtgtggtgtagattgatctccaatgctctgataccacttgttatgaaaatagatgtataacggagacacgaattttacgtggaaaacccttgcggaaaaaaaccacgggcgctgaccggcaatgatcactgtagagtaaatgattacaaacatagggaaataacaatgggaacgtcaccccttcccgtacggcttacaagagtatatatagaggataatagaaagacacctaataggatatacatgaagtcttactaggaaactaatccgaatatattgtgggcccaaaattcggatcacatatttaacacctcgcgtggtggcgatggcttcctgaggagtgaggacgctacgcgacagtggccaccttcttctggaagctttggaccgcgggataaatgggctgaatttcactatgtgggctgctacgtcaccggtagattcaacatctgacccattcattttttgtattgtgcagccaacacaaacagtaagttgagtctacagttgcagcagcaacggctgcatacagtggctgtaccagccagccgaacaggtccattatcgattggaaatcaggacagaattcccatagcatatatactacgaggtgtctaggtgtataactaattttttgcgtgggtttgaaagtcaaattcgtgagaatcacgtagaatctctatattccaaaagatcccttcatgggtgacgaaatgccaatttactcccttcccttaatattacaagtcattttgtcttttcttaagtcaaaattgttgaaaatttgatcaagtttacataaacatataacgacacttataacactaaattataaatcagtttataccccgcacatgattagtttaggccacgctgcccaaccacccaaaaaaaacatgattcagcttgagcttaaaaaaaagaagatttggagagagagacaatatattttaaaaaaaatgatatcgcgttggggattgaagacgggacctcgggcttaaaataacacaccccttaccacttcaaatgctaatacagtctccgatcaaatatacattggtgccaaccgtgcacaaatcatttgaacgaagccttttgattcatacataagaatctgaaccttgaggtgccccgtaagctgatctaaaatagcaccctggcatctgttgcaacacgattttcagaaaaacctcagaaaattttgaaccctgattgtcgacaacattcagttatgtcacttcaaatgctgttttatactcgttccgtttctaaatatttgatgccgttgatttttttaaatatgtttgaccgttcgtcttatgcaaaaaaaatttaagtaattattaattttttttcctatcatttgattgntgttaaatatacttatatgtatacatatagttttacatattttacaaaagtttttgaataagatgaaaatatcaaacgtgctaaaaagtcaacggtgtcaaatatttagaaacggagcgagtatatattttgaaccaaatcgtcaaacgtgaaaagtgctcctgctagtacccagtattaattgcaacatccttcaaactctaggatacattgacagcatttgaagatcaaggaaaaaaagagacgcaaacatttctagcaaggcatattcacagctctctttcatcatgctaaatcagcctgtcattcaaaaataccaaaatgctaaatcagtgtcagcctgtcaccaaattatagtgttcaactcaaaaaaccgtccactgatacagtgaaattctatgcattctgccaacagaaggaaaagtagcagctgtatgtacaacagccacatctagaatgtaacagatcaaagttcaaaagctatgcttccataacagaaaggtggacatggcaaggacaagaggtacaacactctgtaattcctcaagaaggaaaacaagcagctggttgcacaagaacagcctcatctagaatctaaacagtagcaagttccgaagtatttcttccataatgcgaaggcagcatcaaaaaggacaggatgtctaacttacgatccgtcttgtgtcacttttgctgtcaacaaaagttggggtgaagccttttggcactcgattaactctttgcatttattttcaaaccattcgctctttccatcatcatcaaacataaaagtgacagcaaatgtttgaagagagcctgctttggacagtaaaaacttcataaagcacatttgattttcgcggtgcttggcaccagtcagggacacatgtttgaggcttgcaaacaagtcactgcttatctctgaatttagggagtcttcatcaatcttttctttatccaattctgtatcaagagtctacaaaacaaggccaagtttcaattaactcaattgaccaagagatgtctttaaattgaacatagcagttgaaggtgtgaatctaacattacctgaatttcaaggtgctcaatatgcggagcaaacttcagtaaagaatctattgatagaacacttgagagttggccaaaatctatgttcaggctggct

SEQ ID NO: 50884 - DNA, 1816 bp, Oryza sativa
aaatcccgtgtggataataaattataatgtccaaaaacaaaatgaacggtcatcaaacatcgaactatgtgtgatccggcgaacgaaatcatcatagtactagtttattagaaaatagaaagagtaattttctctacagcaatgctgctcaaacaataatatcaaccatctaatttaaatagatggaagttatagaaattctagatatactcacagcatgagacatagtgttagactgttagtaagataaaatttacttcatccgtttcacaatgtaaggctttctagcattacccacattcatttagatgttaatggatctagacatatgtgtttagattcattaacatttatatgtatgtgagcaatgctagaaagtcttacattgtgaaatggagggagtagtatgtatagacttttccttttctcttttgcggggatagctagaaagggtaatttgatgcacgccacagcggtaaaatggggggaaacaaccgcagcaaattcgttcggcatgtaaaagcctcaaattctagtattctacaagcaaaacatccacgaaaataactcccccacattccaaaaccaaccacctgctagggcccacctgtcagccaccctaccaccccgcccgctgctcccgaaatccgcgcgccaaaagactccacatacgaagcggcttcccgcttcactccccttcccaaaaactccttctcatccaaaacttctatttttccccccccaaatctcatctcatctcatccccctcccctccctctccgtgcgccgccaccaccaccgccaccgccgccgccgcaggagcaaccccgaggagacggaggagggaggaggcagccgacgccgccgcgatgttctactcgcacacgatccttgcgcggaagagcccactgggcacggtgtggatcgccgcccacctcgagcgcaagatcaagaagccgcagatcgacggcatcgacatcccctcctacgccggtaagccctcccctcccctctctcccaaagacgcgctctttcttttcccctttgttgttgctgcgcgggtagaaaggcggcgcctttcagcggcggcgggggtagaaaggataagcttttttttttttttggttcctccgtgcaactgggatttgttccggagttgtgagtgaaaaatgttttggggttagcaatggggtcaagtgatggtacagagatttggatcccaatctgcattctgcaatttgggacaggaaggaagaaggtttggatagttttttttagagcattttgctaggggttcgcagtatttatctggttatcagttagaatttcgtgtaaatgattgttctagtggcatgattattcattaatgacaaaagatacaacaaaatttggtcttttagttatgggaggttgtggtggggtgtgcaccggagacttttgggtggatttttgcaggccctatttggatgctaaacatttcaagaatgacagcatttgcatatccagaaggaagaaaaaaaaaagaacgaccaaacccaattttttacctcccagtacagtataatcacttgcggtggaacactgcctacttgagccactctatttgaagagtaattcatatatgtttgttctacttatatgaattacacaaataagtttatatgttatccagtcaaatcatagaacattgacaaataaactggcttgttgtgcttgcattgttcttttagtacattatgtaacagtttttactttattctgtgattaactttacatatttaaccttgcaaactcaagaacaaagtagataagcctt

SEQ ID NO: 50885 - DNA, 724 bp, Oryza sativa
ccgcagtacgcttttgcaaacactttatactatcttttttactcattatttattaagtcgagctacactagctggctaagcatgtatttgtacaaaaccatccttaccaatactaacataatcgtaggccagcaaatctctaccaatcaatcattgcagtcgtattgtcaatcaaccgccatgtctatcaaggcaatgcaagatgatttgtcggcctcaaccatctccacatcgacatccaactattgtatcaaacattgatgtatagtagaggagatacaatagtttgcatgaattcaatcctgacctaataaaatattatacctacccataacatcaagaacataaaaagcagtaggcatatagtatatatatactttcaacagtaagtttcatagacataacacaacaccttagcctcagccaactctcccaaaaaaccattacactccatgttagtttccattaattcactctccttctggcctaatttagaaaggaacgaaagtggcaaaatatcaataccatcacctccatcaaccaacatacagccaataggttaaaacagaggctttaggtgctcaccccatttttctgaattttcaaacatagcattttttggaccaagaatgagctccacgacctccactctcatgtgtttgaaaatcagccggatgctcaaacaccatcttcacatccatgagcacatcctgtgtatcttcaa

SEQ ID NO: 50886 - DNA, 1672 bp, Oryza sativa
aaaagttttcctttgatacttacgtcggggagtaattctaaccaaggataacctagctaagcgaaattggaaaggtagtaaaaaatgttgcttttgtcataaggatgaaaccattcagcatttgttcttccaatgtcatctatctcgtttggtatggttcgttattcatatggcctctaactttcaacctcctcgaaatgttactcatatgtttgggcgttggcttttatgtgttcctaaagaaatgagaaatctgcttttgatgggtgcagcagctctctgttggtccatttgcctaagcagaaacggggttattttttataacaagttagtgtcttctcctttacaggttattactctagttacccggtggctacgtacctgggctatcctccacaaaccgggattgcgggatactattgcggtggtatctcgacatttggaccaggtggcacgagatgtttttacccaggagctgggtggcgatctagtctacagattgatagtcactaatatctatgtttcgtgatgagggtttaattttatccttttattggctgtgtgcattttatgcagaggccgggggtaggctcagttggaatgtatcatcttagtatatttgacagagtcttaataaaacttccattatcttaaaaaaaagtgagttttatctccaggctactcaccttcctcctccctcaagaaaccacgtcatgctcatccattaagcagtgccgtctcttccaattcctccctcccattaattaatcccttcctctctctaatcaatatatctcttttaaatgataaaaactgaataaaattgatgagatggatccatttttcaattttccagccacctctacaccttgacacacaagtcaagcacactgagctcctgctcaagcagcctcctcttacaattctctacaaatcactagcttcgccatcaatttctcctcttcaatgcaaaaaattgaatgctcttcaatttgccaaaaccatttctctaatttctgccgccacctctccatctcctggttgttcgtctctcctcttctcctctataaatacctgctacacacctccttcatctcccttttgttcgacgatcacaccatcgcccatgtcgttactgccactgctcatcatcgcttggagagcacgaggcgctaccctggagagtggagattgagccagcaccgccgtcgcagcctgagagggcacaggccgatcatcattttctcctgcaaccttgttgagagtgccacctctactatgtccaagagctcgagccatctcgccatccataggagcttcacccactgcctgtgagcaccatggttgaggccggcttcatcttccctagatctagtgccatcttccgtcaagccgccactgctccttggtgtcaacaactcctgtgtcaacgtctccacttccatctcctctgactgcagctgccatccaccagcaccaccgtctcatgaatttataccatcatcgcacgatcatcatgcaaccatttcccgagcttgatcacaaaccacatcatcgttgtcttgtttccaagacagccaccacctcaacgtcatcatcggtggtgaatccccactgctctttcatgtgctattgtcgtcgcctctctacttcggtctcctaccaacatgct

SEQ ID NO: 50887 - DNA, 4443 bp, Oryza sativa
  unsure (1)..(4443): unsure at all n locations
ccagaacattgttgcttcctcttctcttcgatggcaggtaagcacctgcaccccatccacatcatgattcgtgtcctccattcaatataaacaactacatcactatcatcatttagctccatttttcactgtctgtgcaactcccggctaggtattcacctctcctttcctcctctatatatacgaacgtcacagctgtctttttcttttgctcatgcatgctgagatgctctctgctctcctctcctaccatagtgcagccacaacaaacttgagcagcctacaaatcaaaagcatcatagcagggaggtctagtttcgccgcatcatgtccgttctatctcaagcgcctccaacgtcggtgctgctgcattggagctctcccacttcgcttgtacgccattgccatgctgctgcaactgctcactatcgtggaaagcatagatgtaagttcaagtgctttagtttggttttggactttggtgattaatgacgaatctatttatatgagactgtcggagggtgtactcctccaccagtgaaccgtgaggcccccctcccccccccctcccttttttcagttcggccgggggcggtgattgtagttttgagggtttcgctgtccagtgtgcaagagagggggttcaacccctcgggggaaaggcaacggtggtttatacaggttcggggtgctgagaagcgtaataccctactcatgtgctatgctcactgagagagagattacaagatctccttgttggagtagaatgtgttgatgatgaggggcaagagactatcttagtcaaaatggctcatccccctcccacagtaggccaggacctcctttcatatctcaaggggttaccacaggggaccaccgagcctagctggggaggataatcatactaagcacatgtctcgttgcttgccttgaaagccactcgcatgccttgctgcagtgcggggcccatcaaatcctctcgcctgacacaggagacacagccgtcattcggcatttaaagagtgaggacttttgggtcctcatttgtaccgggagatgggaaccctgccctaaacggattaggcaaactgtctccggtagacgttagaggctgatctgcctctcacaattgcgacgtgacggtgggtgtcaggcggcaggacgcctgacatgcaaccagcgcgcaggcgcactaccccggccatgtcaatcatcggtcacagaccggcctgacacaccacgccgcaataaatgctgcgtgcggagcgctcgctcagaccgccttaagtgcggttaggtgggcactaggagcgcccgtctggcgcggcacacgtggcgccgcgcagtgggggtcggggtgacccgaccccggggtgtgtgaggaacggctgccgccttgcctcgggccgaacccccttgggggaaggccacgtggccaccaagggcaggcccttcttcatagtctgggtacccccgggcccatatcaccgatagagactaatgttcctatgagttttttttagtctcattgtgatatggaaataaaaacaataagtcttatttgtatatgaaagtgaaaatgatgagaagtttttccccgatgatgagatgtggtagatatgcattctttggtggtggatcttaatcatgacaaagatgaaatgcatggagataaagcgaatgtatcacttcttatctcatactttntgatagattcatatatatgatttccatgttattgttatataagtgcgagactaatgtttacttgagcattttcttatttagtgttctttacattaagaacatggagattataaaggtatgtgtttatgtccgtctttatcattgctacataccctctccatgtgtataggataaaccccattggttcttctctacttgtgcatacacttgcctctcttatatatttctttgtatgaatatatttagggagagcaaatcttatacatttattgtgcatgttctagatacatgttgttcacctattatttatattggatctttgcacttaagcttgcatgcaagtatatgatacttgtggtgttaatgaatactcaataaacattcatatctttcataggcaaccggttggtcatcaagtggaggatgacaaacgatttattaggactaatgtcttcctttgagttgtgcaaaggaataggtcccaacatccatgtgtgtgtgcatgctcaattgataaaatcttgatacaaaatgaacatagatcagtaaatcatggatttgttggaagatcatatatatcattaaaaaggagattgaatagatactaagaaatcacaaatataaaatttgttgagctagaaatgccatatgtatgtggaggaagaacatatgaatatattcaattaagaataataaatatgtttattctatattcatatcaaaataatactgaagctaaagatagagtgtttaattaacatgtagtctcataatcagatctatctttaacctccgaagcaaattaatgacacgtataatataaggttattaaggggccatttggcttgaccttaagtttgcactggggtaaacccaaaaggagtaaacttctcaaaaccttcattttaattttaaaatttattaccaagtaaaaattaaaacaaatgatgaaaatggaaagaaaaatgtatgtttggtccattgtatgattgataatgggcaagggtgatccttgccattgaaggacagttaattttggatctcattgaagtaataaaatcatgcaaggtaaacttcagacaaatacaacaaataatggtgcattgcagaacacatattgcatgaaaattttctgaacagactctgcgctctggcacactgaagatatcagactatgtacactgacatttataaaattgtcttatgctagtcatccaacatttttcgacttgtatttaacatatcactaccatgtaattaaacagcaaaagtaagaaaaattcttatcttcatctgattccttgttcactttgctttctgccaagaaagcataggcaaggactaccatctgaagtcctaactggacaagatgtattggctttcgacaactactaatgctacagctttacaactacagtattctgcaacataaacctaaatggcatggagtgcctacttgttctagtaattggagtccagcaaattgcagtagattagccagccatgtcgcatataagaatccattgttcaggccatttctgcaaatcccaccaaagctccttcccgcggatcaaatgagattatatgtggttctaagcaactgaattggtcaaaatttggctcctgagagtgagggtttaactgaaactgctatatcaccataggctgcttcttgttcaacatcaatataatcataactctttagaacctacagaaagaacaaacatacgatatgtcaagacatagtgtggaaagtgactacaaattatgtccaaaagggaaatgtaacttgcagtttaaatggtaccagtgtttcaaaaaacatgcgtgcagcttgtttcctgtgtctcccttccaagattctgttcaagataaatttaccaggttggtcatctgatgtagccgaagccatttgatctttgaagtactgtgccacagccctacaatgcagtatgaaacatgtcagaattcacactcaaatggtaacatataatgaaatcgtctattggaacttatcccataccttgtcctagcagacatgcttcccaatcctgtggtgccagtacctgcggtagatattactccaggagtactcatgaggctaggaatctcgggcaaatctccatcaagttcatcattaaatggaaaaggagaaacttgaggatcagagtcttgtccaggtgacatgtaactcatatctgctggtgtcccagaggcaggagtttctccaagtcttgatttcggagttccaccagcaccaggagttttgaaaggagaattgtcgtctcttattggagatggaatattttgtggcgagaatcgagggatctcaggcatatcatcaaagtgtgacgtgcctgcttcgcctggagactttgggttgagctcaggttcaggctgtccatccgcatttcttggagattgtggattaatctgagattcaggttgtgcctctgcatttacaggagactttgggttaagctcaggttcaggttgtccatctgaatttcttggagcttgttgatgaactgatgttcaggttgtgcatctgtgtttccaggagacttcggggagagttgatgatcatgtgtatcctgaatactgtcattagctaccccaggagtatgctcgacagatcctgactcagcttcagggtcaatcacatgggggaaggttctctcgtacgtttgacgtagggtagcgcacatccctgaaaggaagagcgggctgcaggaa

SEQ ID NO: 50888 - DNA, 5414 bp, Oryza sativa
atgtttcttcgcccgctaaccatcctgctgaaattaatcattccattactctatactccctccgtccaataaaaaaaaacaatctagataggatgtgatgtttctatgtccagattcattgtactaacactactatagaaacaatttttctatacaagggccctataaggttgcaggctgaccataactggtcgcgccttcgaaaatcaacctatattttcacatacggctccttaagaggtccgcatgcaaaaatctattttcgtatgcggacctctaagagagtgatatgcaaaaataagtattttcctcggtgggtctcttaaatggtcgcatgaaatgtattttcgcaggcgggcctcttaaatattcgcctagaagtctgacttacttccttttttccctcagcacttcaatttttttttgaagtcatcgttatctcctctcatctctctctctctcacctccttcctcctcatattatacttctctcccatttctcaccttttcttctctctccctcaactcccctcctgggaacggctagtggcgggcacacggtagctagccggccgcccccgccgttgacgcgagggagacggccctaccccgccctcgagagcggcggtagcgggagcgagcaagccggtgatcggatccattgccctcgccctcgggagcaacggcggcaggcagaggcaacacgacgacgacgaccagcggtgttggctgcgacgggcggtagcagctagagttttggaagaatcggggagctagggtttcgggctatatggctttttgatattttttttatttttttttgccgaaactattttcacgtgcggtcagcttagatgaccacatgcgaaaaaaatagcaatctttgtagacacatgggtgcaaaaggaccgaaggcccgcatgcgaaaatctattttgatcctttgaaaaaattcttctttagtagtgtaggaaacatcacattttatcctataagttggttttttatggacggatggagtgttaccttcccatgatgtcattacctgccttgtcattgttgtagccgtactggtaagtgggcattgcgcttagaaatttccatggctccgatgcacacggatcccattggatgattgcatgctgcttcttgcctgcaggcaggggcggatccaaggggtaggcttcatcaggctcaagtttgccttccgatttttgcaaaaaaaattcaagcatatagcatttctcacatgggagcagttggagaaagcggggagaagagaagaggcgaataactgcgtccctgtccacgcgatgaagaagaacaggagtgatagagctgaaccgatatgcactaaacgacccaattaaccaatttagcaaaagcccattaaatggcgagtgattgccggcgcaacggtgacgagcgacaccggagcgaggctacgttatgacctgagctcatgagagatcgaatcatataaactaacaacaaatacactaataactccagatagtttgagaagaaattgggggatcgggtggagaacaagaagggaacaaaggaagaagaacaataggagggaatcagattcaattcatttcatttatccctctcctggtacatgtttcttgcattatcatggtagtaagactgactagtgggaccccaacgctggatacatttgtttagtacgagtatgacattatggccgagggaagtggactgcgccactgcagcccgcaagtgtgggtgtcgatttctaagatcggcaataaaatttatagggtgcgctagatgctagaaagaaatggtgacacagtgatttatactggttcaggccctcgggatgaggtaatacctagtccaattgtttggtggattatctttgtatcgagtgttgaatgaagaacgtgtgtaaccctctaggggtgctgtcgatccccttaatatagcagcagggtgaccggcggcaaggaggatgcaatatcccttacaatccgggctcctgccatccgtcaagatatggcgggatatgtttctatctccttattcctcaccatttatagtaacagattacatgggcttgggcccgtagcatgctagagatctggcctttgagtactgtgatgggctaccccagtacgataactcccacagtgggccgtgcaggcgtgccgggccggacaaaccaggaggcaggagcctaggaagtgctgcttccagcttgcttgctgccataaggccctatttgtttcagctcaaggccctatttatttcagcttagaattattataatctagattattagtagtaatctgaaataaacatgtagattattataatctataagacataatagtataatctggtaatctcctctaagcgtgttttttcatattatttggtggttaaagactcactatccttattctaccataatccagataaacaaccaactcatagcttattctactatagcttattataatccagcttatagtaatctagctcaataatttagattacatataaaacaaacaggcctaacttgcctcgttgcctgctacattgcttcttgcggcatgcggcttgcctcggttgcctgcatccagtgagcgagctctgttcagttctttattgtctagtgaaaaaatgaggctgtgaggggatttatcatttacatttcgtagtatttgatttattggtagatttgcaaattgcaatggagaagaaaatagcatagcttaattactttacaagccattcaactgatacatccccaacagacgagagcacaaatagaccaatccaacaaaacagataccaatagatgattagatgaagtgaggagagcatatttattgaatggtccaaattgagcaccaacatgtttttccaaaaacattggatggtaagatttagagattctttcaacgaaattggctcgataaatttgacattggaatatagtgtaggaaaggatgttgcattttctttttcacatttttccatttgatacttaaactaccggttcatattttctgataatggtatgcatttagccggtgccgtacagcaagtctgcgggatcgcgtggtgccacgtggccggcatgtgggactgacgcagtaccacgcgagcgctgcacgggattgtttcagccatcaatccgcgttttggtgtcgcgtcgaataatcgatcccacattatcatcttgcggtacatgtatatttttacaattcttttaaaaacacgtatataattacagaacgtcagaaatcatgtatattttaattttgttttctagatttcgccatctatcaaagagaaagaagtcttttgcaaggggcatctttcaccaaaaatttcactcacagcttaaaatttcctcctccgcccaaaaaccctctcgacgctccgaaccccagcaatggcggacccgccgtccttccgccgccacccgcaccccttctccatcgacctcatccgctggctcccctgctcctcctcctcctcctccgaccgcctcctcgccgccgccgtccacgacccggcggcgccctcctcctcctcctcccacctccacctcctcccgctccacgacccctcctccccgctcgccgccctccccctcccctcccgcgccgcctccctccgctgctccccctccgtcctcgccgcggccacctcctcggggtccctccacctcctcccctcctccctcgacgccgccggatcggccggggtgtccgtccctgccggcgccgggttccacgtgggccccgtccgcggcctcgactgcggcggcggtggggaggagtgggtgacggccggggaggacggcagggtgcacgtggtgggcggtggcggggatgggagggtggtggcgaggaggctgtgggatgggaaggggatggccgggtacgaggccgccaggtgggcgtcggcggcggagttcgccaccggtggcgccggctgcggcgtgcagtggtgggacaggaggaagggggacgccgtggtggcgcagtgcaagggcgtttggtgagtgtgagaaatggtggatctctcctgttcctggttgttggttgatgtgcttgtaaatgctagtaggagtagtacattattagtggttcaattaggatcaaggaaatcttctttgcttgtgattggtgagtagagactcaatgcgcgcacaatgatttgattggtgctagtacattacatgttgtttgctctgtagatatgtatgttcctgctgttgttatgaacatgctagatgtatatttatggttatggttatgctcattgttgtcatcacgtaattaggtcgactgctacggttatttgcttatgggttgatgaaaattttggcaaggagagcttcctgtaactctttgatgggattctaacatctcaagacatctctgctttcctaaaatttggtgcactcgaatctgatatggatgaaatgtacctgttacacaggaatttgattcaaaaaatttcagggtaacaagcaactcaattcttgaacttctctacattccatttctgaaaggctatagctcaatagttatcgttctatttttagaagctcagcctaagctttactagtgcagattttgattaattgtgtgatcctcaaagttcaaagttctgtggtttttttaattaaattgcagattttgatttgtatgctgataattgcaaaattcaaagttctgtggtttttttaattaaattgtcaagatttaggtttaaaaataatcatgcaacaaatcatatagattcatctctactctccagtcttcctcaaaaagcatatggactcctacgtcataagaaaaaaaagataaaaatgatttaggcttgtgattatttttattatcatggtgatgaatcgagatgtttcatgtttggcggatttatttgctaaaacatcaagatctgatgtcccagaaaataggttttttttttctgaatggctgcacatcttgaactcatgtgctagacgattcaggttcttttatataatggattgttatgttaagtggaatacaaggctggatggctgaaccttatgtgctagtatgctgcagacaatgagtggtttttgtatcactacttgatggaaaagcataaaacttctgaattactgttaatatctaattcatgatcaattgtaaacatgtaaaggtaccaatcttagcaatgtcatgtcatataattatgccagcgtttatattattccagaagttggtaatgtgccatatttgcttgttatgctgacttgatgaccttgtgattttgcaggggccgtggcattgtcactggtatggttcattccattgacattcatccatcaagaaagcatatctgtgtggtaagttcaatgtcttagaaaatttgtg

SEQ ID NO: 50889 - DNA, 1129 bp, Oryza sativa
gtgatgagtgtcatgggccaggagtcccaggcccaatgggaacaatatccccgccccacgctacttacgtatctcagttagatagagtcagagtctgttgggattaggttagagtcctcgatctatataaagagggatcttatccaaggtcagagaggcattagattgagttatctcttaggctgtgttcttccccccattttcccaacccacctctcttgttttccacgcgcacacttttcaaactgctaaacggtgtgatttatgcaaaaactttttatatgaaagttgttttaaaaaatcatattaatccatttttcaaaaaaattagttaatacttaattaatcatgcaataatacgagcttagttttgcatgccgggctcctcccgaacacagccttagtgcccaccggccctgcctttcctgcacaatgtgctctagctccgttgcgctgtttaggtccagggccagtcctgttacttcctctattataatccaatttatcccccttcaccccctttcatctcaaataatcctcgccctgacaatgagccaaggtatatagcttaatcaaacagctgaatgttgcgtacacaccaagaagcctctgtttggactttggaccatgaagttggtatgatagggtgtccgctgttcactgagagtgatagtttctgttttctccaaaaatcttataaccaaatagaatacacgtaagaggaaacaaccatatatcagtgtattgacaaagtttcagacaggtggaaatctggatttgttctcaaagtcttttttttaaaagaaaaagtatatccatgtcggctgttttattgaaataattagaactccttcagagttaatggcgactaattccttgataatatccttaggtcagatgtatttactgatttcttgcagctcttcttagttatgtacaagggttgagatgttatttatatccccccccaaccccccccccccccacacacacacacacacaaaaagggaaatggcaatgtaactaataattcattgtaatgaatgaatgctgtcgagtcattggctacaactctcgcttcttatatttgccaaagatcggaaatttccaatcagaacaatctttgctg

SEQ ID NO: 50890 - DNA, 862 bp, Oryza sativa
cctggttctgctggttctggagttgctgcatcatcatgttcatcaactgtgcctgttgggccaagacttgagcgagtgtgggattctcggcgctgttgttattgttgttattgttgctgttggggccgttcccgttgctgcgagtgagcaccatctgacatagacaggagcacaagaagagaaacaggggagaactacttaggacagataattaaattaattaacttaacttttattgatcttaactgagtttcattattacaaagctgaagactctctcaccatctaactcaccaacttcctaacactcaaaagcaaataaagacatgcatttacatcccaccaatgatgtaaacgcacgcagaacccacacacacaaccaaacttaaacaagcaaactaacacaacgttctaaggcaacgactagcaaaacggtctaggtcttctgggcatcggagttgattgaaggctcgttcggcacgtccccatcatcttgagttggcccccactcgatcttggaatgggtacgtttggattcctcttcatcatcacttacattgacaaccggaggatccgctggggtagcttctttttccaccacacgaacctttggtgccaactgatagcgagggacgaatagagctctcttccttgcggtaagacggactctggccttctgcggtggtgcttctcccttcaacgcggctagctccttctccaaatgatccaccttgtcttctagcttgcagatcttccccctattccggtctcacgatcttgagcggctattacaatctcagcgcgggtttcatccatagcccatagcatctcaaccaaatgccttgtggtagcgtcgttctcg

SEQ ID NO: 50891 - DNA, 1298 bp, Oryza sativa
aatgatgacaacatgaagagaatagcggaaagtaaactgaacataaagaaagtgaatctgagttgcttgttcgtgggagctattcccagttatgaaccaagtgatatgttcgcagatagtctacagaggtcagagtaaaatcacatctaaccacgaagcttcaaaatttggccggataacgctcagacaataagaagtccaacagtaaaactatttgggaagacgtcaaagtatatcaagtgggataagttggttctcttgggaagcataattcaaaggcaaagttatcgaccctcgaatcgaatagcagaagtagctagcacccggagaccagggaagctaatatgaggcagttaggggcaagtggccaaacatgatatcctagtaatgacaaagctgatgtcgacgcatgtcacgaaggtggtaacttgtatgaggttgacgccaaagatatgaatgataagaagttctagaactgaagccccatcctcaaccaccgcagcctagtctgagtcagttaaaggtgcaaccagggacaagtcgggtgaagagaagatttcatctgcaacaggagatcgagccaagcagtccagagtggagaagtttagttagacaagtttgttatagaagacagagcggaagaagtcagacaagaagagaagaccgcccaacctatcttcttgctggcctcctcgaatctcggggacgagattcttgtaaggggggtggatttgtcacgtcctgataaattcatcccgaattaaaattcattctctaaaaggaataatagaattaattaaaattcgaaaagaaattggcaaacactaaaatacgtacaagaaaaattcaaaagtggcccggagaatttttgtcaaattctccttggtctaaaaggagccctcaaattttagtggaattttcagagcacaaataataattgttaagaaataaacaaagttaaaaaggatttataaaaagaaaaaccctaaaagaagtccttttccccccctcccttcttgggccggctcggcccagtccctccctctctctctcttcccccgcggcccatcggcctcccccgcgcgcgcgccgctgacaggcgggcccgctccccgctctcgctgacgggtgggtcccgcctgtcgtcttcctcctcgcgccgcgccgccgctcgcccgtgccctagcgcccccgccgccgcggatttcgccgcatcccgccgtcccagcgcgcattaaagaggggaaaatactccccgcgattccctctcccgtttccccctctttttcctctctctc

SEQ ID NO: 50892 - DNA, 1462 bp, Oryza sativa
agggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaactatttgtgaaagttccttttttctccttcccctaatgctatttgcaaaatgtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcct

SEQ ID NO: 50893 - DNA, 4040 bp, Oryza sativa
agatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgtcgaagctccagaagactgttggatccgtcagcgcagcaaaggaagcagtgaagccagatgtgtagcaagagtgaagatcttggagaacccgtcgcagaacctaagccaccctctaaggtagagtcgttagttgtgtgtttccttgcttgtgtgtgtagcgcgtggtttgcatcggtggggtgtgatgtaaccatgctaggttgtttgcttaatcaacttgcagaataagtgaaacaaacagcacatcaacaaaaagagttagttcctttaaggtcctgtccctagttctggtctattctttcctggcttgtttcctctctcacctcaatccctgtaacagatgtttaacagagaaaaaggaaagaatgtcagcgggtatgcctccagtaactcaagttttcaattcaatccaccactggcctcaagagagttaaccagggcacacccttggtccattccaagcatgctgcttagttcacagctaccattagttggaagtcaagaccaaaatcagtatgtgtttgatcgagcgtttgccacccaggtcaatgagcttccaatgccagaagaggatgtccccttttgtcacgattgtagagagcaaggacactatgccctgaattgtccatgggtatatgtcaaagaagccccttcctttggtttagcagggcagacatcgctaaaccagcctcctcgcaccaagtcaagtttgcagcctagtgtgcaaagtgaagagcccaatggagacaatccattgaatcctagaaaatgctttcctcctagcctttcgcaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggattatgaagatgagtccccccgacatctcggcgaggaagagatggaatcaaaagcatgcccccgttgtggagaaattggacacgttgctagcatgtgtttcacactttgccctcattgtgaggaagaccatccaccaggtgaatgtcccacccgcaaggtacatgttttctctgcgcaggtacaaaccatgtgcccaaggattgccaactcagtgtgttgttgaccaagaccgcagatatccaacgaacaaccctacgattgtctcgtcagttagtcagctccaacagcaacatcgacgatataatccacagcaccaatgctcctcttggtgcacctgattctgcagtgaatcatagcgataataccttcagcaccaaccattctttgcaccgacagcctcagcaaagaattgttatcgatgaaagcagttgtgtctctccccgacatactccaggccgagcaaagggcaatcaatctcagagggcgataccaagcagaagaccatcatccgcttcaaacagcaatcagaaggaagcttctcctgtgaatgatagcaatatgcagtcctatcacatatcacagaccaatcaaggatgatgcagtcactagaacaatgccagctatatctctccagaatcaaaatgagcagccatgtttgtggttttcagttcgctacttatcatggtgtaatcgaaagtttgcagcaatcatgtaatacataaatatattcatgtctataaacagtgggtttgctatgcttatggatgattcatgttgaggatacaatgtaccgatgttaagcaccgtcccttttttgtttaaggcagtgcctcgtattcatgtaatgagggagaaatgtgtaatacagacaagttccatgaggattcttttggaagatgcgggtatgtgattatgtgtataattgcttactgataaaggagacctagggtctcatttcagaggaactatgttctaaccttgagttaataaccaacctgttgatggaaaagaaaaccaattaaactgtgttgggttaaaaggccaatgagacagtagttggggataggagtttggatacgccttttacagatcaagataaggattgttggatgaaacccataagggtacccgccatgcctctacattgataagttcggatatacctgcaaacagtaagaagatccaggagacatcaatatttgagaacataatagtcgatggttggtaattagtctatcaggtatcagaaaaaggtcaaaggtgatatggcagaagaacaatatggatgctccccatctcgaggaagcactcaagatgaccatcggcaattaaaccctagtggtatagatacagatagcaggcaatgtatttccctgaaggtagtcagtgtagctttttgacgcaccacatcaaggtttcactgaaaggcagcaagccaaaggacctcatcgtccccagaagcgtccgcaatccacattaaagaataccacctgttagagataagccgaaagatgatttataaaagagattggcaaagatgttctctagcatgaaagaagtaggccgaaaggtgattgataaacagaaacatgctctgcatcgctcaaggacgacccctgatagtaattgccccgcaacagtcaccttgtcattaagtaagcgagatgacctaggtaaaaatgtttctatgaaggcaaggagtgaaatcttcaactcggtatcagatgctacacggagtgaaaagtgcaagcaccggttaccaggtaatgccatgtcttgggagatgatccaatgggaaagaacacatcaaggttaaaggtgtaaaggaatacgttgaatgctaactgaggacaacctgaagataataatgggaagtaaactgaacataaagaaagtgaatctgcgttgcttgttcgtgggagctattcccagttatgaaccaagtgatatgatcgaagatagtctacagaggtcagattaaaatcacctccaacaacgaagcttcaggtctggcaggaccacgatcagacaataacaagtccagcagcaaagtcattcgggaagacgtcaaagtatgtcaagtgggataaattggttctcttgggaagcataacttatagttagagtggttgacccttgcatcaaatagcagaagtagctatcacccggagaccagggaagctaatatgaggcagttggtggcgagttagaagcaaataacaagcatggtatcctagtaatgataagcaggttacgacgcatgacacgaagttgataacttgtccgaggttgactccgaagatatgaatcatgagaagttctggaacggaagcatcactgcactaccgcaacctagtctgagtcagccaaaaggtgcaccctggtccaagtcaggtgaagggaagattccatccgcaacaggaggtcaagccaagcagttccgagtggtgaagttttgctggaagtttgtcaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattctctaaaaggaataatagaattaattaaaattccaaaagaaattggcaaaccttaaaatacgt

SEQ ID NO: 50894 - DNA, 922 bp, Oryza sativa
gtctcctctttcatgttcatcatgggcatttttaagtattgggagagggcgaaggctatgctgctcgccaacctagagaacttgcgaagctcaatcaagaagaaggaggaggaggagacaaggagacgacgaagcttgagaaatatttggcgtccaagcagttcgaagcatgataatgacgaggaggcactgctggttgctcatggcctgctcgacatcaccaaaggcgccttcgtcgtttcttcagtcgacgagcatcaaatccctgtctatgctgccaggagacgagagatatttcctaagagtggctgggggatgatgtacaaggtggtcgacatggagctctccctcatgtatgacatcctctacaccaaggcggccatggtgcacacatggcatggctacgctatgcgtgccgcctctccgttcgccacttccgtggccttcatgctgttttggtttgacagcaagcaaggtcagcggatgaccgatgttttgatcacctatttcttgctgggaggtacggtcctcctagacatcatatggcttctcagagcagtggcatcaacaaggacctattcgttcctcaatgataggccacacttgtgggttcatcacgcatttttgtgctctgggaagtggcgcctgctccgtcgtctcattgtctccctggatccgtcgttgatcctcgccaaggaaccaagtagctacaggaagtggtctggaaaaattggacagtataacttgttacacaagtacactcatgacaaggacgaaaggaccagagattacttgagctatgtggtagagaaagtagcatcggaagacatctcgatggagtacgaataccacaacttgaggggtattcatatttctgtggatttcaagaagaacttgttggattgtatttgggactatatgt

SEQ ID NO: 50895 - DNA, 7231 bp, Oryza sativa
  unsure (1)..(7231): unsure at all n locations
gacgtggaggagaagaagaaggagaaggaggagaagaagaagaagaagaagaagggaacggcggagaagaagccagatccgccgatgaagccggctgagcaccacaatattgagaacattcggaaattggaagaagctctggattttcttcctgaatttcaggagtccattcttatcatgcacatcactacgaatgtcgtcttcatgtacactgaatctgaacaaaatgcagaatcgtccaagtccaaagacaatgtggaggtgaatcaaggcattgtcggattacatgatattccttatcgcggtgcgacccaccatactacctggtctcaagctgcgcagcctgtatgaagctaccgaggatgctcttgccaaaatatggtctaagaaagaatcttcccgctgcagctccagatcaagacaaaagtgtcttgctgacatcctgcgatgcatggagaacaaaaggagagagaaaaggccggataaatccgacaactggaggctaggctacaggacccggaactggcaaccagactatacaaccgacctttacagcattagtattgttctgtccgatgggattaaactagctgatcatttgctgcaatggctgcatcgtaattactgggttaaatttcccaaatctgaatactcgtacgaggcaaaatttgcacagatgtttccgaaattgagaaaaatcctgaacgggcgctcgatgtacgactaccccgataaatggtcgcgactgctggaacacatcttcttagagtgggtgcgtctgctgattaacgcgtccgtcaagtgtacaagagattctcacgccaagcagctgagccgtggtggtgagctcacgaccgtcgtttggatcctagttgaacacgcgggcgtatttcgcgtcgaccgtcaaaagagatgaaactgtttgatgctacaattcctactgaatcgaggggttcatatataagttgagatgtctgtcttctcttgtcctctgtacctgtaaaactcaaactcaatttgtagatcacagggttctcaattatatattacctgtacaatctttttctcatcgatatgataaatctaccatgggtccaaaatattcaaaaatatagcctttacttgtttctgatttaaaaaatcccaaaattcaaacggaaggctataagtttaccaacaaagatgtcaggaaaattttaaacacaaactataattgtacactagaagcttcagcaatttatgcagacactactaaaaaaacgtgtttgggtgccggttggcaaccanccatatgtgctggatttcccaaccagcacccaacaaacggcaccttcgagtctcctcaaaggtgatggtttaaaaaccaacacatttaaggttcccggaatgaaaaaataaacggctcaatgcactggctcaaatcgagccgatgcaccaagtgctccaccctgcttcgcccccgaaatcgcaccccccccaaaaaaaataaaaaataaaaaatcaatcatcaacaacacaacacacaacatcatctaaaaacgaagacacaacaacatcatctaaaaagcaagcccctgccgctgcctcggctggatctgttcgcgggagccaccgccagatccgccgcgggagaagcttgggacggagggggaggagagggggtagaggatcactggatctgcccagcggaaacgccactgccttcacctccgccggatccggccacgggagcaccgatgccgccgccgctgtcgctggataagcttggtggcaaagggatgggagagggagtagaggaccgccggatccacccgtcgaaaatgccattgttgcgtcctccaccggatccgcccatgtgagccgccgacgccaccgccaccaccggatcggctgcgggaggagcttgggggcggagggggactgggagggggtagaggacagccagatccggacagtgggagccgtcgacgccatcgcttccatcagatgtaccgccggtgagggatgtgagagggaaaggaggcggggaccagagagagagaggaggggatggcgggtgggggacagtgacagagataaaaagaggcgcgggtatatgggtggatataaggataaggactgggaccgattggctcgtctcggatttttggtgttggattattaaaatccagtataatatattataggtgtcggttgttttaaaaaaaatggcactatagtatttatgtcggtcctttttttttcaccctgcaggaatagaaaaagtctataggtgccagttttagatattccggtatttatagtgatgtatatactttatgtgtttatgtagtagtgagacttaggggtcaaaatttaccaaccgggactaaagatggatctcaaccgggactaaagatgggcatctttagtcccggattgctactcccggttggaaacccgggactaaagggggttcccaaccgggagtaaaaaaggtttctccaccagtggtagtgtgaaactggaatactgaaacaattgaaacttcaggatataactgcggtttcgtactatagtctatatatgattaagaatcaatccatatgttaggatacacgtgtgtgtatatatatatatatatatatacatatatatatatatatacatatatatatacatatatatatacatatatatacatatatatacatatatatatatatatatacatatatatataaaatatttgaaattgcaaaaatatggaataacttatgataatttctgtgaaaaatgctaccgcatggaccacttgttaccaattgacatgttggctgtcacttgtcatgaaaaaatatagtctgactaccaaagaaacatggtggacttggtaacaatgttatgagaaccactttatctatttatatgtcaagtgtgtttttatggatgtgatagcaatgttgaggatatgtgtgctagccactgatcatgggcctgtacgtacagtgtacactccacgtatttggcaattctatcccgggtgccgaaaaaattagtactttgataaatgtaagaatcataattatttatgtattatgtttacattattgttcctaattcttaaaatcacaacccacgatgaattcggctagctgggttcgtgattctcagtccaaatcatcgacccagggtcatcgacctgcatgacatggagtcatgtccctcgaccgatactttcgaactgggatcatcgtcccagctttatcaggatcgtggtccataacggtcgattggcgtcccgaggaggtatactcccgtcgtaccacacttttccaagtgtcgctcctcgtccgtcgaccctgttcctcgacccagtcgacccatatttttggtgactatgccttgaccacagttgtcgtggtcgcgtgcggtcgaggtctcacgtggactgccacgcttcgtctggatctgtgccgccgtcgccttgatccggtgtcagaacgagcccccaccatcgccttccagctcgtcgtcatcgctgagccttgccgagccctgccttgcctcacctcgatctacccatgtgtcaccgcctggattcgccgctaagccccaccgagccttgcctagatctgccgtcgagccctgcctcagacccacgccgccaagcccgtgtgctgccgagcctcacacctcagatccgcacgcccgagcgccgcccctgggtgtgtcgtcgccccaagcttgagagcgacagagatcgagagggtgtgagggagaagaggagggaggagagatctagagagaaaggaaatgtagctaagggagaggtaggtggctgtttttttatagggcctttagtttattttttatggcggccagttaagagaaccgcttggaaaaatctatttttataattataaaaataaaaattggcttataagcttataagcggtgctcttatctggccacaggaaaaaaagttatttttacaagcggtcgtcttaaaaaaaccattcgtaaaaatatagttttgcaagcggttattacctagggacctccaattgcatcttcacaaactttcttattttcttaggcgaaataaaaatggtgactccatgaaaatatttttttaagtaatgtaacttctcaacgatccaaaaattaatctctacttatactttttttttcatttcgatatagaatgatgcctatattggctgacaaatttcttccaaaattacacattctacataagccaagtctttggcggctgtcagaaatactatacctaccttgcaacctactccatgcgtctgcttgtgatccccaagatctagactgctcacagtgcacagatgcctgtcaactttacaaagattccgacatcccacaaatctgtccaatgagctgactcctttaacgatgacaaattaaggataatgatgatttggcaacaagtgtgccacagatatgctaatgatatccacacattgtccctgttgcgtttctttagagtcgaactaattaaacgccgaaagttattccatatttttttcaatgaaaaatgtattatataatttgtcctaacataaagattatttaattagcctaaggatgccaactagaaggcctagaaactcagttattttagtccccatgtttcatactactaaataaagaaaattgaccttggtttttctttagtgtcgtggtgtgtttgtgcttatgttgactaaggatcatgctaagaaaagagtcaaacacatggcaaatgggcactgatatgatattttcataagttgatatgtattagtaccgaaatgacaagaaaatatttaaaaagtggatatagaaaaggagaagaaaatccattcttcagttcacaagaagatttgtaatcctcattctactgttcatgtcgaactatccatcgcatcacgcatgcgactgatgatacaagcagctgggtcagcttatccgctccaggtggggaattgccggctagccaagtgagaccgtgggggcaatgggccgaaggcccatctagaccagcaaggcagggagggctccgaggttctctcgtgcagtgcgtgtctgccccagcgagtatgtagaatatacgaaaccgatacgatgacggtgttgtacaaaaatttgagataaaaacacctaaaacttttataatagtggagataaaggaataggttaaattgccggtccacacgtaaactgagtgtagagaataattgagaaccctgcaaattagttaattactccctccgttttcatattataagatattttgactttggttaaaatcgaactacttcaaatttaactaaggttatagacaaatatagtaatatttatataaccaaattagttttattaaattaataactaaatatatttttataataaatttatcttggtttaaaaatattactattttttctatgaacttggtaaaatttgaagcaatttgactttaactaaagttaaaacatcatataacctgaaacgaagggagtagtagctacaagtcgatcgagttacacaagtacacacaggagaaatgaaaaaaaaaagttctaactaaaggagatcaaatgaacacatcaatcagagacgctatggatatctgtcagtagcgagacacatgaatgcctagtctatcgtagctatctgctggtttcctcttcgtcgtctttttcacacgaagaatgcgagcgtgttcagcgaggatccacacaacggtagtgagctcaccaccacgagcaagctgcttggcatgggaattcctcgtacatctgatggacacgttaatcaagagacgcacccactctctgaagatgatgtccctcacttccttgggcatttgatactctaattcagtctcagtcgcctcaccggatttcatcaaatccggaaactgccgcttaagtttgtcttcgagtactttgttgtctccaatttcgatcttagaaccaggtttccaatttagcagaagattggctagtctagctccgtcagatagaatataactcgagtcgtaaagaacacttagataggcacctggtgacagtatctcagttttgttcccttgatgccacttgaatgttctcatgggtgtctttccattcttcttcatctccttatcaagcagacttttggcaagacacttctctctcgccatggagttgttgaaggaggaagaattttttatctccttccattgttcacccaaagcatcaaggagagcatcgtaccggctactgagtgcgaggcccgggagcatggtcggtcgcaccgcgacgaggaacatcatgtaatccgacaacgccttgatcgccttcccccactccgattgatcttgattttgaccggattccgtgtgaaagaggaagatgtccgtggcgacgtgcaggacaagaatggtctcttgtaaatcaggagtgaaatccagggcatcgtttagttcctgatcaataccaatagtagctttcgcagcagcctccgcagcaaccgtcgcagaaggaaacggatcctccacatgtatccattttggatccgataactgcacaggcggtatccgttcaggaaacgctaagtccatgtttttccaaacacggtcaaacagcttgttcctgaaatctcttgaaatatgaatgcctctcgagttgtggtattcgtactccatccatgcttcttccggtgcattcttcttccaccaagagctccagaagttgctggtcttctcgtcctcctcccgagtgcactccctcaacaagttatactgcccaatggttcctaaccacatcctgtacctagttggtttcttattattggcaaggaaccgaaatagattcaaagagaggatgaatcgacggagcatgcgccatttccctgagcacagaagtgcatgatgaagccacgatcgtggcctatcattcaggtaagaataggtccatgtggacaccactgctcggaggagccatttgatatccaagatgacggcgccacctagcaagacgtaggtgattacaacgtctgccgtcgcctggccttgcttgctgtggaaccaaaacagcaggaatgcagttgctccgaggaatggagaggcgaaacggatggcgtagccaccccaagtttgtaccataactttcttggtgtagaggatgtcgtacatgagggagagctccatgctgacaaccttgtacagtgtctcatcccaggtaccagagag

SEQ ID NO: 50896 - DNA, 7858 bp, Oryza sativa
tcatcactccttttgtccaaaaaatccatgaaggcattcttggtaatatatagcatatcatgagcaatgagcaggatctgctcatcatccggcttcctgcctccccggctagtattttggaggctgctgctgctgcttcgtcttctcatgttctccttcttcttctcctcctcctttcttgagcttctcatgttctccaggtttccgcgctgcagcgcgtagtatgccccctcgaaatacttggcgatagccatgaggcagacaaaggaggaaatccagagcatggagtcgccaggcatggcgaacatattcaggtacaggatataggcaggcgacacgggtccaaactgttatgaacgacgtatagaaatatgaagtaaacgaaaaacaatcacagcggagacacacgatttaacgtggaaaacccctttaatgcgaaaggggaaaaaaccacgagcaccagccagcaacaatctcactatctcaagagttttgggttacacgcctatggcggcttacaagagaatcaagtctccacgaaaccctagctccggcccaagcctccggcttaggcctccgctccgcttcgtcagaagcccggccaatatcttgaagtgaatttagaacaactccaacacaaacacctgagcaatcacatctaccttctgtcgcagcgagaggacgctgtcttccaaggcgtaggcggcgatgttgtccggcctggcagcatgcagcagcatgaacgccgcccagagcgtcgcctgctgtctctcctggaccgtgctgccgatggttattatgcccagcgcggcggtcggggcccaacgggcaccctcgtttgccacccacaggaggaatgtcgccccaccggtcgcttggcggcggcgaactccggcgaacaagacgaggacgacatgagcaatgaagctgagggctaccactcccggatcgaaaaaagaaagtctctgatgaacatcatggtacccatccatccaggcatcgcccctgctaatgcatgtggttaggacgtaatttataaacaaactagacgtacgtcaaacaatcaaccaagagacgtacgtaccggccatgcgctcgttgaatctgatggcgttacagttaatttgccactgatggactacgcctgactggatagtatatatcactatatatcaagctggttcgaatctacaagggctagaacaacagcaaacaagatgtgcactggtgccttgggtgtacgtgtttaacaatgcttgagcaatccaggtatacttatagggatctgggcatttcattagtatctcgatctgttattgcacgcttacatttcattagccaaaagtgctacttaatatgctacagtgcatgctagcattatgatcaaaccatttttcatacatctgcgctattctaagcaagggtgtactagcgcccggtttagttcccaaaaatttttgttttgggtgtcacatcggatatacggacacacatttaaagtattaaacgttgtctagtaacatgagcatcaccaccatattagagaatatatgggatcccagttgcttctgccacatttgtattaatttgctaaaactcctcttttccacaacctccaagtgaatatagttagtagttaactactctctccatcccatatataatcacttttggattttgacacggttttcgagatactactttgacttaaaagtaatatgttttaaatagaaagaactgcatattaattatgatagtttgtttaatgataaatccagtaacatcaattttacttaattgatctttttttatatttttgttattaatagtcaaagttacaaatatttgattgggcactatgctaaaaatgattatattttaggacagagggaataatttcctggaatgatgttctcttctcagaatcatagagaaggaatgtttgttcttcatttcattttatcaaacaacatttcaaattacagcatcttaatttacaccgggttttaatattactgcagaaattaaaaacattttctgcgtgcataatgccataatgacggaaatagaactacttaagtttcggacatactccctccgatccatccaaaaaaactcaacttctaaagtttaaattttattttaaaaaaccaaattctaacatcctacctaccctcagcatataaaacgagaagttttatctcttaaattccctttacctacctattaccattgctacttttttcaataataagagatattttgcttatttttactcttcactattttctccttgggatgtgctaggaatagacttttttttggacggcgagagtattctaagaacataaacatttttttctgaactgaaaaaaaaattgctgcaaaaaatatattctgccaggtgggccgacagataactaatatttcaatccagcatttaaaatctgatcgacgtcctaacgaactaattttaggctgttcttcccctctttttctaactcatctgcctcgtttttcgcgcgcacgcttttgaaacttctaaatgatgagtttttttttaaaagtttatatacgaaacttactttaaaaaaatcatattgatccagttttgaaaaaaaaagctaatacttaactaatcacacgctaataaactactttattttccgtgttaagaatatgggttgccaatccaggctgccgaacacatattgcctgttgataaataattggtgttcatctaattcggtaaagcatcgacctccttaattaattatcaacagcttcgactccacatattgcaagagtggcgaggtagttaataatacacctgccggtagggatgaaacggtcggaaattgtcagaaacggtatattattttattatttttttgaaaacaaacgaaaacggtcagaaaattttgatatttatgaatttatctatttaatgtcaacttcaatgtcacactgacataaattaaaaaaaataaattttaaaaacggtaaccatcggtaaaaatattattattatactagttctgtggaaatcataccgttttcacctctaagtgccggtatgccccgcacacgttaactgcctcgccggcttatacatcctcgggtgtgagtgatttccctgtctccacgttaataatacaaggctcaattctccacggatgcatgcatctagtatggttctacacaggccggtagaccatagtagttgactatatatatagtagtagctgctagcttatgttgtttgtttttatatccagctcccgatctaatttttttctccttttcttattcatttgatttcttgcatatgtgccatcacatatatttgagtgtcagctacatgactcactcttagctcctaagagcaatgtcaatagtgtcacccgctaatggctgtaaaaatgactacatcagtctcttatagatattactaaaagctaatatatataataagtagatttacattgactattatttatttttttaatctttagctagcttccccatctaattttttaattttattgccgttgtttcgtccaaccattactgaatcgtgtcagctcgcgtggacccacaatcgcatgtcccaatcaaagctagcctggtgttgctacacttgcgttgggacgtgtgagtagccggtgataatttagtcgcagactcacgctctctctcctgtctagctcattgacaaatccgatgtggcagttttattgctggctaaacaggtttattatactttctctaatgcatataatcgtaggttgcccatggtacatgtaggtactaggtctaattaatatctaacaacacaaattctaattaatacctaacaataccgataccgatggatactagcatatctatatgtaccaggcgtgacacatatgggtatatccgatactcagctaccaagtctgaaactgatatatactgtaatggtacctacgataccaaacataattcatatgggtattatatttgaaacacgtgggtatcatgtttgatacctatatatactatatatgatatctatcagtatcagacatggtatatataggtatcaagtataatacttaccaaccttgatacaataatactataagataataggtctgactaagtatcaagtatgatacaagataatattagagacgataatatgggtatctggtccaatatcttcgatgttacattattatcatctatgcaccgtatggtctctgtgctctaggaagagattttaaattaattaaactaaaaatagtaaatagaacaaacaagtgtttcccttgttttgtgcacccgacagaatttatttgtagcaattgagctcatatatagctcactagctcaatggacacaagccaaaaggcccagagttataaaatccatctattaatctaatgaactaactaaaaaattcacactcacagtctaaaattttctcagattaatcgaagaaaggaaaaaaaaagggtttgagtaggtacacaattcaaagcatctgaaattcggagtaaaaaataaaaacaagagtcaacctggaaatacacactgcaggaaaacccttcattagtcccggtttgcaacccctttcgtcccgggttgcaatccgggactaacgatgctagcgccaatgttttttttctttttttattgtttatttgctgcttgcattttgattttcccaaatcgagttgctccctacgtatccctaaatcaaagtaacaacatctcaaatcatatatttacatcacaaattctcaaaaaaaaatcacgaattctaaaagaaatacattacagatccaatgaaagacaaattctaaaaaaaaaagaaagaataacataaaaaaatctagcgctactgcctcccgccaccctccgcccacctgccacctccctcccatccgcccacctgccacctcccttcgatccgcccgccgccaccctcccctacaccagcccctgccctcccatccgcccgccacaaccctcccctccgccagccgctgccctcccctcccgccgctcatggtgcgccgccgcgcaccaccgctcgccgccgcaaaccaccacctgccgtcgccctccgcacaccatggagagggccaggaagggaaggaggggatcgaggagaggggagggccggggaaggttgcctcggagagggccgggaacgagaagaggaggagtggatcgaggatagttgtggatcgaggggacgaggagtggaggaggaggggcatgagtagataaggatgggatgtgtgcgaggcatatgtcactgcaccttttttttttcaatttttgtcccagttggtataaacaactgggactaaaagtgtgtggggccgggggggctgacacggcctaaccacgttttgaaccgggactaaaaataaacaaaaatcgggactaaagatcataaagtgttgtgccgcttttgaatcggggctaaagatcttgtttagtcctgattcttatttaaacaggactaatgtgatttttagccaacccagcaaagatagttacaatttagaaaaataaaattgtattgtggcaagaaatttttaaaaaataataataagataataaaataataaaataggtagaaattctgtggcttggattatagctgtcacatgaatccttcgtacttggacaaagtggaatgcaacaactgccatcaaatgagacatcattctcaacagtgtcctcaaggacaaggacacaaggtagtaccaggatacaatccaaggtagcaagtactaatggagcacctacgtaccgttggacacaagatcatgactaattaataaaccgtacactgggtaggtgtcacaagtaatggagcacctaccattgaacacaagagcatgactaattaataaagggacaatttaaaccatgccacacaaattttacaaaatttgtgatatgccaccctgacccacatgtcattgactcatgtgggtcttacatgtcattgagatacgggtggtatatctcaaattttgtaaatatagggtggcatggttccaacaaacccaataataaaccacactgtacactgtataggtgtcataagtaatggagcacccaccgttggacacaagcagcggatcgatcagtgtcacaacctacgccagctttcaggagatcccgactaataaaccacgggcctgtttggcacagctccagctccaactccacccctccttgagctggagctcagacaaacaatttcagctccaccaaaactaggagtggagttgggtggagctctctcaaaaaatgtactagagttgtggagctgggtttaggcagctccacaactccactccagactcaactcctggagttatatttaggagttggagttgtaccaaataggcccgtgtcattgggacagaagaaattctggaagaactactcaatgaggcataataacaaataggtaaaacttgctatagaacattcaaaaaacatgtaatttgctatggaacaccgtaagaacgtgtagctgttgtaggacatcgcaaaaactgataattagctgctggacacccgtgacattattttattatttttgaatgaataggagagagaaacaattattaaggacaagttcgccctttgctcaaatcaatccaccatgggccccacatgtaaggccctctttccagatgggacggtggggcggcgacgagcggagtagcaccggatcaagcaggtatgggacagcgggcgtagcggcggaccaatagcacgacgccacgtcgttagccgcaccgcgcgcgttcctcgcacgcaccttgacagcgagccaacccactgttcctgcgtgcgcatttgaaaccgtgtgggccccgccttctcctatgcgcgacacgtcgttgctcctcgcccgtgccatttccctcgcaccgaatgcgagcatgccacgcgtcctagcgtggagaccgcgtccgcccacgcctgcctatgggtcccgcgtgtcgtacgactcccgcgcttgcctcgtgaatctggggtcgccatgtcgccggctctgaagaagagaagagaataaaagagaggagaaagaaaggagaagcaagaagaagagtgtcatgggcaattcaggactctcaacgctctttctctctctattttcatcggaaatagtaaaatatgtcacgagtgtacaccagctaattactatatttctacagtacccacaagaaaataagcattctttagatatctcatagctaattacacattttttgagtgtcctatagcaaattttgccgaaatagttgaggaccaagttccacttgaggagcagaacctgcaccaaagacatagaagtaccaagatcgacgtacaaagacctaaaaaataaagtcagtggtacaaagctactacgtagctttcaaggatcgacaccacccctagttcttagctaggttgcccgccgtagttctcccatagcttcccttattttgaatcttcgatcgggtcaagatttcttttgagtgggtaggtttataacaccccatttttctcatgctattaaaaactatttaaataaaaccttattgtgaaagtttggatctttgtgtctgatcaaggatctaagtgccaaagatctcaaaatctctctttgagacccaaaatttctttccaaactcaaatcttgggattcaaattttgaaatttgaatttccctttgttctttccaaatctcccaaatcctgaagccatcaaatgtctccaacaaaaacatcaatttttctttgaatgcccttccttgggctcctcttgagtttatgagttcaaatgtcaa

SEQ ID NO: 50897 - DNA, 2323 bp, Oryza sativa
ccattatcgtgctctgtttcccctcccacgacgccgttcgctgtaaaaccgccagccgccatcggtcgtcgatacagtcctaggtcaacgcggacccagaccaccgatgcggcgtggttagccatgcgctgcctcactcactgttaacaacgaaattttgtatcagattcggagaagaaggaacaagatcgaagtggatttgatgaagaattgagttgagatcaaagttggaccgcgcattggctggcatcgttattgatggtcgttacaaaccaaattcgacggtcaatataactaaaataaaggagaattagctatgcttgcaatgcatatttgttttaaaataatatatttctatttgtacttggattctatctatctatagataaagagatacaaaatggaggagagccggcagcaaaacactcgaacaatcaatcagacgctgtcaagaattagacttgtggggaaatgggccagaaactcagaattgacatgatcaaataggcccataactcactgatttggattgaggagccaaagaggagatggcctgctgaacagggggcctgttgggccagcccatgttcagccgaaccataggcccccttagcaccgctggatgaagggttttgatctgacggtggggatttactcccaatggcagttggagggtattactaacctttccaactgccacaaccgttattcttcagctataaaagggcttcacctctaccactccttcacacactcaagcaagctcaattatctcttctacactttagtttagtattctagtgttaagtggagtagaatagaatagctcccggagtcatcggagtcttcggaggaattttggtatggttgtaatagctttccttctttcttttgtaagactttaacaattgatgaaatattcttattcatatgctctcgatacttcagttcatctaagtattgtttttactttatatctgtatcgatacaactgtatagttagcctaccagcaaggtacaatggtgtgggtttaatgttcgattattcggttgctctatgttatctcgagggatgtagagtattatttaataatgtagacgtggtgtctagattattaagtatcattatctaggcatatatggtacgggttagtcgaggtgggccgctgatggtgacagctcagtacgggtattcctccacgatagtatatattcctaagaaactttcctagggagggtactccttcgtatttagccccggttggacggccatgacaggttgtcgtaaggaactcgacaagccgcggtggtctctcgaagcactaggagggcactattagggggtattggctatatagttgtatactagcagatgtagactaaagttgggtgtatattataattataggaatcgattgtttttctatttcttcttccacttagtttaggaatgattaaatgagatacatgagtgctttgcttcgtgtcactctacccatataaatatcttaacccctacttagactttgattatgcaagtggcatgtatatatattattagcatagttctctcttacaatcttcccttgggattaaataaataagatactttcgaatactcctgggtgaaatgctacaatggtatatccgtgcacttgcaggttctttctgtaaaccatatatatactaggtccatttctagcatcatggctaggaatttatatttctagtagtatcattaagaaataccaataagcatttttggcgccgttgccggggaagattaataaagagattactataagctaataatttatacacaccacctctgtatatatcactgtcctttgtaggctaaccttggttgttttcacttttcgtgtgaaaatagggtagtgcacatctggtttcaacttgccggaaaatttcaaagacaatccagagtctttcttctagaatgttaagccgcgagttagaaaaatcacctgaccaagaaaccaaccatccccgcgtcaccgagcttgtagagtatggccgagaagacactccgcgagttcactgccccctcagctgacaacgtgcccgttgggccgcaagtcaacttgtgagatgcatactttgatttgaagaccagcctcatcatgatggcgcaggctagcccattctgtggcaagcttaacgaggatgccagtgatcatctgcaaaggttcctggatatctgcagcacgtacactatgaaaggagtcagcccagatgtcgtcaggctcaggctattcccattttcccttcttaggaaagcgaagcagtggttctatgccaaccg

SEQ ID NO: 50898 - DNA, 4167 bp, Oryza sativa
ccaactggtcgactcgtcggaccgctacctatcagggattgcggaggacgtgccggtcaagatttgagacttcttcatcccggtcaattcgtggtgctagatatggactcggataaggaaacaccgctcattcttgggcattcgcctctgagcaccgccgaagccaacatagacatgggagtaggcagcaaacgtttccacatcaacgagaaagagaattttgagtttcggctaaggatgaaacaatgctccacggtgaggatcaagtacgggccgaatccatagaatattaaagaggtctaagtgaagccgcccaagatggataacctcatgcattcatgaagaacttcctagagaaggaagtgtcaatgaacaggccctgtccaaagaagacaccggtgaaaactagtgcactggcaaagcagcctgatgaagcatgtatgcccccgttgttaatttggtaattaatgacaagcactaattgtggactaaccgttctattgagttacatattttacgttaggatcacataatgtgtgcatatggatgattatcgcggactaaaattgatggcgcaaaccaaaaggaaaagaagacggtaaactagtgttttaattgtaaattgatcgaggagttgtgcgatcaaaatttgctagtttatttttagcttcgctatactattatggggtgtaatgacctagacaaagagatgatcgaaatgccacattaggtcatttgcatttagacttgtgctcaatttatatacatttgagattgtctgactagggccggtctgaccgaggcatagatgccggtctgaccgatgggtagcggccggactaaccgtcgggttaaccacggtctgaccgcccccctggaggttggcggtggtgctttggggaggggatccagagccgcagccggtcagaccggtagcacactgagttgggagatttcgcccccgacggctagttttggttggtgggagtataaatactcacccaccagcaacaaggggtctctcttggcacttgcttcacttgcatacaccccttgcatctctcccacactcaattaagctttgtgttcatgcatgtcacacccagagttttcccttcccttagatttcaaatcactaataattgacttcaagaatttgctttggttaaccaggataaaaccctagttaacgatacatttaataatcggaattgtcagggagaatttttttcgaattctctttgctctgtaaccgctaacaggacttaaagagtaaatatcagatcaccggaggcaatgttgctaagttaaaaagtgtcaagctaatctccttcctttacctttggtcgtgaattgtgcccaattcactccctctcagtccgcactttccttttgcatgacgaaccgtattcgtgtcagttcgtgggatcgttcttttcctttcctaaaacagcatcgcattgtttttccttttcgggaaagacctagtctcccctagtttccatttccctccccctctccccaaccagccatgccccctcccctactcgcatgcgcgcccctcctcccctcttatccggctccctcccctcctcctagtcctacttcctctacgactccaccattcctaatccaaccctctcctatatgtgtgtcctccccttgtttttttttgtttttcccgagtcctagtcgcaagccgccaccgccgcttgctgtgccgccgccgccggccggtgccgccgccgccgtcgccaccgttgcgtcgccggtactccgttccccctcccctttagatgtatttggtcctgcactcatcaattcatctatctaattccttccgttcaatcttttccagcgtcgtcgtcgtcgatcccgagctcgccgccagaaccgccgccgccgtcaccgtcctttctccgctcatcgttgttctccggtgaggttctccgtccttttagggttaagatttttctgttcctagcgtttgtgtcatgtgtcgttgccctatccctagagctgagccgtcccgctgttggcggttattaaatgccaattttataccgccaacatctgcataaagtccagataataaaacatccaacatagtgataggtgttaaatctcacatatttcacaagtgttaggaggaaaatcagactaaagtgtgggagaaatatgtatccatacaaggatggtttgtgaacttcatcaaaataccaaagaatcagtccaacactcccagaaatggatagaggaggaccaggggaagagatgggtcgaaggccaggccaggtgggcccagcccaggttcggccgaacccgagccaggggtctcagccgttcaagctggggtttggcatggacgtcccagattactccctgatggcgattgcggggcaattcagacaattcacataaggataaccgtcatacgtacctctatataaggagcttcactccttcactcacacacactaccaagcttgagctgaattgtaagaggctctattgtactatattgtatactagaataggaagagagtagagtagaagaagtcggaagaattccggagttgtcggtaatcttctctcatttattttattctgtttattactctgatttcaatagagttatcttcctgagtaatttagatttatcttgtgagatttatctcttggttagttcctaaatagcataggggattattgttcactataatcaactaaaatatagtgattgctttagtgagttataagcactaaagtagatcttaattgcttagacgtggtgtttaggtaattgttatccaataattgatgtgtatcccgcagtacgtttgaggtagatgtagaggtggtgacagccctcgagatcacttaagttctccctgtccgggtacgtagtagagcaacatctgggaacagtgggttgccagtgcctgaagtattgtgttaggattaaacttaagcttaccctagacacactgattctcactagtaaatcctctctatactagcctatctttgcttggtgtccttggatgaaccggagaaaaggtctgatcacatacgttcccttggattcgatacccatagaatagtccataggggaagtgctacatcggcatatccatgcgcttgcggatttctatctgtgaccgtaagaattaccaacaagcatttctggcgctgttgccaggtaacggttgctgatcatttccgaacccagttcatcctcgtatctcttttcattttctattctacctttacccctgctacccagagaagtattcctgtcaaactcttctcgactatggagcaacctctcttcgagctgtctgttcctaggggcgaattctatgagccacttccttcattggagccaatttatacatctggctatgaaattcgccccgaactaatcagtatggttagggaaaactctttctggccttgatctagaaaatccctaccatcacatataggactttgagcaagtctgctcatgccttcagattcgtagcatgaaggaagaaactgtatggtggaaatttgtcacgcccggaatttctatccaaaattccaaacgcttacatgtgtgtgaaccctcgtccaggaatcagccgaggcacacaataacaaattgataatagagtacaattattactctaattaataagcaaataaaatgtcattacagaggtagatagttcctctcaatcaataaagatctaagcagcggaaaataagataaacggcgcagacggctccactccacaggcagcttgaccaaggctacacctaatcctccacaccatcagcatcattgaagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaagtattaaacaatattaatccaacgctacacaacataccctgttgcataggcccagccattcagatcaaccatcccggctgcatagttctatctccaaaccaggaatataccattccaaaccaggagctaataaaattattaccagttatagcatcatttactatggtgaga

SEQ ID NO: 50899 - DNA, 8425 bp, Oryza sativa
cataagttatcccaaaagtgagctaatgtttctaagcagggctaagcaattaaatctaatatctagttgaaccaacatatagagctcaactagtcaagttataataacccaaggtatcaaggaataaggtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgccttgctggccttggaactcttcaaactcttctccggcgaaaatggactctccggaaacgacggaatctaagcagaaagaagcaaaatcaccaaaacagcacataaacaagcttgaacagtacatgtggatatttttaacatgtacatctcaattttagaaaaatttagagacttgaaccaagtaaatcggagctaagataaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggctcacgcgaacggacggccgagatcgacttgatccaaaacggacggccgagatcgaacggtccacgaccggctcacagcaaacggccccgatgacgtcggcgatgacgtcaccaccggcggcggcggctcgggcttgcatgctcgccggcgaatgacggcacggcggcgcgaacggaaggcaccaacgggtagagcgcgacgcggtgaactcaccggtgaccaaaagagcggcggaagatcaacggacagcgacggcgacgaggaggaagcggcggcaaacttcgggtcgtcggcggcgacggtgctccggcggtcttcggcggcggcgaaggagcggacgaggacggcgacgtgacggcgaccacgacggcggtctacccgagcgacagcgacgtctggaacggcggcggcgcacggctggagcgacggctacgacggcggcgctaggttgcacggcgctagagctcttccggcgacgagaggcgaaggcgaaggtggcgacgggtagaggagacaccggggaaccttttaaaggggctcggaggcgacggcgaaggcccacggcggctggcgatgagaaggaaggtttagggttcggaggagagagacgaatccgattcgacctcgaatcaaacactttccaagccgttttagccgatgtttccaaaagggaaaaggtagaggagatcccgaggatcatttcccctctatcaattcggccggagaaggaaaggagcggccggatttggaagggaacggcggcagcgcggcgctagggttttgggaggcggccgacgcgaggaagacgacgacttgacaggcgggccccacctgtcagcgagcgagggcgcgcgcgcgcgggcggctgcggactgggccggctgggccttgagagagagaacggttttgtgccgactttcggcccaaagccaaaagagactttttcaaacctttttcaatttaaattattcatgaaatgcaattccatttattaaaaatagttccttagctcaaataaatctcagaaaaatctaggaattatagaattaagcaaagtatttaatgaaattttatctggccccattttatgttggaatttattaattaaaattagatcttctcttcaagacttttaaaattatttctaaaaattccaattaaacaacaatttatatattttgaattttcagggtgtgacaaaattgtttacgttctcccttcatgagagagtgaagcaatggtacacatctaccgttggatgtgtaaacggtagttgggaaaagttgcgagacagattttgtcttgctttcttcccagttactcgtattacaaccctttgagtagaaattctcaatttccggcagattgaaaacgaatccatcggtgtagcctggtccagattcactaatttagtgtagtctggaccaaccttatccttacccgactatgtgcttttgcaacattttcatacgggtctaaataaggaatctgcattctatctagacataaccgtcggaggatcattcatgcacaagatgccatcagaaggaaaagtaattctagacagcattctagaaaatacttccttcatgacgcaatgcgatgaaccccagctagaggcatccgtgtccaagatagaggaaccttcaacaatcgagtcacaacctgaaccttccacctctaccgactcgattgatgaaaaagttcccgagccatccgttgagactgaagaaattcagactccggatcgtgccgcaatcatgttcagggatggttttgatgaagactatggtaacaccctgaactacttcggtaaaaagaaaccactcgtccccttgccacctcccgatcctatggaacttgggttcctaagagaaactgtccgggagttgaaatctataatgagtgacgaatggctaagggagacagagctttcatctgaagtaattcaggggcataagccaaacgacttctccttctggaccctttttcttcaactgaggtttgattgaattaaatcctgtaaaattcataactaattcaaatgaagtcggaatgaggccgttcaagtctctaaattcatctaaaatcatgatctacatgtttgtttactttttatgtactatttatttggtttttcttagactttttcctcgttttgcgtgatatcttgtcttttccgtcgttacaatggtttgtgagtgcgtcggaagtattcaagaagattaatggaagacctattgttgcaaggcaagtcacacagatcctaaacacaattcctttgagcatgttgatcctatatttaaattatctatttatttcaactgtgcatttattttagaatgtcacaaggtggtgtgaaactattccttcgttatggccaattcgcattgattaccctattccttgataccttgggttataatttgactagttgaactttacatattggttcaactagatattggtataattgcttagccatgcttagaaacactagcacactatgggatgattaatgtttcactattatttatggttatattgaatgatagctcacgattgtcaatcgtgattggttaattaattatttgccaacttaaacttgacaatggtgggttgtgagcatatagttttgaagatcgtgctcatgacaactaaggaccggttcgtgagctattgttgtgagacattaaccgtgccaaccacaagccagcatgggcaatggctttatttttttgtataccatggttcattgttgtgagacattagacgtggtgtttaggtaattgttatccagtaattgctgcatatcccacaatatgttttaggtaggtgtagaggtggtgacagcccttgagattacttaagtcctccctatccgcgtatgtagtagagcgatatatgggaacagcgagttgctagtacctggagtattgtgttaggatgaaacttaagcttaccctagacactgtttctcactagtaaatcttctctatcctatatatatatatatatatatatatatatatatatatatgcttataccaaaggaagaagtgccagtggtacgagagtatctggatgtatttcctgaagaactaagtgaattacccccagatcaggaaatagaattcatcatggagttacttcctggaacgacacctatatcaaaaagaccttataggatgccaattaatgaattagaagaattaaagaaacaaatagccaagttagaaagaaaaggttttattcgaccaagttcttcaccttggggagctcctgtgctatttgtcaaaaagaaagatgcaagcttaagaatgtgtgttgactaccgagctttaaatgaagtaactattaagaacaaatatcacttgccaaggatcaacgatctatttgatcaattaaaaggagctagtgtattctctaaaatagatcttcgatcggggtatcatcaattgaaaatcagacaagaagatatatcaaagactgcctttgtgacaaggtatggattatatgagtttacaattatagcatttggactaacaaatgctccggcttattttatgaatctattgacagaaaactaatcttctctccaacgctgatgttaccaaatttgattgttaacagaatctcatgaacaatatatttatggagtatttggaccagtttgttgtcgtgtttattgacgacattcttatatacaccaaaaatgaagaagaacataaataatatctccgattggtactggagaagttaaagcaacgccaactttatgccaaattctgtaagtatgaattttggctagatcaagttgcattcttgggacataattaccaagaatggagttgtcgtagatccagagaagattaaagctgtgatggagtggaaggtatcaacatcggtacctgaaataagaagttttctaggacttgctggatattatcggagatttattaaggacttctccactattgcaaaacctattaccaaattacttaggaaggacaagaagtttgaatgtacactagaatgtcagagtagttttcaaagattaaaacataagcttactactacaccagtattactcttgctagacatccaaaaagattttgagatctattgtgatgcttctcgacaaggattaggatgtgtccttatgcaagaaagtaaaatagtggcttatgcatcaagacaattaagacttcttgaagaaaattatccaactcatgacctagagttagctgcagtagtacatgcggttaagatctggtgacaccacttgattggaaatcattgtaagatctacactgatcacaagagtttgaaatatatttttacccagacagatcttaatcttcggcaaagaagatggttagaattaattaaagactataatttggaaattctataccatccaagaaaggccaatgtgatggctgatgccttaagctaaaaagcttattgcaatttacgacaggaaatactgtcaaaacaattacaagcagagttgcttaagttaaatcttgacgctattaattatggagaattaaatactgtcgaaacatgatttcggcaataataaaacggggtagcgcacgagacctagaagtggatgtatgtggagacaaaggatttagacaggttcaggccctctcaatgagaggtaataccctactcctgtttggggattagaatccgccgggtgtgtattgatctgacgatcaggttgtctcatgccccctagagggcctcctgcccaccttatatagggtgggagcaggattacaagatagaaaccttaaccaataaggtaccgatttcctaaatctactttacaatcttatcaaaccaggattttaggtcgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatgttctctcgaactagattactctaaagccgagtgcttcaatcatcttcgccatggtctctcgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgataccaatatatagcatatgcggtgtgaatccctgaataatatgatccaagtgatataccgactgcttggcaaaatatgatgcgtacaacctaaagttgacaacatctttgaaagttcacatagcaaaacaactataaagaagcttgaatgctgtgaataaagaaatttcgaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcaacctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgtagacatattaggcctaggccaaaaaatatgccttcgacaccctttaaaggatgacgcatgtaacatactcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctatcaatgaagatgaaagcacccagcgataaagttggtagccatggcagcgaaataattgacgtgatgaagatgacgatgtcggcgatccagttaatagcagtgtcacaactaatgataatgacgaagacgctcatcagcatttgcatagtaggtcaaccgtgaaggtgaaattataagtcggtgaagacataatcatccattagcaacagcggagatgtcagggccgatgaagcagaggtgctgttgatgatgtcagtgataataattcatcaaattaatgttatagctgttgtagatgcttcacttggaggagagttgatgctgtagtccaactcgtctaaaccgaaatatttgatgttgttgaagtagaatgtctgctccgaagcaaagatgaagataatgactcctggagttgacttgttggttgatgaattgatttcttcagcttgacataaaatttgtcaaattttgagccttgtatttgtgtagcccccgactctttgattagttgggaaacaactgaatatagagtcgagaactgtagcttcttgtcgtcgaatagtcattgcttgattgaagatatgtgttgaagatgtccaagtagaaatccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagcaatgaagatggtaaggccaatcaacactggcagaatcatgcagccatggaagtgcagaaaccagtcggcagccatggcaaacgtaggcagcttgtgttgaagatactgatgcctattagtagtgactgcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggtggcggcgaaggcaagccggtcggtgaagacgtagacgcccaacaacggcggcat

SEQ ID NO: 50900 - DNA, 806 bp, Oryza sativa
aatttcccgcttcatgctaacccaccagtatttctccttcaagtctaagtacatctttgtactgcccgggtgaatgaataaggactttcatgagcttcctgaagtatcagctgtttaagttctctgttatctggaacgcatacccgctttccgttccatagggttccgtgttcatcctccgtgaaaccagcggctttaccctgtttcatattcttgaggagtccatgcatgttcggatcattcttctgagcctcgcggatttgatcgagcaaggtaggcttggcttccaacgcagccaagaatccacgaccaactatgcttaggttcagggcttccatctgttggttaagctcgggcggaatgccacggacgttaagattgttgcaatggctctttcgacttagagcgtcggcaatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcatgattaatgcaaggggggtacaaggagtaataatataggggttaagttttgc

SEQ ID NO: 50901 - DNA, 778 bp, Oryza sativa
acggctggcctattatgccgccgttgttgggcgtatacgtcttcaccgaccggccgcctcgaccgccgccaattggtgcttccgcctgcacggctgacttattatgccgccgttgttgggcgtctacgacttcaccgaccggcttgccttcgccgccgccgactggtgtttccgcctgcacggctggcctttatgccgccgttgttgggcgtctacgtcttcaccgaccggccgcctcgtccgccgccgactggtgtttccgcctgcacggctggcctattatgctgccgttgttgggcgcctatgtcttcaccgaccggcttgccttcgccgccgccgactggtgtttccgcctgcgcggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggctgcctcgaccgccgccgactggtgtttccgcctgcacggctggcctattatgctgccgttgttgggcgtctacgtcttcactgtcacgtcctgataaattcatcccgaattaaaattcattctctaaaaggaataatagaattaattaaaattcgaaaagaaattggcaaacactaaaatacgtacaagaaaaattcaaaagtggcccggagaatttttgtcaaattctccttggtctaaaaggagccctcaaattttagtggaattttcagagcacaa

SEQ ID NO: 50902 - DNA, 1103 bp, Oryza sativa
aacacatcgggatactcccggactataggaatctcttccaaagtcaattggttcagacgtgaccttatagactcagaagataatgcatgaacagttacaactcgaccatcattactggtgagagttacttttctattagcacaatctatcacacctttatatctggctaaccagtccatccctaggatgacatcaaggtctttggattctaacagaataaggttggccaggaaaggtacaccttggatctctattctgacagaggggctacgttgtgaggagagtgcttggttactcggagtactaaccatcaaaggacgtctaagttcctttacctccatcccttgatttcccgcaaaactcatggataaaaatgaatgcatagcaccagaatcaaaaagcacggttgcaggaactgagttaacagggaatgtacccaaaatcacatctggagcaccttgagcttctgcagcagcaacatggttgacacgagccttggctgcgggtgcggaggggttgttctgggcagggacgaccttcacgcggcggggcttcggacacttgtcagcgtaatgtcctgggtctccacagttgaagcacaccccgggcttactgccttgctccctcttggcaggctgttgctgtgttggagatgcaacagggcgtggagcttgattgcggatgttgttgccagcattgttgttgaagaactatcgctgcggacgaacaacagacgaagaacctccctgtggcatggactggggtcccaaagtaaggcgtggcctttgactattcccctgctgtgccttgaaatgagcaatccggcgtttcttctgctccatgcggttgtatttgtcctcctggcgaatagctttatccactaacttctggaaatcatgataatctccagtcataagtgggtaggaaagttcatcattaagtccttttaagaacctctcctgacgctcttcatcagtgcgcacctcttccggagcataacgagccagacgattgaactcgtgcagatactcggtgacagtgcgggaaccttgtgtgagtgacctgaattccttcttcttgagagacaccactcccgagggtat

SEQ ID NO: 50903 - DNA, 2746 bp, Oryza sativa
  unsure (1)..(2746): unsure at all n locations
aaaatttatgctcaagtcatgtttatagtcatgtctgtgtgcgcggatgcacgctgcgtcccttctagttacggtaagatcagatcagtcttcgatacaatatatagacaagtaagcacagggttccgaactataattattagctattggactagtctcaaatagagtaaacaatacagtaatgggttgggggagaatggaagcaaagtacggtcacatggcgctaaccatgtgacacatgggaatgggagacccgtacttttagttcgggtaaacttttacttgtcatttctgttatgaaaaaagatgtacaatggagacacgaatttttacgtgaaaaacccttgcgggaaaaaatcacgggcgccgaccggcaatgatcactatagaggagttgattacaaacgtaggatagacatggagtcctactagaaaattaatctgaatatattatgggtccaaaatttggatcacatatttaacaatttctttatctttttatggcttgcagcttgttgtttggtcgatagactttactctccgtcccaaaatatagtaaccttgtactgtatgtaacacatcctaatataacgaatctagacaggatcttcagaaccaaacccggtactaacaatgtttccccactagttcaaaaatgattttcctaggcaagcaatctaataggttgcagatgggccataagtgtccgcgtatgcaaaaatcggccctcattttcgaatacgactccataatagacccgcacgaaaaaaatcaatgtttccaaatggcccacttaaaacatccgcatgcaaaaataagggtattttcgcaagtgggtctcttaactcacccacacgcgaaaatattcgtccaccccattttttattctaccctctccctatctctgtctctcccacctcacacttcatctcctggcttcactcctctcctctctctcccggccacattcctctcctcttctcccacttggcggcgacaacggcggcggcggttggcgtaggcagcggtgacggaaggggtgggcgacgcctagcgccggcctactgcatgctctcccgtgcatggcgagcccctccagcggtggaggcgcgggatccggcgggcggcggccgtcgccgcacggatccggcggccggctgcttccccccacggcctcaccctcgacggtagtgtgcgtggccactcccctccctctccatctatctcccctcccctccccttccttccctccctgcgtggtcggagggggagcgccggcagagcgcggatgaggcggcacgacctctcccctccctttcctcttgcttccctcctagatccgatggaggggatgggcatcgacagtggtgtggccagaggggaggctggcgtcggcggcgatggggaggcatgggggcggtgggtccggcgacgccctccgcgcgtgcctccgccgacgccctctacccgcgccgcccgtcgacaccctccgccggaaggaaggaaggaaggaagcggaggggagggagccagagggaaacacgagagacagagttgagggaatgagtggtggggagaggataagatggaagaggagaagataagataggaattagttttttttatgtaggcatgattttttgtatgcggaccacataaggttccgcctgcaaaaatcatattttttttaggcggaccacttaagagatccgcctgngaaatannnnnnnnnnnnnnnnnnnnnnnnnnnnnnnnnnnnnnnttcntaagtggtccgcctagaaaaattgattttcgtaggaggatgatgaaaatccaccttggtttacattttcataagcggatattgttagatttaattgggtaattgatccatttaaatcaattaaatcaaataaattccaaggctcattaagctaggaatttatatgtattcattctcttatgggatatcaatgggatgaagagttttgaaaattaatccatttaatcagtgaattggtaacttatatcaatcactcctaattgatgaatggttgatggttgtgtggtgaaggatggttcatggctagttgctagttgatgacaattagctgctctattcctcttcctattccgttggtaacctacatcaattactcataattgatggttggttgatgattgtgtagtggaggatggttgatgggtaattgatgagaattagttactctattcctcttcctattccataactcttactcttcatcttccattcctcctataaaatgagaacggatttgatctctctaaggagaagtgagacacactttcatccatttccaaggctattgctgctacggtaatcccatcccgacgagtgtgtgcacatgctttgggagaataggccttcgaaaccatgcactgctacgacgtttgcatggacgggtgggcgattaggttttcggggagcacaaggcgcaactactcactgttcgtcaacgtctacttcgtcttcaccaacatgtcgaacactggagacaacggcaacactagagacaaggagaaggaggcttctgtcaacaccaacggtgacaatactatctcaaactccagcggagaaccattcttggggtataaccttcttacattatttcaattagaagttttacggttaatattcatcgcaatgtaaacattgcgttattatgtgattgttgatgcttattctacattaagcatgctcatgttgattacatgctactat

SEQ ID NO: 50904 - DNA, 3255 bp, Oryza sativa
taatttctataaaaatcttgcaaaatagtgtctatgttttaaaaggagtaaattgcacccacggttcaacaacttggcaggtgggtgcaatttgatataataacttgaaaaatgaggattctagtgcaacaacttagtaagaaggtgtaatttagtataggaatttataagtgatcgtataaatacaacaacttgcaaggtaggtacgattttgatacaataaaataaattaagaagtgtgacaacttaattatttggagtattttttatataaattcaaatttttaagtacttattttgacaatatactagcgtggatttgtataagcatatttatatttttatcctaataactaataactctaataactaataactaaaagtcaattaaattggatgtagaaattattatatttcggttgatatttgagaaggtaaagaaacaaaaaattcttaaaggtaactgaatgtaaattgtatgtgcaatataattcttaaagattaaattcaatattataaggtaacatccgtaggattactatgtattggcatattgacatcgtgaaaaacctcacctagcatatgtttagccaaattgattcaccaaaatactaaattgtcaagtacttgtactagaacgcacccacttgtcaagttgttgcagtcagacgtttaattctcaagttctttcactatatcgcacccacataccgagttgttgtaccgtgggtgcaatttatagattctctaaccacaatccctccgatctaataattcatccactatttagagagtcatcattctcttcggattcacccgtattgaaaaagaacatcaggccggttaggtgcatgatgcagcgcattatcttcttaatacgacgatatacatattcattgacgggagtaataaggacgttactttacaggtcaagtcaagtaaagcatgaacgttatcgaatcctgatttgcttctgactcatgtgttgtcaccgagccgacgtcagcaaaccgcgtattcagatggaatgcacgcgtcttccagaatctgttcttcaggaatctccgtatttaagttcagaacacatggcgatgttgtgcttgaagcagaactagctagctcgatcttgcacttgtctccgacttccttctcgtttttgtttcattccatagctgaagcaaaatggtatgtgttgttcttgaatatttgttgctgcactcggttgtctttctggttcaaatcaacattttttttggtgatgtatatatacttggtagggtgacaagaaacaagtgaagctaaaggttcggggtgcaagcgagactgaggtcaagaatgtacttcgtcaagaattcaaaggtttaattaccatcttgtattttctgttgtcgaaaaggaacgagcaaaactcagaggtgtagagaggatcagctaaaatttcagtgacatacaaggaatttcctttactaatacctgtgttgttcatccttctttctatgttttttagaatctatcgagtatagaaactacagcaaaaatccagagagcagcagtttgaaggtggaggtgcgagggactgtggatgtggggaagctgtacgaacgcctcaagaagatggcatccagtgtcaagattgaatcggttattccggtatgcatgtactatttgcatcttaattgatcttgtgcaagattgacgggtacatcaattcgttaatatatcttttgggttattgtttgaatctttcatgcatccaggatgatgtaaaggaagaaatagagagatacaagaaagaccttgaaagaatgaagagacagaaggaagatctagacataaaactaagggaaaaaagggaagaaaaaaaggttctccaggccgacaaaacagctgccgaggaagagcagaaaagattgaagagagacaaagaaaatctcaatttaaaggtagacacaaagaggaaagagaacaggcgtctcgaggaggagaacaagaaattgcagcgaaaaattaaggatctcgagcaaaagcacaaggtattaagctaaatccatgctatgatgctatactgcagggtacagaaatttcggaatatccccccatctccccccgggcaagcaaatgtctcatccgaaattttcatttaatttctttcaaaagcaatcaaaatttggtaaaattccaaataatttattgcagaaaaacaacgaagttcctggaattttggtttttacgaaattgcaaaccctcatgctacagacagatgttgtacattttgcctcagtccatccaagcctgcattcgtgctgctgattttcctcttcttttttggtctgcagggagggacatcaattgagtatcacggcgtggaggtgcatcagaagatgaatcatatgcatcaggaggtacacatgcatgaagtcgttcgcaagcttaagatatcggacaacgatcatggaaacgctaatgggagggggcatggacaactcctgcagcagcttggccacggaagaaattgatccgcttataaatattaccaaagctagatatatgtgtgtgctttgtgggtgccaacctattttggtgtatggtttatttgcttgtgtttctcggttgtgagttttttctcttccataacatgtctaataataaaacaataacaagaaagctgcattattaggaaccgttttgttctactgaatgtctgagctgagcctgaaattgtaatgatgtgaaaagggcaatgtaatgtaatggattgatacgtcaaacgttttctcatgttcggctctctcgggtaggattattagacggcatccttaaggtagtgtttggttctgagactaggtgggatgggatgaaaccatccatgattttgaggttgggatgattccacttgcgtgtttggtttatagaataggacgatcccagttttttgtttggttgaagggacgagggagggatgggatggacgccgtttgccaccactgacgacgccgtttgcaacaaccatggccgccgctgcctctgccctcacctctatctccgccaccgagctgcggtcgcgaagggacgcgatgcggcgggtgatggcgtcgaccttcgcgcggagcagccatggctcggcgacgatgatggcggcgaggtccgcacgggagagggagagggacaggctagcgacggacgacgacgacgacgacgccgagagcttcggggacgacgacggacggccgggccgccgccggatccgtcggcgca

SEQ ID NO: 50905 - DNA, 8852 bp, Oryza sativa
  unsure (1)..(8852): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaatgtgattattactaatgttaacaatactatatgaaaacaattttgtgttaaaggaaacataccattaaatatacaatggggttatttcattttggtaaacttaattttttttgtttttcaaaaattcagtaatcctaaattcgtaactgataggaactaataaacatgaactttgtatccatagtggctatccattatgtaattaatttaatactgaaattaataattagcaggttacaaaaataaaatttggaatcaagaaattataaagaaataccacatattcagcatgggaaaaaatatttatgaaaggtattaacaaatttacgccgtgcgttgcacgggttggtggctagtctagctagtgatgtataaaatgagtattttagttaactaatctaaccttagttcataggcttaaggtctttattatcatggttcatattttataaactaggggagctctagtccatgctagcaatttattatatcaacctagaaattattatataagataagtgccttaagttttggtggatgaggatggaactatgcattcactggtctaacaagttttatttgggtttcattatagctagagcgtatttctatatacatttatatatatacatattgctcaatcgatactatgtgattagcacctatcctataaatttaaactttagagctataacctgtacagaaggttccatattttattttactatgttgaagcccactgtttgctggttctatagatatttggttcacttcatttagactaaagatgaattttctacaaattttacaatttaaggttgctctatgatggttattacttacataagtatttagaggcttttatcatacagtaagtatataattttattttataacttggaagtatatgttttggtgattctacagaacttgggtttactcaaaaaggatctaagatgaattttatatgaacttctaaaattcagctcatctaaaactagtcatttaaaggtaatagttttagaggcatttgatgtatagtatgtatactatttcattttgctttataggagaacataagttggtggatctgtagaaactgagtttgctccaaaatgagttgagatgtactttatatgcattttataagtttgtgtatgctttatgtatgatttatcttagacccattttagagacaaggtctgtgctgagggtgccaagcttaatgttaccacattaaagttcatagttttgtgaacctacagaaatttgaatcatctcaaaataagttatatttgattttatatggattttacaagtttaggtgttttgctgttaaaaagtaaaggcttttagtattatcttttacattttcagattttaaactcatggggtccacctgtcggtctcaggccaatatgcgaaaaggcccctaggatttcaggaaatcaaaccgcagtcctatgactgttctgtgtgtcttgagcttttgcagaaaggaccctatattaatctaaattctcgtgaggaggtccctcgttcgagctgaagcagatcaagccatggctgagctcgatctcaagcttgccagcggcaaacggtggctcgtttgagggtgcgaccaaaagacaaaatgaagatcatgctattccgattccattcctctacttttctcggtcagtggacatcggagtgacgccggcggcgagtccgagcggcggctgtgcttaggctgctactgcatgttgagttggtgctcgattctaagtgaatgaaatgcatgaatgcaatcctatgggctcaagggtgctcaccgaaccttgaacgaggcgcgggaaagtctggacagcggcagcggtgaagaagatggtccggcgatggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtgaagaagacggtagccgatctccgcacttgctgcgccattgcctaggatttttgagggtttttgaggaagacttcaaggagaagacgttggcgcgacggctcggcttggtttggtctacagtggtcggaacgacgacgatgtcggctgcggcggcgcttggagcgcgctccggagtgccgggggcacgacggcgttcccgtcgatccgctgcacgatagaggatgaaattaaaaggataaatcctcggcatggtgaggagagtagagtacaatagtcgtcttcttcgcggccggcggcaaggatgagggcgacggagaagttgagagcctcctccctcggtttcttcggcttagaggtggagaatgatgtgtggagatgcagctgggaggaggagaaggctagaataggagtttgatggcgtcgacacgttgtggctacgcgtcgtacacagccggcaccaatctctctctctcggctgtctctggtcggctggaagatttgcacagggtgaggacgagccagagtggctgccaagtgggtccaggtcgtggcaaactaagctagggtgagagggttgggcagaaacgtgggtgaagaaaacgtttgaatgattttcaggattatttctctctcccactttagtaattcaattatttaatttgtgggtagaataatttagtgtggatttttctgaaggtatatgaagatacctagattccgtattctttagttgcactcaaaaattatggatagattactcacagaaattagaggaatatgggttctttggaaaatatttcgaatttttaggagacctaaacagagaagataaattctggaaaaattatttttattcatgataaattacctagtattttaataaattattttacttatacacttttatgcagttaaatgcaattttagacaaagtatggttttagccgattaagaactacaggtaatctagtttttattagtttgactgatttatttgaggtaccaaatttagttattaaattataccaaaattacagtgagttgtatgtgttgagtagagcctacatgaattttctcatgattttatcttgcacgaattattttagataattcgcaagacttatgtcttatatgtgtttccctttcctaaatgcatgtaaatgtttataaaagttatatttggactcttattaacctgaggtgatattgatatgttagaattacaatttaccttacacatgtcataagctccttacctatttatgcataaatttactttagcattaaattaagagaatgcttatagagatgattaagatagaatataccctatatgatataatttatttgttcactttcatgttcatgacatgtcttcagatggatgtccaaattagttttgtgaggcttgacattagccatgttgatatatttcaaggtgtatggtttctatttttgtgaaatcattatcatgattaatatttgtgatgaacaattggctatgcaaatgatttagttaaagaattggtttgagagtttgtgtgaatgttggtgtgagtacgtgtgactaatgtgggtcaggttgtgatatctgtgtccagaaacggttgttttgtctgattgtgtgcaggtgacttgagatcagccttggtcaatggtgaggaccgggactatgttcagggaggaacagaggtctattgcggtcgggataccacgtgagaaggtgactagagtctggattcttgaaggtcaacttcggtcaacggtggggatcgggacgagactcagggaggagttgaggtccagacggtcaaggataccgggtgacgaagttggatacgaaatggcatacggtggatggacaccgtgtgggagagatcttcgcaacgggcttcacgaggtgtgcgtgcaagcgtcggtgttcgcgaagggaattggaagaggtttatgtatggtgctacagtacggtggtgtactgtagcgtgcatatgtgtatgcgtgcttgtgtacagcatgcatatatgtgtggtatacgtgcaggtatgcatgcatgtacggtgctgtacatgtatgtgtgtgatcgatacatgcatgtgaagcatgtatgtgtgcatgattggttggccgagcagcaggagagcggctcggtggctgtggcttgttggagccggcccaggccgtgcggcgcgaggagaccgagtgcgagctggcgaaggatcggtaaaggaatccgatccggagcaggattttccatggccggtgcggctgtggtttcggagaaaaaggaaattgagagattgagtcctactgtgaagaggagtcctacgtctactttgattaggagggtttttcatgtataaatagagggggagcgtgaggattcctggtatcgcttttcggtatcgcttttcagagcgtggagttgatagtttagttagggtttcgagtttagtcgagatttttgtaaggagtgctgttgttgcactttgtaaacacagagataagcaataaagttgtcatctactttgagagttcttcgatttgtgtttcatcgggttcggcggtctaccagtgacataccaacggttcaacaggcgacaagacagcggttcgaccggcggcgtgcaagcggttcgactggcggcgtgcgagcggtccgaccggcggcggcgacaggattacgtcgagatttccatcgatttgagggtaacttttatttccgttaaaggtttttgggttttttgttttccctaccattcacccccctcttgtaggcttggtttcttgtgttcgatcctaaaagtggtatcagagccttgttttcttctttggattttaaccgatctagagtttttgccatggctactcccgctaggttttcaactaagcctcatgttttcgatggaacggatttttctcattggtatagtaggatgcaatcttacattatggctgaagattatgatatttggagaaaagtttctcatgcttatgtgattcctgaaactattaatactgctgctgaaaaaactgcttttgaacaaaattgcaaagctcgcaaaattcttttgagtggtatttctcgttctgattatgatcatgttgctcatcttcaaactgctcatgagatttggattgctttgagtaattttcatcagggaacaaataacattaaagaacttcatcgtgatcttttcaaaatatattaaatttgagatgaaacctgaagaagctttggatgattatctttctcggtttaataaaatttttagtgatcttagatctgttgattcttcttatgatgcaaattatccacaatctgagatttctcgtcactttttgaatggtctcgatatgtctatttgggagatgaaagttacatctattcaggagtctgtgaacatgtcttctttgactttggattcgctttacacaaaactgaaaactcatgagatgaatattctttctcgtaaaggtgattctaagtctagtgctttggtttcgtcttcaacttttttggatgttggtgcttcttcatcgaagccttctgttcttgctttatttaatgccatatccgatgatcaactcgaacagttcgaggaggaggatttggttttgctatctaacagattttctcgagctatgaaaaatgttaggaacaggaaaagaggagaactgaatcgttgttttgagtgtggagcacttgatcatcttcgttcgcattgtcctaagcttgggagaggaaagaaggaagatgatggaagagtcaaagaggatgacgtgaacaagaagaagaacatgaaggagaaggagaagaagaagcattgtatgcagtggttagttcaggaactcataaaagttattgatggatctgaagatgaagatgagggcaaaggtaagcaagttgttgatctagcttttattgctcgtaatgcaagttctgatgttgatgaatctgatgatgataatgaagaaaagcttagttatgatcaattagaatatgctgcttataagtttgctaagaaacttcaaacatgttctattgagcttgatgagaaggatcacactattgatattctaaatgctgaaattgctagattaaaatctttgattcataatgatgataattgtcaatcttgtgaagttttattttctgaaattaatgctttgcgagatgtcaattctgttaattgcaagaaattggaatttgagattgaaaaatctaaaaagttggagtcttcttttgctcttggatttgctttacatgctcgtgttgttgatgagttgattttgacaaagaatgttttgaaaaaatacaaagttgctttttgtgcaagttctttagtcaatgcttcatgtgtaaataaggcaacacaaaacaatggtgttttgatttctcaagattgttcaaagtgtgttttgaatgagttgaagttgaaagatgctttagagcgtgttaaacacatggaagaaattgttaaacaagatgaggtgttttcttgttcaacttgtagaaaataaaaagatcttttggatgcttgcaaaaattgtgctattcttactcaggaggtttcttatttgaaaagttctttgcaaagattttccgatggtaaaaagactctcaacatgattcttgatcaatctaaaattagcacacacaatcgtggtttaggttttgattcttatgctcatcatactagacatcctcctactgttttgggtgcttctaggagaggtgaaattttgattgaaactgagcctaagaacactgtgtttaaatctgttggcatcatgtcttctttgaatgcatcttcttcgaaatcaaatggtgtgaatgcaaaaccttctgttgatgcaaaaccatcaatttcaaaatcatctacttcacaaacttgtcgtgagaagtatacttgctctttttgtgaaaaagatggacatttggttggtttttgtttttgacttgcccgcaaacagaaaaaggaaagagaaattgcttttgcgaaacaacggtggcaaaaatcgggtttttgttcaaggagcacggttagaccgcagctaaaccggctgccaggcccggttagaccgcagggacagcggcggtcagaccggccccggggcaattttgcacgtaattcaaatcggacttttgtgaagcgacaaggtaagttttcaggtaagtctggttctgattttgttagtgcatatagtgcatatgtacctactggttctagtggtcgtgtgactcagtgttggattccaaaatttcttatttctaaccccaacacggaggcctcgacatcttcgttcgtaggtattttggtggcatactccccatgtgcattcaacgttgagattgcttttcatggtaacatcaatttacttttggattgacatattttttggttctactctctcgattattagcttttcatatgctagtgtttgaggtagtagtttttcttaatacaagtggatatatgtcgattcatgataaccttggtgatatcattggcaattggatgtctttctcgaaatctttaatttcttcttgatttttcttcggggagaattggaggttaatttgagggggagtttgtgctttttcatgcattcatgtttatttttatgcatttgctctaattctgaaaattaataaaaataagaaaaagaagagctttgttttatacctctagtatattcttgtgcatgctagcaaaataattgaggtctatttgttgctatgttagcttgtatgcattttaatctttatatgaagcttagatattgcttttaagtgagatgatgcatgacactaaatcttttacttgaattacgaaaatatgcaatattgatgctagcatatggtttgatttataaatgctttatatatatgcattattgaattgttattactcaaatagctttaaatgctcattgtgaaaagagaataaaaaatatgaaaacaatgaataccgaatccttggaaacagtcttgacgacaaggacgtattcgatgtgagcaaaataatgggtgccgaatccctggaaacagtcttgacgacagggacgtacccggaataaaagagaaaattatgagcaaaaaggctcaagaaaaagtaaaaattctcttggttgctttgtgctaaagctaatttgagaaagagtgataaatgcaataggtatatatgtatagtgtttatttttcaatctatgtgcttgtgaatatattgcattataaatcatttgaaatcatgaatcattattgctgatttaagcttaattgtaatatctttgattcatgtttatactatggtgcatgcttactaactagttgatgaatttatctcccatatctccaaaacatgatcttgaattgcttttggtacatttcaaagctctcgaaaaaaaagagaaaatataaaataaaaaatggttattccaagtggcaatcatgacataactgcatttgtg

SEQ ID NO: 50906 - DNA, 3108 bp, Oryza sativa
tgttgttgcactttgtaaacacagagagaagtaataaagttgtcatctactttgagagttcttcgatttgtgtttcatcgggttcggcggtctaccagtgacataccaacggttcaacaggcgacaagacagcggttcgaccggcggcgtgcaagcggttcgactggcggcgtgcgagcggtccgaccggcggcggcgacaggattacgtcgagatttccatcgattcgagggtaacttttatttccgttaaaagtttttgggtttttggttttccctaccattcaccccccctcttgtaggcttggtttcttgtgttcgatcctacaattttaacttcctctagctaacactaggccctaatggtttagttgtttatctagatcttagttaatattcatgagacctattatgaaatgcaaataaaaaattcaaatgcacatgatggacaagtcaaaacatgttttatgcaagtatgcatgcttttactcgtgtttgcatttatgtcctaggttataaatgaaaaagttttaatttattctcaaattgtacttaggttcaagttagattgaccacacttaggttaaaaatggaaatttttagctctcaaaaatggaaaagttagcttccaactattttgataggaaatttttaaggtctagaatttgggtatgttacagtgttacccttgagcgttcgctcggagatctatttgtatctaacaatctgttatgagtattgatttcaagaaagtcatatttcagggctttgtcgcagattctacaattactcgattactcgagaacgattggacgactactcaattactcgagaacgattggtggagttcgacgaaaattatggaatgaagagatggtgaacctaccgagatgaaaattcttgacttcaacccaaattctcgattacggcaggtcagtaaacttagtcgtatactccgcaccttctcgctcgtccgagaatggtcaagcgagaacaacattgttattccaaggtctttggtcgagaacatcaactcgttcgtttacgttgatttcatgcttgtttatggcagttatttagactttaattcaaattcacttgtagaacgttgatcttttttcgatgatgttgagtactccatgtcttctcgaatgttatcaagaatgaccaagtgagcatgaaatgttggtagggaatgtcttctcgaatggtagacttttcacgcgatattaattaattataaccctcttgaaaccacaatttagagggtacacaggttagttaagtctagagaataaatgagaaccctgcaaagtaattaactacaaccatctacaggccgatggatcacacagatacacaaaggagagatcaaacagtatatccatctgagactctgtagttatctctcagttcagtagggagagagacatgcatgaatgcctatactgcgtcgtagctagctggtttcttttctgttttgatgcgaagtatgcgagcatgttcagcaaggatccacacaacggtcgtgagctcaccaccacgggcaagctgcttggcatgagaatcccttgtacatcggatggacacgttaatcagctgacgtgcccactccccgatgatggcatccgtcgtcattgcgattgatggaaaagagacattcttagcgaattccatcaaatccggaaactgccggtgaaatttctttagtattgggggctcgccgtcgccgtgttctccaactttttcaatgatattctttctaaaattaggacctcttatcctaggtagcagaaacatggctagtatagctccctctgatagaacattactcgtgtcgtaaagaacactcagaaagccgctttggggcctcgaatcgtccacctggaagtaatttccctcctcatcttcgttggcaatcaggatctcggcaagacgtttctctctcatcattgagctagtacgcaaggaaggatcactaccttctttctccttccatattccggcaagagcctcactgacagcttcatatcggctactgaggacgaggcccggtagcatcccgggccgcaccgcgacgaggaacatcatgtaatctgacaacgccttgatcacctccacatcctttttggacttgggcgatgcttcaatttctgattccgctgagaagaggaatatgtccgtggcgatgtgcaagataagaatggtctcttgtaaatcaggagtgaacttcagggcaaggtctgcttcctgatgagcatgtgtaaatggaggagccgccggtgcaggcctccaggcctccgtcactattatttgtcgtggtggtcgtcgttgtgggaagggtttcttcaagacttgccagatagagttgaacaactcgtccctgaaatctcttgaatcaatatgattgcccctcatgcgctggtattcgtactccatccagttctcctccggtgctaaccgcttgaacatgccgctcttccagttcttggtccttgcctcgctctcgtagcgagtgcactcgtgcaacaagttgtactgtccaatggtttgtgaccacatcctgtatctagttggcttcttattattgtcaaggatccgaaacagattcagatcagacacgatgaggcgacggatcagtcgccatttccctgagcacagaagtgcatgatgaagccacgatcgtggcctctcatcaaggaacgagtagaaccatgtcgacgccaccgctcggagaagccatttgatgtccaggacgaccatgccggccagcaggacataggtgatcacgacgtcggccgtcgcctgaccttccttgctgtggagccaaaacagcacgaatgccgccgtcgcggcgatcggagaggcgaaacggaggatgtagcctttccatgagtgcaccacggccgccttggtgtagatgaggtcgtacatgagggagagctccatgttgaccaccctgtacagcttctcatcccatgtagcagagagtgcttcttgttcatccgcattattttggtccagaaaatcgatgaaggcgtccttggtgatgtctagcatgtcatgagcagccagaaggatttgctcatcattcggctccctgcctcca

SEQ ID NO: 50907 - DNA, 1169 bp, Oryza sativa
caccacatgagcatcactagttcgagcccagctcagcggatgcttcaaagacaaaaaaaaaaaaagcaacggcgttatctattaaaaaacggaggtagtacttgaaagatatgttagttttagtctcagaaaaacttaaccaatttggataagattttctagtttccacatgaccattgatatccatcttatctacacagtactacatgactacatgtgagacttcttttgtgtggtttatatgagatttttgttagattgagtttccacggttccaccgtatatttggcctagttaagtaggaagaaagtttaacgtagacaaactagatgaattacaagcagcacgacaacgagacgtaccaggcgatggttgaagtcgacggcgttactgttgccactgatggactatacgcgcgtacacctgaccgatatatatctctatcaagtttggaatctacaaatgctagaacaacagcaaacaagatatacattggtgccttggtgggtttaacaatgcttgtacccacccaggatttataagatctggccatttcattagtatatatgttactattatattgcatgtgctttgcatttcattagccaaatgtgctaccatgccaaaagtgcatcatgatcaaccatttttaatagtttactctatttctatgcaaggatgtactaggtatacaattgcttgtgctagccacgtaatacaaacaaactaaagggattaaaggtgacgcactgatatataattttttgtacagctactacctctgagcaccacatgagcatcactagttcgagcccagctcagcggatgcttcaaagacaaaaaaaaaaaaagcaacggcgttatctattaaaaaacggaggtattacttgaaagatatgttagttttagtctcagaaaaacttaaccaatttggataagattttctagtttccacacgaccattgatatccatcttatctacacagtctacatgactacatgtgggacttcttttgtgtggtttatatgagatttttgttagattgagtttccacggttccaccgtatatttggctagttaagtaggaagaaagtttaacgcagacaaactagatgaattacaagcagcacgacaacgagacgtagcaggcgatggttgaagtcgacgg

SEQ ID NO: 50908 - DNA, 1625 bp, Oryza sativa
ataccagccgatgccgatagggttttgagcaatcgattatatatccaatgtggataatgatataaagacaatcgactgatgataatgtaataaaacaataatatgatctagttgaaaccaatcaactaacaataatatgataaaataagtgatctgatggttaaagtatacatcagcgggaggtctattgtcatagaatacacaagattagataattaatgaagcatttgttgcaattggctaaaaccaacttgtattcaatttttataagccgattcaacgtccaaataactcatcagctgaaatcccgatgaaacccttattataatcaaagacaggttagcctttatgatttaagcacgactaaggatgatgcatcacaaagtatgctaagaagcaaaaagtctaaaaatcaagtcttcgacaaattttcaggatggtggataccttagctaatctaatcagataatttagctgatactagcataaaccctaaaatgaatatcagccgatatgatcaaattaaggtgctaagctatattaactaagatatatgacaaataggtaggcaaatatataaaccgaaccagagcgatccaagagattgaagcgatgcagctttgaagcacaccaatgtaaccgatacaattgccaatgccggcggtacgtaggacttaccccttcgccggagatcgaaagtcaatgcagccccgtgttaggtgccatgttctgccggatgataaataaaacctcgggaaagagggtggcgatacaccaagagtaattgtatagatctctgtgatagtttacaatgacctcgggtgtacatatttatacccatggatagatactagtccttattggacaagaaagaaactttcataatcataaaaggaaaatataaaatccttatcggacactaaacacacttttctagagagataaaaggaaactaacaaactcttcctaattaatagataaactgccaagccacatcctccttgaactcagtcacttctgaataaacttcctttaatagtttaatttccttaaccaaatctactaaggatccgattattggtgacttgataattctcatcagccgattcgaagatgttgaagccaatattgattctaagctgatgatgacttcggagcttacaaaattttggcgttaacaccgcggcaacatcacagaggagcaggagcagctcaaggagcagcggcggctagggggcgaggacaatgacaatgccatggcataggaggcatggttgacgttgacaggcgctagcactcctcccgctccctcacttgacgaggtggaaggctgtgacatcctggcgcaattaggatgaggcccgtgtggcccatgtgagctgtgtgcgcaagtttcgtaccaccttgctagcactggtggaaccaacttataaggcatcttccctccaaccatgtcacttccgagttaacccttttatacgaagcgaggatgaaattgtaagtggagaggtatctgtaagtgggccagcccgtcggatagactggctacacggttctggagggagggctgttacaaatggtatcagagccgaccctcgcggttgcatgtacgggtcagtgtgtgc

SEQ ID NO: 50909 - DNA, 2389 bp, Oryza sativa
tcagctcaattcgagcccagcgatgcttcaaagacaaaaaaaaaacaaaaaatctaacaaaaaagagactagtacaaataagaggaacaagttcatacataagagaatcaaacattcacatcagagaatcaacaagtttgaggaggaggaggagccccagacggtccaccgtggcaacgtcatagaggagcaggagcagctcaatgagcagcggcggcatgggggcgaggacggcgatggcgccgtggcgcaggagacgtggttgacgttgaccgacgccagcattcctcccgctcccctacccgatgaggtcgacggcgccgcagggtgcccctgcgtcggaccaaccttgtcggtgccacgcttctccttccaagagcacggcggcagtggtagagaagcgaggatggcaatgtctccgtggtgcgggaggcgtgattgacagtgacaagcgccggcactccccccgctcccccacccaatgaggatgatgacgtcacgaggtgcccctacgctggctcggccccatcagtgccgcgctaccccttctgactccgttagccctgaaggcagaggggaggtggtggcatggtgagtcacggctggttatttggggaggagacaagatgagaagggaggagaggtaagggaggtggtggcttggggaagaggaaggaaagggagaggagcacgaattggatgagaaaggataagaaggaagcataaagagaataagaaggaagcgaagagaccgaggagataaggatgagaggacgggagataggtgttggttgtattgaaaaccgacacttctacctcgtatgaaagtgccattttttaataggaatcgacacctatttgaatagcaatgtcctagcttttgccgctggcacccccgcgggagcccgtgtgggtgagaaaagcattataaatgtcagttttagctattctaacacctatatatagtgttgtctcctttttttagcagtgaacatttgcttcggtgcatatcaatagccggaggcgaagaagtggtgaaggaaatccaccaaggattgtgtggagcccatcaggcagcaaggaccgtagcatccgaagagtttcggcaagtgtatattggtcaaccgtactcaaagtatgcattgaccagatcaaaaggtgcgaaagctgtcagcgacatggctgaagccagtcagcccctcagtatgaattatggcccattgcacctgtctagtcgtttgcaaggtgggggcatgacatcattggcccgttccctatggcgcgaaatggctaccggttcgccattgttgctattgagtacttctctcggtggttagaagctgaaccactccatactatcacttcggcagcagtccagaaattcttgcgaaaaaccattgtctgtcggtttagtgtgctgaaagagttcatcaccgacaatggcaagtagttcaactctaatgaattcagagagatgtgcgaggggctaaatttggagatcaggttcgcctcggttgtgttggtatttcttacgatcacagatgaaatccacaagcgcatagatataccgctgtagcacttcccctatagagtattccaagtttggtcagatctttctccggttcatcctaacacgatacttcaggcactggcaaccacactaaagcaaccactataaataaatggactatagtgaacaatgatcccgtatgctatttaggaactaaccaagagataactctcactagacaaatctaaattactaaggaagaatattatattgaattcagagtaataaacagaataacagaaatgagagaagattaacgacaactccagaattcttccgacttcttctactctactctcttcctattctagtatacaatatagtacaacagagcctcttataattcatctcaagcttggaagtgtgcattgaagtgagtaaagtgaggtctttatatagaggtaggtatgacggttagcgaagaggaaatgtccgaactaccccgcaaccgccatcaaggagtgatctggagcgtccacgccaaaacctgggatcaacagtgggggttcggccgaacctgggctgggcccccctagcctggcctttggcctggctcctatcctggtcctcccctatccaatcctcagtgttttaggctgattttctagtattttgatgaagttcacaacccatccttgtatggatacatatttgtcctcactttagtctagatttcctcccaacctcagtgtttatcacctgcatacaaatatacaccaacacttgtagaatatgtgagattaagcacctatcactatgttggatgttttattatctgaaatttatgcagatgttggcagtatagaattggtatttaac

SEQ ID NO: 50910 - DNA, 1734 bp, Oryza sativa
atttttatgaattttcgcaaaccagctcttttcctcatattgactttctctcttatttctcaaggatgaatattttatttttggatcctcaccaagacaaaatgtgctagaatttatccctactctaaggctgatatgggagttccgtagggacaaactgtgacatacctgcatcatatatattgcaaagccaaaaatacggactcaagaagatcatcagccatactcctagatcaagggtctttatttgtggtagaaaatagaaaagtaaaatattttgtggaatagtggaataaagaaatgattctccttttttcatgtactttctctccattttgttttcttggcatgaatatggaaggggcatggctatattttcttttcatcatgctcaatgttttgagagcaagctttatttcctcttttttttttcttttccatagccatgcctttccctccttttctcatttttttttgctaagacctttttttttcttctaacagaagaaagcatagtctaatgtaggagtttatttgaatggaattttagtgggaagccaacttccagtgtaaaatcttagcttaattatatatgtggaaatggaaatgaccccttgatcatgagagtatgaaagatatctagcacgagtcacacaaatttgttaaagcttaacataatgtcaagcagtcatacgcataataaggtttatcaaagatatacttgcatacgaccttggtaggaataaagaatgaagtcaattggaggaatgagcttttaaaacaattttattttgaaaacaaattcccaagagtcataacaaaagttgcaagaattcctttcatctttaatcatctctcatatagcaaatacttagatgtataagggtccctaaacatggatggttgttcataagcacaggttcagctgagaataaagaatatacaagatcaaccatatgaaaaatttcattagttggaaattttatcttatacttatgcttgaaccaattgtttcctgaattttcaactctagtactataccatggtggagatatacaaataatggacgtgctcgcctgcttacctgtgaaaattgagaaggattggggccagctttggttcggccgaaccactctggcgcctgatccctcagcaactttctgcagtgtatagtgcttccaggtgttcagacctttcatcagttttcagagtatgtgcacgtcagaagctgggatatctcccccacacttattcaacacctgaactttattaaacctaaaacaaaaaaaaaaactttggcaaacattggggttaacaccaatgagccacattatttatagcaagtgcttacatgattggaaaaaaaaaactaagcacctactactttattcatgggagaggagacatctattttgcataatctctattctccttacccatttctacaaatggatgcttgattttagcgcacaaaccgcgactaagggtatcaacattattcctaagctcagcgagttctacccgtagctccgcgttgcggtccctaaactcaatattctccttgtggagcttcttcacttatgatgctagcttatgaaccgagggctccggcgactttacttcttcctcttgaaattggccggccccccttacaattggaggggggcgtcaaatgacgcttcaccttcataagtggagggctacgggattccgctgccccctccttctccgatg

SEQ ID NO: 50911 - DNA, 3611 bp, Oryza sativa
cttttgcaaaggagaaagaaggagaagaactagctcaggggcgtgatccgatcgttctatctctaaactcgcatctaaacagatcaagcagtagcggggagactgccattcaaaattgggactgatcgggcgccgccttggttcggctgaaccctggcgggtccggctggccgccaattttttcctaggcccactaattcctaagctaagcacaaaaatgacaactttgcatggtttttagcatggaatagatgagaccattatggctcataatcgattaattcaataacatccacttcttcatctaaagtttcatttggcacaaggaaaatttttaagcgttgaccgtttaccttgaatatattacctgaatcatcacggagtgtgattgccccatgtgaagaggtgtcgatgacgtcgaacggtccttcccatttgctgcgcaattttccgtggccgaaaagcataaccctggaattgaacatcagtactttgtctcctggcttgaatttcttaatgtttatccttttatcatgccagcgcttcgtcctttctttatatatctttgcgttgtggtaagccttctctctccattcttcaagttcagcaattttcatttttcttcattctcctgctccttcaaagttcatgttctagtttctgatggcccaatatgctctgtgctcgagctctacgggtagtcgacatgacttcccacagtgcgtctagcaatctatcctttcaccatgttcccattttgttgaccgtcttctgcacaatattcttcatttgtttgtttgatgtttctgcttgaccgctggtctgtggatagtaaggagtggccacattgtgtttggctcccatgtcttgtaggaggtctcggaaggttttgtcgatgaagtgagaacctccgtcacttatgaccatcctaggggtaccaaatcttgggaggatgatttctatgaacatcttcttggcatgcttcgcatccgcggtgctgcatggcatagcctcaacccacttggagacatagtcgactgccactagaatatactcgcagttgcgggacttagggaaaggtcccataaagtctataccccaaacatcgaatatctcgacttgcaagttgtatgtgaggggcattgcatcacgagcagtaattcctccttgcctctgccagcttgtgcatcttctaacgaatgcttttgaatcttcatacattgtcggccagaagaaaccacttttccaaatcctgacccgggcgcggaatgcatacaaggaacaatcacaagagctcgtgcctgttcacttcattatcaggcagtttcgttcttaaggttacaatatcaggatttcttgaaaggagtacaactaaataaatcctgtgataattcacgcgggaaagattgcttgtgataatattattgtgcttaagaacgaaggagaaaaaacgaaggagatgcacatagtaaaaaatgattatacactacagaaggtcccaatttggcctgccacattgacccaagttgaaaaggatgcccattgattcaaggcttcgtttggtgacatgcaatggtatatacgatttagcctcaaaaataaaattaatctagcggaccgcacttgcaaaaagagtgcctacttttttctgtaaacgagtactacgatcaaacctgcatacatgccatattgactacacgatactatttcttgcgcttattctcgtgattctcctgtggccatctccagttatgtatcaataagacagtcttttcccctaaacaaaaggacaaaccatgttcatctatgaggagattgatcattctcttgattggtgaacaacggacaatattattatcatttctttagtattacaggcttgataagccgatcaagcaattggtttgcaatttgcctcacaggcttgcaagctagggtagcatacatttctacagcagaccttcgatggggagaaaatgttgcctggtacgggtaccaaaccatttatattgacattgttgcgtccttcattcatggatgcactcctggtgtaatccagatttttacctgaaaaataaaaaatattttactaggaaagcatgaaagatacagaaaaaccatatgcaatacatggatatgtgaagatggatgtccagaagaaaattggaatcacaaattttactctgaaagatatgtttctttaatacatcgtgattaccacagaagaattgaataattgtgaaatcaaaataaaccttggattcaccattgagattcaatattagatagtagattaccatacacgtggccaggaatgctaaaacagcctagaagggccaacaacagaagcagaagtccacggctacagttcggcatctgcttgcccatttgtgtgattgctttgtatgaagctgtggcttgtgcttcttctttgttttacgatggttatatagacagcacaactgaaataaataggcaaaagtaatccaatgattaatagtatccaaatataaggcttatcctaaacatatgtacagttttgttatatattattgaaatgaagtatggtggatagtcttatctaatcttaccatttgcagtttactcatattgctaaacatggacggtggcctatgtaacgtctactagacactcattgtgatagctaaatatttattaatgtgtttattctgcacaatctatgcgaagttattccctcgtgtaagaaatataagatcttttgcacgatgatacggtctgacatattaaattttaccactaatattctttccagtatactcggtgaaaagtcactagaattacaacactataaaaagatgattgtaaaagtagttaaacatattttaccgttcctataatctctacctcccaatgaaaattttaaaaacatttacgtgttgtttggtgataaatctgttttatgatcaaagcaaatttctttgtattatataatcccttattttccatatgttacctgttaatcagtggcgggcccagctttttaaacttgggtattcgaaatgggaaggggtaaaaaaatatccatacaccaaaaagccaaaaaatgggcttgtatattatgatacactaataattataatttagagcgtatagaacataaaattgatcattagttcacacagtgatagaattgatcatcactagaaattgtttaacttatagaaatactaataccaaacatatcaaagtgtcaaaatatggaatacaaaaatgatagaaaataataagttaggaagaaaacttacaatttagatattaacttttcgacgcttgatattttggaaataattgatgatgtccttgtccttagcttgcaaaaagaattctctttcaatgaatgtaaccaaacaatcattcaaatactacaaatttgctaatatggtatgaactatgaactactgcccagtgtccaatatactcaattactcaaatactcaaataggcaactagtcaactacaatcctacaaactaaatgtctaaatcaagcaagcaagcaagcaagcaactacactaaaatactaaatgtctaaatcaatgaatttttgtgcttgtcccgttgtccggagtt

SEQ ID NO: 50912 - DNA, 1302 bp, Oryza sativa
gctgacggcctggagcagcctcctgcctggctgcctcctgggcccctgcaggctgccgcgccggctgccgcacgcggcacgccgtcgcccgtcggtcacggtgcgcctgccggtcacgggcttggcgccttggccttggcggctcaccgcctcaccggtcgccgtcgccgccgccgcgccgcacgctgctgcacgccacggccgcgccgcacgccgccacggctcccgccgccggcagccgcacgctgcacgcagcccccgccgaccgccgcacgtcacgccgccgcacgcctcctcccgtcgccgtgctgtactgctgtgttgtggtctagggtttgcaggtttgggtggccaaggcgccaggcgggtggggaattgggggaaaattgcaaatgggctgatatgtggcccaattagaccacaggttgagaggaaagagggaggcgagtggaaaatttaggcccaatagagaagaaatggggaaacaaggcccaatatagcagtttaagctttctttttatttttttaatacctatatgaactatatagtatatatacctattttttttttccaaaaatcttgggtatacatctgaatacccatgaatacatagtgggcccgcccctgcctgttatggatttctcgtaaaaaatacttatggatgttgatatatttttgggaatagataatgaacataggattggtggataatcgtttcagatgtatttgttggtctatttttgtaaagtatccttaacggttaaagcggcaaacattgtatgctgaactactgggttgttggaggtggagctagacatcctatgaaattttaccaactggagcagatggtatgacccgagaggtgccatgtttgatcggggggagggggtgcgactacaactttaggtgagcatgattccatgcataactcttgacaaaggacaagaatcacttgtacaaccaaacttgaattatggttgcatgatcagatgcaattgtccgaggtatacgatgtgaaccacaaggtataccagaaaaaaaaggtagagggaagatctcaagctagcaaagatgtaaagtcaacaatgttgtcacgtcctgataaattcatcccgaaataaaaatcattctctaaaagaaaataatagaattaattaaaattcgaaaagaaattggcaaaccttaaaaagcgtacagaaaaaattcgaatgtggccaggagaatttttgttaaattctcattggtctaaaaggagccctcaaatttttcttgaattttcagagcaccggaaatatttatta

SEQ ID NO: 50913 - DNA, 5139 bp, Oryza sativa
caggatcttaaggaaagattttggtgggcaagtatgaagcgtgaaatcgcagaatatgtagcagtatgtgatgtttgtcagcgagtcaaagcagaacatcagaaacccgcaggtttgctgcagcctttgaagataccagaatggaagtgggaggaaatcggtatggattttatcactggactatccagaacgtcgtcaggtcatgactctatttgggtgatagtcgacagactaaccaaagtggctcatttcattctggtgaggaccacttattctgggagtcgtttggaggaattgtacatggcaaggattgtgtgtttgcatggcgtccctaagaagatcgtatctaatcgaggaagccagtttacttcaaagttttggaagaaacttcaagaagagatgggttccaagttgaatttcagtactgcataacatccgcagacagatggacagaccgaaagggtaaatcagatactggaagacatgttgagagcttgtgctttagatttcggtggaagttgggataagaatttgccttacgcggaattctcgtacaacaacagttatcaagctagtcttcagatggctccgtacgaagcactgtatggtcggaaatgccgcactccacttttgtgggatcagacaggagatcgtcaggttttcgggactgatatcctgagggaagcggatcggactcgtcgtcttcctctggctggccgccgcccgaaaccctagcgccgcgccgccgccgtctccttccaaatttggccgcgcctttccgtttccggtgaaatcaatagaggggaaatgatcttcgggatcccctctaccttttctcttttggaatcatcatctatttcggtttggaaatccgtggattcgatctcgaatcggattcgtctctctccccgaaccctaaccattccatcgccgtcgccagccgccgtgggccttcgccgccgcctttcaacccctttaaaagcacccccaggtcctcctctacccgccgccaccctcgccttcgcctctcgtcgtccgtagcgccctagcaccgtgtagctcgcgccgccgtcgtcgccgccgctccagccgtgcgccgccgtcgcttcagtcgtcgccgtcgctcggggaggtcgccatcgtggtcgccaagtcgtcgccgtcctcgtccacccctccgtcgtcgccgtaggtcaccgtagcaccgtcgccgtcgtcaagccgaaggtcgccgccgccttttcctcgacgccgtcgccgtccgttgatcttccgccgccgttttggtcaccggtgagttcgccgcgtcgctctctacgtgctgaggttctccgttcgcgtcgtcgcgccgtcgttcgccggcgagcatgcaagcccgagccgccgccggtggtgacgtcaccgctgacgtcatcgtcgtcgtctcccgtggcccggccgtggaccggtcgatctcggccgtccgttgtagatagcatcgatctcggccgtccaaacccgtgaaccgccgccgtgcacccggtccaccgcaaaccctagtcgctgacgcaataaaccccttttccttttcaaaaataattcattattgcgtcataattcaattaaaatctatataaatgctttaatccggtttaatctttgaaaattcataactaattcatcttagctcggatttagttggttcaagtctctaaaaatatccacatgtactgttcatgcttgtttatgtgctgttttggtgtttttgctcttttctgtttagattccgacgtttccggagagtccgttttcgctggagaagaatttgaagagttccaaggccagtaaggcaagtcacacagatctcagacaaccctttgagcatgttgatcctatttaaagctattgtttctattcaactattgcatctattttcgaatgtcattgggtggaattaacctattctttgttatggccctttttgtacttgattactttattctttgataccttgggttagtataatttgactagttgagctttatacaatggttcagctagatgttaggtataattgcttagccatgcttagaaacattagctcactaatgggataatttatgattcactattatttaatgatggcttaatgatagctcatgatggttaatcatgattggttaattaattaatttgacaactaaaatatgataatggtgggttgtgagcatatggttttgatggttgtgctcatgacaattaaggaccggttcacgattttcggttgtgaaacatttatcgtaccaaccacaagccagcgtgggcaacggctttactttctgtatagtatggttcatagtagagcaccagactgtgaagtggaggagataagcccacgggggtcactggggagtccataccttgtttataagggggtgattatgatccgggaacggtgcactgctttgaattctattatatagagggtattgtcacaatctctattcgggtacttgtcaagtatcgcgacgcatggttgacatgatgttgagattgtgtcttgtgggtacagtggtacacctctgatcagagtaaaactattcgaatagccgagcccgcggttatgggcgggtctaacaatgtctttcgtgattagtttcacacttctcaccataataaaagatgctataactggcaataatttgtttagctcctggtttggaatggtgtattcctggtttggagatagaactgtgcagccgggatggttgttcagaacgattgggcctatgcaacagggtatgttgtatagcgttggattaatattgtttaattactacttaactattttattaaattctgaaatgtttgtaaatgccatttatgcaaatgaaaccatactatgtcatcctttgttatcctgtgcacttgcatatttgctgcgtggcttgctgagtatgtcatatactcaccttgcaatcattcatcagaggaggagttctacagtgatgctgatggtatggaggattaggtgtagccctggtcaagctgcctgtggagtagagtcgtttgtgccgtttattttaattttccgctgcttagatttttattgattgagaggaactatctacctctgtaacgacattttattcgcttattaattagagtaataattgtactctattatcaatttgttattgtgtgcctcggctgattcctggacgagggttcacacacatgtaagcgtttggaattttggatagaaattccaggcgtgacaccgaaggtagcaggagggcctgacaaatgggcctcgggcccacctgtcggctggagggaggaggaatgaacttgagggagggaggggagccgagcgggccgagcggcccaaaaggagaggggagaagggcggccgggccggaggagagaaggggaagggagggagttgggccgaacacggcccaaagacaaagaggggattttaatttgttttctatttatttaaattgagttaatgaactttgtattattataattacttattgagctccaaaaattcacgggaaaattcagagaatatattaaggtgcaaagaatattacaaaatattctcggccatgatttttaatggaaatttttaatttactcattatttcacttgattaaattgctttaattttatttaatttccagaaaatgcattatttaatgatttttaatcccgaacgaaaatcggggcgttacattagccgcgtggtttccacgtgtgcagcccgcgtggtgtctagtggagtccgtttgtcggccactcgcctcggttgacacacggggtccgcttccgtcgacccgtggaccatctctgtgtactcggtctaccgtggtcctttaggttgacatgtggggtctgcatgtcaacaagcgcagccttcctgtcttttctaggctagcgcttacacatattttatagttataaaacctaattacaataatccgtaaatctccatgtaacagcattaaacttcggatgatcatatcttggtcatacgaactccgaatcgagccgttcaaatctcttaatttttgttataacctaaagaaccctgtgcttttctttttatgtatcgttattgcttctttttaggcttgtagctttgcttgtgtgcttcgcgtagcttctgttgttccggaggttcccgaagcgtggttcgcggtcgtcgccgaaggtttggaagaccgttctctctgagcaaggcaagtcgcatcatcattgagcatattgaatcccagtttataaaattattttgatttaaattattgcattaccgctttatttaaattcccgcgttatcactgttttatttagcacttcctattaatccttgttatagccttatcattgctattgtttattatcaccatgttcaccctaggaaaataaaaccccaactagtacatactctattcatggttccactagtatgaatttaggtatatgcttcgctgattaattaggcaacattaggtgtgacggagctcgtggctcctcaccgggagaccgcgcaggcccccctttgccggttcggccgggggcttagggtgaaatcccaagctctctctgtatgtggaaagatcgctcgccagcaagaaacgcgagacacggcgacgtatacaggttcgggccgctgggaagcgtaataccctactcctgtgtttttgtggatctgtgtatgaacaagttaccaagtatcaatcagccaaaagtcccccttctaggtgggcaaggtcctccttttatatctcaaggggataccacatgcacctttccctttttaaactggactgttcttctcttcataaatggacggagatcggtacggttgctgtccgagtgcccttctgacgggacgacccgtacctacccccacttccgccggaaacaggtgcgacgtgggattatggctgtctgtggatgacgcgaccagcgtcagaccggtcacagatcagtcatccttgtctaccatgcgtcagcttagcaacgtgcatgtttgcccttcttcatgtaacatcttgcatgtaatggttgggatgaagcctggtataaatctaaccagggctaacgtgccatctctaagagataacacgctagctccggcttgagac

SEQ ID NO: 50914 - DNA, 934 bp, Oryza sativa
tcgggggaaatcaggaggagggcagacacctcaccctcgggcccgacgtccccgaaggtgccaggccgcgtgggcgattgtgtctgcctcaagcctctggtcacgatacccccggtcccatatcaccgacaaggtggttttataactttagactttgggaattctcatatcatttggatagtatggaatgattggcttatgttggaattggacacacacctccccctctattcaaaaccccccaaacggttttacgctgggctcgaggtgcgtggttttgttttgttagtcatacctcaggtactataaggattaagctcgcgcctctgttccaaagcactaccgtactaaccacatgtctaatgggtaaggcttaactcggtgctcagtctagtcctgaacaaaaggacacggatagagatagatgaagtcgttgcgacgatggatatctctaaggcaaatgaaggctacgcgagctgcggctcggtaatcgagatgtctaggcaaatgaaggctacaagggccggtgtccgttagtcgagatgccatggcactcgactagtacgcgggtggtctcacccctatgtgtgtggcgcacccggtctagatcctattgctaggggctcaatcctggcctgcttgtcccgggaaaccggccgtaggcagggttggatcggtacttttgttcactgctaggatgggtgaagggttatgtcacatgtttacgacgggttccaaggccttggaatgcggagtaaagatgtgtcttgtgggtacagatgtacacctctgattagagtataattgtcacgaccggaaataacccaacgggcgttcctgacgtgcgtgcattaatccttatcccaggaggcaaggacaccaaaagttgatacaattcagagtttaacaagcggaagcgtaaatagaattatta

SEQ ID NO: 50915 - DNA, 6980 bp, Oryza sativa
ctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagacctttacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactctttaacagatgtgcttaagtccctagaagacacatggttccaccacacctggaaatatatggcatatgtggtataaaatccgagtaaataaactcataaaggatttaccaaccgcctgaaaatgaccacaatatataatcagcctaagccataatattggtcaataaaaatgcacacttactggcgaaaagcaatgatattgtatcaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctaaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatataaatagaatattgcccaccagaggtggcaaaaatattggtggtagtgaagatagtgataccaatcaaaagtactgaagtcgcatagccatggaggcgaagaaacagtcggtgatgacaaaagcaaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagtgggaaacaaattaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagatgcgcagttgtgaaaataaaagcactagtcggcgacagcataaccagtcggcgacggaagacgatgatgttcatcagtagtgatagctgtataaaccagatgtagaggcgagggcactagtcagcagcagacgagacgaccggcgatgaagatggtaaggccaatcaacactggcagaatcatgcagccatggaagtgaagaaaccagtcggcaaccatggcaaacgtaggcagcttgtattgaagatactgatgcctattagtagtgacagcgatgtagccagccgtaaagaagatagcatcagttggcgttataacaggccagccgtgcaggcggtgacaccagtcagcggcggatgcggcggccggtcggtgaatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaaataaacagcagcggactagcgggcctacggctccatcttcacaggcgctcaactggggtataagccaggactccacctaagacttcttctccaaagcttctcttactgaaggggggagaaagattgagcaagaatgagtacaaccacagtactcagcaagccacaccggagatgcacaattaatgcaaaggagtacaaggggataataacataggggttatgttttgcagtaaacagcatttaaaagtcacttagttgcccaaagccattttgtaaggacgatcctagagctacacaatgttattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaaagatatgagaattcccaaagtctaaagttataaaaaccacctaatgttgtcctattaatcagcgaagcatctacctaagttcatactagtggaaccataaatagagggtccactagttggggttttgtttattctagggtgaacaaggtaataatatcaataacaataatagtatggtcataacaaaggtaaataggcatggctaaataaaacagtgataacgcgggaatttaaataaagcgataatgcattaatttaaattaaaaataatttcgtaaactgggattcaatatgctcaaggatgatgtgacttgccttgctcgctttcccaaacgccggcttcaacttccacgaagagcggatcttccgaagctgcagcgtctacacgaccgacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgggagagagggcgcgcggaccgggtccacgggagtggggcccacgcgtcagcctctcggtccacggtggaccgggagcacgcggctggcggcggtcggcgccgtgggtcccgcgcgtcagccgcgcccgcgggcgcgggcggctgacggccgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggcggtcttcggctcaccccgggactacaacgacgacggaaacggcggccgaagcggaggacggcggcggcgcggttcgggacggcgatgacgacggcgttccggcggtcggcgagcgaagcggaggggcggacggggtcgacgggaacgcggcgaagccgatggaggtggcgccgagacgggaggaagtccggagcgacgacggcggcgaaccggagctcggcggtgacggcggagagagaggagcacgacgcgagcacgaatccgacggcgagagcgagcggcgagcggcggaaacggaagagcgaagcacgggggacgattttatagcgccgagagggggaaagcgcggccggagaaggaggaatcggccgcggagatctcggctccattgaagaagccggcgaaactcgcgggattcaaatcggacgaatccgagggagagagagagggaaaagagggggaaacgggagagggaatcacggggagtgatttccccctctttaatgcgtgcggggatggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgggggaggccgatgggccgcgggggaagagagagagagagggagggactgggccgagccggcccaagaaagaagggggggaaagaagactttttaggatttttctttttataaaacccttttaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcatggttgctccactggaccttgcaaaaacggattacccggttcctggtcctgcgctccatggtgtccaggattttcactggcctctccacataagtcaagtcttcgcgaacttcaatctgctctgagtcggcctgttcggatggcactcgaagacatttcttgagttgcgacacatggaacacatcatgcacgttgcccaaggaggcgggcagctccaactggtaagcgacttctccgcgccgagcattgatacggaaaggacccacataccgaggtgcaagcttcccttttgtctgaaacctgtgcacacctcgcaatggcgtgacccgcagatacacaaagtcatccactgcgaactccagatcacggcgacggttatctgcataacttttctgccgagactgtgccacctttaaattatcccgaatgattctgactttagcttcagcttctctcaggatatcagtcccgaacacttggctttctccgacttgatcccacaatagcggtgtccggcatttgcgcccgtacaacgcttcataaggtgccatttgtatgctggcttgatagctgttattgtaggagaactcggcataggggagactcttatcccaagtcttcccgaaatctagtacacatgcgcgaagcatatcttctaggatctggtttagacgctcggtctgtccatctgtctgcgggtgataggcggtgctgaaatttagtcgggtaccaagctcttcttggagcttcttccaaaagtgagaggtgaattggcttcccctatcagatacgattttc

SEQ ID NO: 50916 - DNA, 4671 bp, Oryza sativa
tcggtgaaaatgtaaacgcccaacaatggcgggataataagtcagccgtgcaggcggaaacatcagttggcggcggcgaaggcaaaccgggttggtgaagacgtagacgcccaacaacggtggcataataggccagccgtacaggcggaaataccagtcggcggcggtcgaggcagccagtcggtgaagatgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcggggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcgatgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctcctggcgcgccaactgtcgaaacatgatttcggcaataataaaagggggtagcatacgagacctaaaagtggatggatgcagagacaaaggatttagacaggttcaggccctctcaatgagaggtaataccctactcctgtttggggatttgaatccgccgggtgtgtattgatctgacgatcaggttgtctctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacaaaatgtatgctaccctagcttgcaagcctgtgaggcaaattgcaagccaattgtttgatcagcttatcaagcctgtaattgtaaagaaatgataataatattgtctgttgttcaccaatcaagagaatgatcaatctcctcatagatgaacgtggtttgtccttttgtttaggggaaaagtataactgtcttattgatacataactggagatggccacaggagaatcacgagaataagcgcaagaaatagtatcgtatagtccatatggcatgtatgcaggtttgatcatagtactcgtttacagaataatgtaggcactgtttttgcaagtgcggttcactagattaaatttagttttgaggataaatcgaaaataccttttcatggcacccaaacgaagccttgaatcaatgggcaaccttttcaacttgggtctgcgtggcaggccaaattggaaccttctgtattgtaccatcattttttacagtgtgcatctccttcgtttttttttaccatagtgtccatctccttcgttcttaagcacaataatattatcacaagcaatctttcccccgtgaattatcgcaagagtttatttatagttgtacccctttaaagaaatcatgatattgtaaccttaagaacgaaacttcctgataatgaggtgaataggcacgagctcgtgtgattgttccttgtatcaccagtttagtatccactatggagacaccattgtcacccttttttaccccatttcaactacaaacctattcgaataaaatgggtaatatagagatttgatgcatcaatttcattggactaacctgtttccacaaattttgtaaacgcggtaatcacaaggatatgtttggttttcaatacaatttcactctgcgtgatagattgtaaaaaatgggcgtcctggttaggtatttgtcgcgcccggaaaaagtgtctttttctgaacgctagtgtattaatccccgtcccagaaaaagccgggtacaccacacaaacatgatacaaaagacacatctttattatatcgttaatatttacattatttcaaaggcacttcaggcctgacaataaaaaataaacaacagcggactagcgggcctacggctccatcttcacaggcgctcaaatggggtataagccaggactccccacctaggacttcttctccaaagtttttcttagtgaaggggggaaagatagagcaagaatgagtacaaccacagtactcagcaagtcacaccggtagatgtattattaatgcaagggggtacaaggggtaataatatagggtttaagttttgcagtaaacaacatttaaaagtcacttagttgctcaaagctattttgtaaagacgatcctagagctacacagtattattaatcaaggacgtgaacccacacgaacttgccttaactcaaggcctacgatgattcagactgaactggcaacccgacctgggtcccagctcgtcccaagccaacccaggacaaccattccacattttagttgttaagcaaattttaagaattaaaccactaacttgggtacattgctaggcttgcctataaccgagggcgcagctattcgaatagattattgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtgaattttcagagcacaaataataattgaaaagaaataaaca

SEQ ID NO: 50917 - DNA, 2928 bp, Oryza sativa
ccggtggtcgccgacggtaaccatcggggcgcgggcgcgccgctcccgtcggccgtgccggcgagaccgctttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagttatttagtgtttaagccttttcttttccgttggtcgtgtagacgctgcagcttcggaagatccgctcttcgtggaagttgaagccgacgtttgggaagacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagagcaaacaaaaccccaactagtggacactctactcatagtaccactagtataattttaggtagatgcttcgcaatctaattaggtaaccttaggtggttttataactatagactttgggaaatattcatatcacctggacactctggaattgttggtttattgtggaattggcttcacaccgctctctctattcaaaagtccccaaaatggttttaggctgggctcggggtgcatggtttggatggtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatagcacagggttggtgccctgctgctaggggctcagttccgtctgcctgtcccgggggttccggccgtaggcgggattgggtcggtactcttgtctatggctaggatgggttggaaactatgtcacgtcttccgtctgtataccgtggtggtatgtggcacgtggatacacgtgagaaagacgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcggcttgccagttcggtctgaatcatcgtaggccttgggttaaggcaggttcgtgtgggttcacggccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcgatattttcaaaataaaaatctttggttatttgtgaaaattgtctagtctctctctgtcttgctgcttcatttatcgccaaaatctgatcttttaaatgttgtttctctttttgtttttgtttgtagatggccggcacagtcacccgtcgtggtttggatatgactggcttcgttttggagctgcgaggcatgtgcgtggtcttggggtatccacatggagtggactaccaggccaggccacttccggatcaggagggtgaggatgcagagcctcacgctggttgggaggtcactgcagtgatcctctctggctctcctgagcggacttcgctggcagtcaccgcgggtggagactccttccccgccgcttgccagaacgccgctctcctcgccatcggcacccttcaccagcgctacccggacgagttgcagcactcgccctaccgctactaccctcgtcgcggaggagcccgcgactacgccaccttccgagatgctagctcggaggatgacgctaccgttgtgcacctggcacgcatggtggaggcgtacgacgcggctcgtatcgacttccatcagatggtgcgccgcgggatggttgagaacaacatgaagatcctggggctgcggcaggagaacctgcagctcaagaaggacctcgacgcgttggaggcgcagctgcatcagctcaaggtcgcccagggtgaggatagccgccccaagcgtcgccgcgtctgccgcagccagaagatcaccgcccgcaagagcacct

SEQ ID NO: 50918 - DNA, 11724 bp, Oryza sativa
ttcgaacgaatccgagggagagagagagggaaaagagggggaaacgggagagggaatcacgggggtgattttccccctctttaatgcgcgcggggacggcgggatgcggcggaatccgcggcggcggcggcgctagggcacgggcgagcggcggctgcggcgggaggaaggcgatgacaggtgggccccacccgtcagcgagagtggcgggcgggcccgcctgtcagcggcgcgcgcgcgggggaggagccgatgggccggagggagaggagagagagagggagggaagtgggccgagccggcccaagaaaggaagggggggaaagaagacttcttttagggtttttctttttataaatcctttttaactttgtttatttcttaacaattattatttgtgctctgaaaattccactaaaatttgagggctccttttagaccaaggagaatttgacaaaaattctccgggccacttttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtctcctcttcttgtctgacttcttccgctctggactgcttggctcgatctcctgttgcagatgaaatcttctcttcacccgacttgtcccgggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaagataccatgcttgtcatttgcttctaactcgccaccaactgcctcatattagctttcctggtctccgggtgatagctacttctgctattcgattcgagggtcgataactttgcctttgaattatgtttctcaacagagccaacttatcccacttgacatgctttgacgcctttccagatgactttactgctggacttgttattgtttgatcgttaccctgccaaatctgaagcttcgctgttacatgtgattttactctgacctctgtagactatcttcgaacatatcacttggttcataactgggaatagctcccacgaacaagcaactcggattcactttctttacatttggttcgcttcccactattctcttcatgttgtcatcatttagcattcaacctattcctttgcaccttccgcatggatgggttctttctcgatggatcgattgctagggaagtgcgttgagcgatactagtgcaagtgcttttattctagtagcatctgatacaaagcccaaggttgaaccgagctttagattccactgttcaggttttacttcttgacttcttggtcatgtcacaaaagtttccatccttgtcccccatagaagtacttctacctgtggtcatctctcttactcgtgaattcacctgctttaatgacagggcaactattgtagggttgtttgctatcgggagtcttcctcgagtgacacaaatcatggttctcgttatcttttatcaatcacctttcgacctttctcaaccaggtactcttcgctccgggtgttgaggatgtttctggggcaatgaggtgcttgggcgtgctgcctttccgtgaaaccttgatgtggttcgtcaaaaactgtactgactaccttcagggaaatacattgcttgctatctgtatccatgccactagggtttaattgccgatgatcacctttagtgcttcttcgagatgggaagcatccaaattgttcttctaccataccacctttgccccttttctgatacctgatagactaattaccaaccatcgactactatgtcctcaaatgtggatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggccttttaacccaactcagtttaattggttttcttttccatcaacaggttggttattaactcaaggttagaacatagttcctctgaaatgagaccctaggtctcctttatcagtaagcaattatacacataatcacatacccgcatcttccaaaagaatcctcatggaacttgtctgtattacacatttctccctcattacatgaatacgaggcactgccttaaacaaaaaagggacggtgcttaacatcggtacattgtatcctcaacatgaatcatccataagcatagcaaacccactgtttatagacatgaatatatttatgtattacatgattgctgcaaactttcgattacaccatgataagtagcggactgaaaaccacaaacatggctgctcattttgattctggagagatatagctggcattgttctagtgactgcatcatccttgattggttctgtgatgatgtgataggactgcatattgctatcattcacaggagaagcttccttctgattgctgtttgaagcggatgatggtcttctgcttggtatcgccctccggaggttgattgccctttgcttggcctggagtaggtcggggagagacacaacttcttccatcaacgacaattctttgctgaggctgtcggtgcagagaatggttgctatgatttattgcagagtcaggtgcagcaggaggagcattggtgcattgtttctgctatgggttctgattaacacgaggcctcacgggtacggcgtttgctccagtgaccacaatacgattggaatgtctgcttcgtgtaaattggcggtaatgtggaggtcgattttgccttggttgcaggcagtccctcgagtaatgccctggttctttgcaattgtagcaaatcaacgtcttctttgctgagctatccgtctgaggacgatcattctgacttggagttggagttggtggttggaaatccttgctaacattggcatcagtggtaccatagttgctatcaccattggagtctttctcagagtcaaaattgctagggttgtcattctgggtgccttcattgatactatcgtcgatatcttggtgaatgctgttgacattgcacgcttgatctaagtgatcatgaatggggcaagaaccatggtggttggtggtattatcagcattagtagtgctattgttgttgtctgcattgcgttcatcttcttggggcaggaactcttgatacacaacagaagatccggtgatctgaagtggctcagtgcgctgtctttggttaccacctggaaatactgggttgttgaccatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcgttcctgcgggaacatgtgatctcctgaatacagatgaaaactcgttccaggtaatggtatgtccttctggccgtgatgcttcgtagcgatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggttcagttttgagaaattctgataacttgcactgttgctggactgtaggcacttgaacgttggttgcccctgctgggttgttccaattctgtaatagttgaaaggctgttgccaacatgttggtttggttaaccactatttggattagctctggtgaggtttcgttgatgcttttctcattcccattggcttgggttcttgagtcatcggatccatcattcccatagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggtcacatcacaacccaccgatgcaaaccacgcgctacacacacaagcaaggaaacacacgactgacaacactatcctagaggacggcttaggttctgcgactggttcccaagatcttcattcttgcttcacatctggcttcactgcttcctttgctgcgctgacggatccaacagtcttccggagcttcggcaaacaactgacgacatcttcttcttcgcaaagctgaccatctagtactagttgaaatttgaagaaggaagaaaagagtaaaccttttgcaaataacattaggggaaggagaaaaagaggaactttcgcaaatagttttatttataaaatatgtccttaggttttatccacttggcttatcctacagtcgagatggctctgataccagcttgtcgcgaccggaaaaatttccttttcccgaacgctagtgtattaatccccgtcccaggaaaagccggggtacaccacacaaacatgataaaaaaggcacatctttattatatcgataatatttacattattacaaaggcgcttaaggcctgacaaacaaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcacaattaatgcaaaggagtacaaggggataataatataggggttaagttttgcagtaaacggcatttaaaggtcacttagttgcccaaagccattttacaaagacgatcttagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgtcgagcaaattttaagaatttgaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttatccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaaagatatgagaattcccaaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccgacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgggagagggggcgcgcggaccgggttaacgggaagtggggcccacgcgtcagcctctcggtccacggtggaccgggagcacgcggctggcggcggtcggcgccgtgggtcccacgcgtcagccgcacccgcgggcgcgggcggctgacggccgggcccacctggcagccgcggggcgcgcccgaaggcggcctcgccggcacggccgacgggagcggcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagtggagaaaggcggcggcgcggttcgggatgccgagggcgacggtgctccggcggtcggcgggcgaagcggagcggcggacggggtcgacggcgacgcggcgacgcggaaggaggtgacgccgagtcgggaggaggaccggagcgacgacggtggcgaaacggagctcggcggcgacggcggagagagaggtgcacgacgcgagcacgaatccgacggcgagagcgagcggcgagcggcggaaacggaagagcgaagcacgggggacgattttatagcgccgagagggagagagggcggccggggaggaaggaaaccggccgcggagttctcgggctccattgatgacgccggcgaggattgcgggcgcgattcgaacgaatccgagggagagagagagggaaaagagggggaaacgggagagggaatcacgggggtgattttccccctctttaatgcgcgcggggacggcgggatgcggcggaatccgcggcggcggcggcgctagggcacgggcgagcggcggctgcggcgggaggaaggcgatgacaggtgggccccacccgtcagcgagagtggcgggcgggcccgcctgtcagcggcgcgcgcgcgggggaggagccgatgggccggagggagaggagagagagagggagggaagtgggccgagccggcccaagaaaggaagggggggaaagaagacttcttttagggtttttctttttataaatcctttttaactttgtttatttcttaacaattattatttgtgctctgaaaattccactaaaatttgagggctccttttagaccaaggagaatttgacaaaaattctccaggccacttttgaatttttcttgtacgtattttagtgtttgccaatttcttttcgaattttaattaattctattattccttttagagaatgaattttaattttgggatgaatttatcaggacgtgacactcaggagggggaaacctccggcgttggtagcacggagggtgcgctgttgctcaccttccgtcctggcccgtcgcagcggtagacgagcagttagtaggcttgcgcgtgtgtttttcctcgtttgtcttcttgagtcgtgtggggcatggttatgccggtgtgtggcgtaattatgtcggagcctgtcttattttttatttgcctaagcaacttgaacattaatgaaccaatttaatagaagtaataaattcaagaattatagtagtcgagggtggttagttttaattgtcagctttctctgtttgccggttctgtgtggggttttcagatggtgacgaccaggagaaatgttaacaccggtgaaggcaaccaacccgaaggcagcaaccccaaccaccaaggcaatccacctccaccaccaccaccagacaccaatgccattctcacccaaatcctcgctcagcaggccaacatgatgaccgctttcctccaccacctccaaaatccgccacaacagaatgctccaccaccacctccccaacactctaaactcgccgagttcctccgcatccgcccacccaccttctctagctccaacaatcccgtggatgcgttggattggttgcatgccgtggggaagaagctggacactgtgcagtgcagtgatgaagagaaagtcatcttcgccgcccatcagctgcagggacccgcatctctatggtgggaccacttccaggctacgcagccagagggacagccgattacttgggctcgcttcaccgccgctttccggagaacccatgtgcccgccggagtcgtggctctcaagaagagggaattccgagagttgaagcaaggcaaccgctccgtgatggagtatttgcatgagttcaacaatctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaggccaagcacaaggagctggagtcgcacaagcgccgcttggcgaacttccgcaatcagcagggtgctaaccagagggtccgctacaccaatccctatccagggggatcctcctcgcagcagcaacaacagcagcagcaacctcgttccgcgcctcgacctcaattcgtggtgcgcgtcccacagccgcagcagcaacagaatcaacaagggactcgtgcgccccgtcctcctacgccagctgtgcagcccgttcaaggccgcagggacgctcaaggtcagcagcgtctatgcttcaactgcttcgagcccgggcactttgcggataaatgcccgaagccaaggcgtcagcaaggccaagcgcctccccgctccaacaacggagggaaggatgtcattcggggccgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggcggggttatgacagcaaagtattatagccctgccgttcctatagaaattcaggggattccttttccctcggatctgattctgctagacaccaagaacttggatgtgatccttgggatgaattggttggctcaattccaaggagtagtggattgcgcgagacgcacggtcactctgtaccgaggaccggaacaaccggttgtcttctttgcacccccaacctctgtcagaagttcagaactgcatcagataggactgtcagaaatccccatcgtcagggagttcggagatgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaaggaaaggggtatatacgtccgagtacttccccctggggtgcttctgtgatttttgtagagaagaaagacaagacgaagaggatgtgcgttgactacagagctctcaatgaagtcaccatcaaaaacaagtaccctcttcctcggatcgatgatctgttcgatcagcttaaaggtgccactgtattctccaagattgatcttcgttccgggtaccaccaattacgtatccgcgaggaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcaacaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcactgaatggaagcaacccaagacagtcacccaaatccgcagtttcttgggtttggcaggatattaccggagattcatcgagaacttctccaaaatcgctcgacccatgacacagttgttgaagaaagaagagaaatttgtgtggagcccgcaatgcgagaaggcgttccaaactctcaaggagaagctggtttcctcgccagtgttaatcttgccggatactcgcaaggatttcatggtgtactgtgatgcttcgcgccaaggattggggtgcgtgctcatgcaggacggtcatgtggtagcctatgcctcacgccaactacgacctcatgaaggcaactaccctacgcatgacttggagttagcagcggtggttcatgctctaaaaatctggcggcactatctcattgggaaccgctgtgaaatatataccgatcataagagcttgaaatacatcttcactcagtcggacctgaatcttcgacaaaggagatggttagaactcatcaaggattatgatgtgggaattcattatcatccgggtaaggctaacgtggttgcctgtcacgtcctgataaattcatcccgaattaaaaatcattcgctaaaaggaataatagaattaattaaaattcgaaaagaaattggcaaacactaaaatgcgtacaagaaaaattcgaatgtggcccggggaattttttgttaaattctccttggtctaaaaggagccctcaaattttacttgaatttttagagcaccggaaataattattaagcaacaaaaacaattatcaaagtttattaaaaagaaaaatctaaaaataatcctccttttcttttgggccaattttggcccaaagacctccctctctcccctcggcccgcggccaaagtctccctttcctccctctttttctctccctctccttctctccctccttctcttgggctcccctttccctcggcccagcttcctcctccctctctctcccgggctgcctctttcccccccccctcccctcccggcctgcccggcccaggccgcctccccctcctctcctcctgggccgcctctcggcccaagctgagccgcccctccctttcacgcacgtgcgttgcacgagcgct

SEQ ID NO: 50919 - DNA, 11064 bp, Oryza sativa
caaatccgcttgattcacttggttaattccaaaattgattagggggtttcaatccccattgattcctcttcaaatgcccccaaattcccccttgattcgtgccttcaatccccgggaacggacgcgccaagtccggccgccttccattgccgccggccgtggttcccgccgccgttcccgctcctcccgtggccggctctctcccccatcctataaaatgggatcctcatcccccgttctctcgttttagccccctcccgagcctccccgtggtccctagccacctccccaccgtcgccctctctctcccacgctgccggccgcctccagccgcctgggccgcctcgaccgtgcgccggccggccgcgccgtcgcctcctccagcgtcgccgctacctcctccaccccggcctgccctccgtttcgcgcggtgatcgccggaggcgcgttcccgccgtcgcccttctcttttctccgcgccggccgcctccagccgcctctcccgcctcgcccgtgcgccgtccggccgcgccgtcttctccctcggcctcgcagccaccccctctccctcggtcagccctccgtttcgcggggaaagcaccggagacgcgttctcgccggcaaaacagtggcgttgccgccactgttccacctccggccgccactgtcgcgtttcccgtgcgccggccgacgtcgccaccacctccctcggcgttgctgcatcgccctctcctccggctgctcctcggtttcgccggaacaccgccgtcacgcgtgccgcctttccctcggtctcgtcggcacccactccggcagcccctttcgccgtgccagtgcgccggccgacgtcgccgtctccacctccggcatcgcagcggcaaggacgccctcggcctcgcctccccttcgaccgaaccccgccggtgttcgtcgtcgtcgtcatcgtcccgtcggttgcccggctcgtcgtctcgcggcgccgcctccgtcgtcggcatcgcagcggcgtggtccgcgtcgtccccgtctccgtgcagctgccgccggctgccctcatcgcctcctcgccggccccggtcgtcgtcgtcgtcgtcctctcgtcgttcccggtcgttgtggcgttcgtccctccgtcgagccgttctcgtccgccgcccgcgtttcgcctagtgtgctgcagccccgtcatcgtcttcgtcctcggctccgcgtcgtcaagcctcgtgccggccacgtctcgccttcgtccaaggatcgccgccgaagccgtcccctcgccgttcgtctccgttgtgcccgtctgtctccgccgcgcccgttcgtcgttgtcgtccccgcgcctcgtcgcgtggtggtaaggatccctctccctcgctgccccgtcctcgtcctttcggtgtcccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaggtcgtgtggtgtttagtggagtccgtttgtcggccactcgcctcggttgacacacggggtctgcttccgtcgacccggggaccgcctctgtgtactcggtctaccgcggtcctttaggttgacatgtggggtccgcatgtcaacggcgcagccttcctgtcctttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaagtccgttctctctgagcaaggcaagtcacatcatccttgagcatattgaatcccagtttataaaattattttgatttaaattaatgcattatcgccttatttaaattcccgcgttatcactgttttatttagccatgcctatttacctttgttatgaccttattattgttgctattgttattattaccttgttcaccctaggataaacaaaacccccccaactagtgggtactctattcatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacatgtttgggtgcatgccagttgtgggaagtagcaccccggccactctaaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctttaggatcgtctttttaaaatggctttgggcaactaagtgacttttaaatgctgttttctgcaaaacttaacccctatattattactccttgtaccccccttgcattaatcatgcatctgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcagctttgcgaagaagaagatgtcgccaattgtttgccgaagctccggaagaccgcagggtccgctagcgaagtgtaggaagcagtgaagccagctgtgaaggagtgaagatcttggagaacccgtcgcagaacctaagccatcctgtagggtagtgttgttagtcgtgtgttccttgcttgtgtgtgtagcgcgtggtttgcatcggtgggttgtgatgtaaccatgctaggttgtttgcttaatcaacttgcggaataagcaaaacaaacaacacatcaacaagaagagttagttcctttaaggtcctatccttagtttctaacctgtctctcccctttgttttccctctctccctctccaaacctgtcacgtcctgataaattcatcccgaaataaaaatcattctctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaaaaccctaaaagaagtcctcttttccccccccttccttcttgggccggctcggcccagtccctctctctctctcttcccccgcggcccatcggtctcccccgcgcgcgcgcgccgctgacaggcgggcccgcccgccactctcgccgacgggtggggcccacctgtcatctccctcctcgcgccgcgcccgccgccgccgcccgtgccctagcgccgccgccgccgcggattccgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgaaccgcgccgccgcttccctccactccggccgccgttctcgtcgtcgtcgttgtcccggggtgagccgaagaccgccgttcgctttcccccttctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgctgttatgtggagtttagtagtgtaaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagcctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatatggaatggttggcctgggttggcttgggacgagttggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaaacctttgcaacagatggctgacaatgagaaaggcaataaggtcagaagtcaggacattggtacctcaagctcccgagtgaatgaagcaccagataccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtgtctgatagtgaagattcagatcaagtctcctcagatgatgaagatgaaatggaacgtaaggcatgctctcgttgtggagaaatcggtcatgtcgccagctcgtgtgccactatatgcgttcattgtgaggaagaccatccacccgacaggtgtccaacgagcaggatcacttgtttcttttgtgaaggaaccgatcatgtaccaaaagattgtcaattcagttttctgctgacgaagaagatggtcaaccaacccgccagttccaacggagagaagcatcaaggcaacaccaatcctcgccaaaattacagtctcagcttaaatccagtgccaggacagaggaatcaaaatgagaaatggaaatgccgagtccgggaagatatctgttgcttcaattgtcaaggaatgggtcatttcgccgacaagtgccccagaccaagaaacatagctgccagcatgtcagtccccgcaactccttgcaatcagaagcttgcccctcagcgaattgtcatccatgcagcccgaagcagtcctatagaccgcgttgcaacagctccaactccagcgagtgcattaccaccaggtgtcaatgctcaatttcagccccagccatcagtttacaagacagaggccagtatcggcattgtatctttggatgttccagcacagcagccaaagaaatcaagtataagatgaagaacccgagcgtaagaaagttattgtctgttacaaactgtagtacctgttaaggaagcagacctgccagtcgccaagtggtcactggagcaaatgcagtacctgacaagcctagcgctagtcagaaaaaaccataatactcttatatcagtgttcaaatacttttgttttatagttgttcccgtcaatcatgtaataacagagaaacatgagattatgaaggagtttgataagtttatgaaggatccatgttaagattgcaagtgctgtgagttgtgtacattttgttgctgattagggagacctagggtctcatttccgtaagctcataatctactatgaatcaaataacctagcgattgatggcgaagaaaataaagtgatcaaccaaagagacatttgtttggactaagagtttcagatatgtcttcttcggatcaaaggcatgcacccgttgtggagaaattggacacgttgctagcatgtgtctcacactctgcactcactgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagctagtcagctccaacagcaacatcgacgatataatccacagcaccaatgctcctcttgctgcacctgattctgcagtaaatcatagcaataataccttcagcaccaaccattctctgcaccgacagcctcagcaaagaattgtcgtcgatggaagaagttgtttctctccccgacctactccaggccgagcgaagggcaatcaacctcaggagggcgataccaagcagaagaccgtcatctgcttcaaacagcaatcagaaggaagcttctcctgtgaatgatagcaatatgcagtcctatcacatcatcacagaaccaatcaaggatgcagtcactagaacaatgccagctatgtagccatgtttgtgattttcagttcgctacttatcactgtaatcgggagtttgcagcaatcatgtaataaataaatatattcatgattataaacaatgagttcgttatgtttatggaagattcatgttgaggatgcaatgtaccaatgctaagcacctttccttttaggcaatgcttagtattcatgtaatgaggaagaaatgtgtaatacagacaagttctatgaggattcttttggaagatgcggatatgtgattatgtgtataattgcttactgataaaggagacctagggtctcattccagaggaactatgttctaacctcgagttaataaccaacctgatgatggaaaagaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcccagttatgaaccaagtgaaatgttcgaagatagtctatagaggtcagattaaaatcgcatctaacaacaaagcttcagtttggcaggaaaacgatcagacaataacaagttcagcagtaaagtcatttaggaagatgtcaaagcatgtcaagtgggataagttggttcttttgagaaacgtaattcaaaggcaaaagttatcgacccttgcatcgaatagcagaagtagctagcacccggagagcaggaaagttaatatgaggcagttggtggcaagttagaagtaaatgacaagcatgatattcttatgatgacaaacatgatatcctagtaatgacaaagctgatgtcgacgcatgtcacgaaggtggtaacttgtatgagtttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagataagtttgttatagaagatgaagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatgcgtacaagaaaaattcgaatgtggcccggggaattttttgttaaattctccttggtctaaaaggagccctcaaattttacttgaatttttagagcaccggaaataattattaagcaacaaaaacaattatcaaagtttattaaaaagaaaaatctaaaaataatcctgcttttcttttgggccaattttggcccaaagaactccctctcttccctcgggacgcggccaaagtctccctttcctccctct

SEQ ID NO: 50920 - DNA, 1584 bp, Oryza sativa
ttcaattgtcaaggaatgggtcatttcgccgacaagtgcccaaaaccgagaaacgtagctgccggcacgtcagtccacgcaactccctgcaatcagaagcttgctcctcaacgaattgtcatccatgcatcccgaagcagtcctatagcccgcgttgcaacaactccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaaggaagcttctcctgtgaatgatagcattatgcagtcctatcacatcgtcacagaaccaattaaggatgcagtcactagaacaatgccagctatatctctccagaatcaaaatgagcagccatgtttgtggttttcagttcgctacttatcatggtgtaatcgaaagtttgcagcaatcatgtaattcataaatataatcatgtctgtaaacagtgagcttgctatgcttatggatgattcatattgagaatacaatgtaccgatgttaagcaccgtccctttttgtttaaggcagtgccttgtattcgtgtaataagggagaaatgtgtaatacagacaagttccctgaggattcgtttgaaagatgcggatatgtgatcatgtgtataattgtttactgacaaaggagacctagggtctcgtgtcagaggaagtatattctaacctcgagttaataaccaacctgtggatagaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgtagcttttgacg

SEQ ID NO: 50921 - DNA, 806 bp, Oryza sativa
ctacggatcagttgctacgagatccaccaatcgaaaaggcggaagtgaaatacttgtacgaactcggtaaaccgcttgtcaagcctgagtagctgcagtccctaccgatacaaatgtacaaattccatcaactgtacatggagatgaacgccaccggtagagagatgatcggagcgaggatcagggacacggacttcttgcaaggagaagatattctctagatcaatttcaagggtatctacgaactataccagctggacgccctcgacgtgtctattatgagttgttggactttgtaagtatcgttcagttagatttctttttacgtttcctttaattaattaggtccttgtatataagtacaccatatataatatatacttccttttatcgttgtagaatggagattcaaagggcccgacggcggggggttttcgatactggattcatcgaccctcggaaagtaaatatgcacacatatatatagtacacacatatataaatgtgcacttaattaagtaaatatggcctatatttacagaagtgcgtatatgtaatatataaatatttatatatatagtatacacatatataaatatgcacttaattaagtaaatatggcctatatttacagaagtgcatatatgtaatatgtttttacacatatatatgcaatatgcatacatatgtataaatacatataatacacacatatatgcacataagtaaatataggcgacatgcatatattaacaaaatttgagtttgcacctaagtaaatatacacacatatattatattatcaa

SEQ ID NO: 50922 - DNA, 1281 bp, Oryza sativa
acaaggaaccagaacagttacagagtacctgcacgagttcaaccgcctcgcgcgatacgcccctgaggacgtgcgtaccgatgccgagaggcaggagaaatttctgtctggccttgatgatgaattgaccaaccagttgatctctagagactatgaggattttgagaagcttgtggacaaggctatcagtcaggaagagcagtgcaacaaaatgaaccgaaaaagaaaggcatctcatttcagaactctctaggggaacagtcagaagcctcgcttcatgacgggatatcagggtggaccttccaccatgattatccggcaacattgtccctaccacccggacaatttcaacagcatcaacaacaatggcagtcacagaaatagtgagcagcacagcctcaaccctactccaagtccactaatgattccagctcagtcagttcagtcagctctgccagctcagccagaacagcccaagaagtttggagaaaacccgaactctacttcaattgtcacgagcccggacacatggttggtaagtgcggaagcaagacgtgctggactcaagtttgttcaggcccgtgtcaatcatgtgtctacagaggaggcgtagtcagcaccagaggttatattgggcacatttcccgtgaactcgacaccggcagtaatattgtttgcaactcattccttcatttccaagtgttttgctagtgcacatgggttatctttagtgaagcttaagataccaatgcgagttcatactcctggaggtggcatgaccacaactcactactatccatccgtgacagttgaaattcaagggttgatttttccagccaacctcattcttctcgaatccaaggatctagatgttattcttggaatggattggctaacaaggcacagaggagtgattgattgcgctagccgcaccatcaagttgaccagtgcgaaaggagaagtggtaaccttctagtctccaataccgcagaagccagggatcagtctgaaccaggccactggtgaagaacaagaggtagcagtggagaaaaccactaagaagttggaggatattcccatagctagagattatccagaggttttcccggaggatctaacatcaatgccaccaaaaagggatatcgagttccggatcgatttagcacccggaactgcaccgatccgcaagaagccttatagaatgggagccaacgagttggcggaagtcaagaagcaagttgatgaacagttacaaaagggatacatcctcccgagcacgtc

SEQ ID NO: 50923 - DNA, 2300 bp, Oryza sativa
ttcctgcagcccttctcgtcccttatttcatttcatcttctattttaacatatactttaaagtacaaatgtatagttctatactctacgctactcctagtataaaaccataataatccaaccatatttaaattcacaattcaaattcgattcttttaaaaaaaataaaatggaaatacaaatcctagtagcatgtattcatagctcgggtgaaacgagcttctgctactgtagcgcttccatgcattttctcacatgtgttgatttttcccgtcttctcatccacccatagaccagctacttctctcacgaagcaacaaccaagcaaaacaacaaaaaagctgcatagcacatcgcatgtatcactttccccattcttctaagtcccacaatcgcagctgctagtgctaccctgctactactttctcaattttgcagcctgcaacaacacttgaatcatccagtgcctcgacgccatcgcatgactcggccactgggccatgtttttcatcgagttcaggcagagggtgcaggctagaggagactccaggtacagcagacgcgtcggccgggaaggagcgtcgggtagaggaatgcacttgagggatgacacggtaggcagggaggagccgcaccgggcgggaatgagcactgggcaggggaggtgccggcggaccaagaccacgtcgggcagctcccgagcttttccaaccgtggatgggggctgtgcagtagagcccctgagactgggggcttggaaagattatttgggtgcctacctaatttaggatccttgatagggtgtcacatcctgatttttgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaatccttaaattataaattgttgtttaaaaggaattattagaaatgattttaaaagcttaaaagagaagatctaattttaatttgctaaatctcaacataaaattgggccagataaaattttgttaaatactttgcttaattctataattcctagatttttctgggatttatttgagctaaggaagtatttttaataaatggaattgcatttaagaaataattttaattgaaaaaggtttttaaaagtctgttttggctttgggccgaaagtcggcccaaaacctctctctttcttctctctctccccggcccagtcggctcaagtcggcccgcagcccagtccgccgagccgccgctctcctctctctctctcgctgtcgctgacaggtggggcccgcctgtcggacccgtcgtcttcctcgcgtcggccgccgcccgaaaccctagccgagccgcgccgccgtctccttccaaattcggccgcgtctttccatctccggccgaatcgtttgaggggaaatgatcttctcgatctcctcttccttttctcttttggaatcatcgtctttttcggtttggaaatccgtggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgtcggaagcgctctagcgccgtgtaacctagcgccgccgtcgtcgccgtcgctccagccgtgcgccgccgccgttccagtcgccgtcgtcactcgggaaggccatcgtcgggatcgccaagttgccgccgtcctcgtccgccccttcgccattcgccggcgagcgtgcgccgtccgagccgtctgagccgccgccgccggaggtgacgtcaccgccgacgtcatcgtcgccctctcccgtgagccggtcgtggaccgttcgatctcggccgtcctttttggacagggttgatctcggccgtccgttcccgtgaaccgccgccgtgcacccgatccaccgcaaaccctagccgctgacgcaataatcattcttttccttttcaaaaataattcattattgcgtcataattcaattaaaatccatataagtgttttaatccgatttaatctttaaaaattcaca

SEQ ID NO: 50924 - DNA, 3082 bp, Oryza sativa
cgccgctatcctctctctctctgtcgctgacaggtgggacccacctgtcaggttcatcttcctcgcgccgccgccgccgcccgaaaccctagcgctgcgccgccgccgccgctttccaaattcggtcgctcctttccttctccggccgaatcgattgaggggaaacaatctccgcgatccactctatcttttctcttatggaatcgtcgtctttttcgctttggaagttcgtggattcgaggtcgaatcggatcggtctctttcctccgaaccccgatctttccttctcgccgccggtcgccgtgggcctccgtcgccgctcgctagcacctttaaaacgacccccgagctctcctctacccgccgccaccctcgcctttgtctctcgccgtcggaagagccctagcgccatggatctagcgccaccgtcgtcgccgtcgctccagccgtgcgccgccgccgttccggtcatcgccgtcgctcgggaagaccgccatcgtggtcgccaagtcgccgccgtcctcgtccgccccttcgccgccgccgaagactgccggagcaccgtcgccgtcgtcgacccgatctccgccgccgcttcttcctcgtcgccggcgccgtccgttgcccttccgccgttgttttggtcaccagtgagttcgccgcgtcgccctctacccgttggtgtcctccgtttgcgtcgtcgcgccgtcgttcgccggcgagcatgcgttgccgagccgccgccggtgctgacgtcatcgctgacgtagccgctgacgtcatcgttgccgtttcccgtgagccggtcgtggaccgttcgatctcggccatccgttttggataagatcgatctcggccgttcgtttccgtgaaccgccgccgtgcacccggtccaccgcaaaccctagccgctgacgcaataatcctccttttccttttcaaaaataattcattattgcgtcataattcaattaaaatccatataagtgttttaatccgatttaatctttgaaaattcataactaattcattgtaactcagtttaatgtggttcaagttgcaaaaattatataaaataaagatctacatattaaaattgtccataaattgaattaaatttatttaatcctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacaccgatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgagctatatatattggttcagctagatattagatatgattgcttagccatgcttagaaacagtagcacactattgggataacttatgactaactattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtggacaacggctttaccttttgtatagcatgattcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgaacaatgtttttcgtgattagtctcacacctctcacaataattatagatgctatacctggtaataatttgcttagctcctggtttggagattagatctgtacagccgggtatggttgcttcagaatggttgggcctgtgcagcatgggcgtgttgttcagtgttgattaaaattaatgattaaagtactctactgttttacttgtcttaaatgttttgctaaatgctgtttttgcaaatgagcctatattatgccaacctttggtatccttgtgcacttgcatatttgctgtgtggcttgttgagtatgtcatatgctcattcttgcaataatcaatcaacctcagttgaagaaaaaggatccagaaggagaagacgtctggcttataccccagttgagttgcctgtgggagtggagccggagcttcgctagattttattttccgctgcagttttcttcatggtggggactaagtgcctcttaagtaaatacttatcgttttagttaatttgatgaatctgtatattaaattgtcagtttgtgtacctcggctgattcctggacgaggattttatgcacaaataagttcggaaattactagtgaatttccgggcgtgacataggggctctgctggattgagttttttagcctcaacacccaaaatctgtttaggggctatatttagtgtccctgctggagatgctcttatgtaggctgacattgattgccccccataatcagttttggttgtgcactagacgatgcggaccggtatcgatgtggttcttaatttcttagagggggcgagtgcggataccagtgagggggaacctttccgatatgggtatgatccaaccgatactaattaggttgtgtacgttctgtaatactccatccgtttcagttt

SEQ ID NO: 50925 - DNA, 5240 bp, Oryza sativa
cgcatgtaaatatgcatgcatgcatgcatgcatcgcctaatggccatctaaccctataattaaatcatacggagtataatacttcctgatagttattaatatttaatttctcgatgtccattatagccaatcttgtatgaaagaatgaagagttgcacattaaatctgagaaaatcattaagaagataggtggttggatttaaatatgtctatcataaataaatttttcagatttaaaaatatgtctatcaaaactagatggagagagtatacagcactattgttactactagctagcagtgcaagcagtgcccaactatggcatggtttatttctcaactttttctttacacacataaactttcaacttttccgtcacatcgtttcaatttcaatcaaactttcaattttaacataaactaaacacaccctatatatacaggactggactaaggtagcttgctagttggcagcgttggaaacgccgaataaccagtgatgaagccactgctactgctcatctcctccattgtagtgatgacattcttactcctcctgagcggcgccggcgctctcaccgccgatcacgccaccgtcggcgtcgccgtggccggcggcaagcgcacccgccacgcggaggaactaagtgagatggattcggtgccgtacccgcaaagaagggtgctacaaggtggcaacactgtctacagaccgcttggcagaggtgcggcttgcaaccctatttgccctggtcgcggagacaggtacactggccgtggctgcaaatcccgttaccagtgcaggggcatgtaagatatctccatcagggtgcatgataatatcttcacaccctatgtacgcatgcatgcttggaaattattgggcagttcagcagttgttctatgtacatcgatggagtaggttgaacactcagttgatctcgtcttttttcagtattgttacggtattccaggcatataaacactcatgatcactggtcatctccatgctgaatttgtctgtatcgcaacctaaacatgttcacgtacgatttcataggatgccggtcgtcgtccggccagacgcaaatggctcagcattgatctgctgttgcatgcttcattattgtattcctgttcttttccctactgttagttactcatctcattgaatgagtgatcctgtggtacttgcaaaatcaagtgttcaattttggtacacacggcacggcgctgtgtgagccggtttggtgagagccggcgagatgggagtcggctcccgattggacggcgaaagcggtgggcgatggctgtggcgacacgcagccgaggtcgtggcgcggcgtcgagtggcggcgacgggaacagcgggcggcagcagtgaatcggtgagtgatggcggcggagcagcggcggccgcggattggctatggcggcggcggcttaggcttagggggcggcacggggtgcccccggtttgcagcggtggcggcgcggtgtttgcgtggcggcagcgggtggcacgggcggcgcagctgggcggcggcgcgtcggattgggcgaggcggccacgcccatggtggcggcggcggcacaatgccgtggtgcgcccacagaggaggagaattaggcggctcgactgggcttcggctcggctgggccgggcgcagcccaagatagagtagaggtggaaggaaaaggaggaaaaagaaaggaaagaaggaatcggcctaatgaaggatttttggtccaaaggaataggaaacatgagaattttgtgtggaagaatttggaatagaattcaaaggaaatgaaaactaaaggatagattgttgtggattttttaaatttggacaaggaattcaaatagaattcaaaggaaattgatctaaaggaagaggttggtggactttttaactttggacaagaaatttgaataggattcaaaggaattgaaaactaggggaatttttgaatggaaggtttgaaatagattttaatggagataaaatttaaaagaggaatgtttggtatcttttgaactttataaaaagaatttaaatataaagttttgaaagcaaaaaggagtttaaaatatttttaaaataatatcaaagatattatttttgagatataaattttaaaaaggataaaaataaagatgctccaattttaaaagaattcaataaggatcaacatgctccaatagaattcaataagaaccaaatacaaaacttgtcacaaagattttctttaatattttaaaaaaatcaaagggaaagaaaggcaataatttaatttctaactttggataaatttttgggatggtggtaaaatggatggaggtaaaataaataggattttaacctccattatatgtggtatggattcttggtggaatatttgtggctaaaggaagttggattttgaatagaagggattagaaataagtttcttagcacaagagcaatcactcaattatttgtgatagtatagttcttgtgccgaggaggaaatcaagccgtaggaatcaaattggtggcttgattaaaataggaacttgaacacataatattttggatcgattaaaagaagacaaaggttttagagggtaggtttagataggggttgatccaaattaaattccaacggaaagggagttatactggtttaaccccaaagataaaaatggttaatgggatataacaaagagtcgggtcaatcagggaattattggcccaagttaaatggtagtctttgaaatcttgaatggataatttagatgaacgagatttcaaaggggaaatacttgtgggagtatagaactggattcagaaatatatgtggatggggatttttataggaacggaattagtggtagattggtaaacttctgaaggataggtatattgacttagagggatattgaaaaggatatctcatggactatgggaatatttaggtggagatccaaagggaaggttttggttatggggaaattaagaattggtatttcatgtgtttgggtagagatcaaaggggaaatatttggtggaagataaaactggttttgctggttgtatggtaagctctaaatgaaaaaggtattaactctagagagattgatatttcatgtgctctagagatggttgagcggctctagagatggttgagcgggaatgaaaagggtatttgtggatgttggagatgttcggtaaaggagtcaaaggaaatataatctagagctaaagttagagattaaagaaaataaatacactacaagaaaaattagctattgccacgaaagtattaccacgaaaaataattggtggcaatatatcatactattgccacgataaaacttttcgtggcaaataagtatattctgttgcaacgatgtataatcgttgtaatatcttttattttcgttgcaacaaaaataagttatcaccacaaataaaatatcgttgcaataaaaactaagctatcaccacaaaaaaaatatcggtgcaacgtacaagccctattgccacgacttcgatttttgtggcaataagcacacaatatttgccacgactcagccgaacctcccaaaatttagcgcgaaatatttctgtgtttcgcggttttgggcgcgtgaaaagatcgattaactcccgaaaaagttagttcagttattagtactatttatcaatctaatctattccattcacacggctgggcagtgctcccgtgacttccaaagtctcacggaggagcagcgcctggtgatttcaccgcgacggtgccgccgtcaaccgcgtcacgaggaattcctccactccgttcagtgattcagctttcagccttcaggtatcctccgttttcatcccctcatcctcctcgaatacacaatttcttttttcacggtctagccaaatttcccaatccgtcggcgctcaccgccttctgtgccgcctcacttgcgccggcgaccggatgacgcctgcatcccctccaattcatcttcctcatcccgatctgatcctccagccctagttccacaagcaacatgccggagatgtgtgcgggagggatccaagcgaggtgcctggctagaggcgccacatccgccggggaagacgagggttcgctggggaagacgagggttcagtcaacgcatgagagagccactacaatggaaggatgcgagggtacacagggtcggcttcggccccggcgtcgacgaggaagcggagccggaggatgtcgcttgctgcagatggggggtcggccgcggcgccatcgatggaagttgcacgcagcgccgccgccgtcgatggaagccgagcgcagcgctgccgttgacggaagccgggtgtatcgtcggatgccgaatatgccgcgtcgcgccgctgccgccgccgccgctgggcgtagcactgcctccaccgccggacgccctatgccatcgccaccacactaccacgtaggccagggcacaaagctgccatccaatgggttgtggaggtaattaaattgagttattggagaagatagagagaaatcagactggaagacatgatttattttttttactactgctattgatttcccaggcataaattcatattatttttgtatacatatatagacgtatcccgtatccatgtttttcagaaaatgatgtatcctatccatatccgtatccctgtatctcggtaacatagagcaaaggatgttgcttgctgcagatggggtgacggccgcagcggcagcgacagtgagtagtttagaacttcagattagctatcttagtaggcaagcagagcaggcagggcgagcattgctagcgtagaatagctcagatgagttatgtttgtttctgaatttctgtctttgtttctgaatttctgtctcccacaaggttaccttggttatactgcacaatatccaaatttgctatacacggtctctcatatttattaatttcttcagtttgtccaatttcccatatgaattttgaaaaataagaaacaccttccatgggaataccaatatatctgttactgtccaatgtctatttttcagctcaaatcctcatgattttgtttagttctaatttatctgttcatatctttgtacaggaatattttttctggtcagcctacagagacaagttctggcaaggtgagtttatgttcacacagtttctccattttccttaagatcataaagtgccaaccatattttccttgtttt

SEQ ID NO: 50926 - DNA, 2010 bp, Oryza sativa
ataaaatagctctgcattttacatggtgactttctttactttaaatacgacttgtaactatatgtccatacatttgtacaggaggaacaatcaactctgttactgttgaatggctggagcaaaccacgacaaaatcaaacaagtgatggctagaaaagctagtttcgacaacaatgttacaaactcattagtttcagaacttttagttttatcagacaacttgtatttcagcatttggaaatttaacatactcatattgtcatcattactttgggtatctgaaatatattatgtcttattcgcggaaatatcagacatcataattcttgtgcgcatgagttgcaagggttttgccatttaacatatatttctactcatgttgcaatagtaccaaatgatccatccaattactgatgtaacacaatttcttttctataaaagctagaagaaattcatttcattgtaataatacttattgccacaaaaatattttagtggcaataacccatatgatatattgccacgattaatgctatgtggcaataacatatattagatattgcaacgaaactattttgtggcaagcacaactaatgccacgcacgaagtggtggcaataattatttgttgcaacgatgttaagtgttgcaatatgtttttttgccacgattattttgtggcattatcaaagtttgttgccactagataaaaattgttgcaataacctattgctactgtttctattgccacggctagcaacggttttaaaatggtggcaatatgtatctattgccacgattttagcattgttgccacgatttttttcgtagcaacaaatcattttcctagtagtgatagagaggtttacattttaaaagagagcgattaactttgcaaataaagtttaaatccaagttaaaagaaattaagagaaggcaacatcacttcaacagaagaatcgagaagagtgcaactaaaatattttgcaaaacattttccctgaaaatttgagtctgtcaatggtggagaaaccctttgtagtcccggtttataacccccctttagtcccggtttccaaaccgggagtaccaatccgggactaaagatcgctatctttatctttagtcccgggtgaaataaccggtactaaagatcgatcttaccaaccgggactaaagatcgagctgacctttttttttttgcatggccctgtgtacttatacatatatatgttatgcaaatgcatatgtatatatacaaacaaatttactatatatatatatatatatatgaccaaaatatatttacattatagaaaatgtgtacacatgcatatagaaacatatgtagtcatgtattaattacaatccattatatgtcctagatagctacgatttcgacgtagtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtaatagctgcacaagttagttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaatcgataccaagccctacatggagtttaaagctatgattcgtagtagcaattaacataacaagattttcttaattaacagaggaacttatgacggtacctgt

SEQ ID NO: 50927 - DNA, 1701 bp, Oryza sativa
ttttaggcggcataccaggtaaatcatctgggaacacatcgggatactcccggactataggaatctcttccaaagttatttggttcagtcttgaccttaaggactcagaagacaatgcatgaacagttacaactcgaccatcattgctggtgagagttacttttctgttggcacagtctatcacacctttatatctggctaaccagtccatccctaggatgacatcaaggtctttggattctaacaggataagattggccagaaatggtactccttgaatttctattctgacagagaggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcgacatgattaacacgggcctttggcgctggtgcggtagagttgctctgagcagggacaaccttcacgcgtcggggcttcggacacttgtcagcgtaatgtcctgggtctccacagttgaaacacaccacgggctttctgccttgctccctcttggcaggttgttgctgtgtcgaggctgcaacagggcgtagagcttgattgcggatgttgttgccagcattgttgttgaagaactgacgctgcggacgaacaacagacgaagaacctccctgtggcatggactggggtcctaaagtaagacgcggcctctgactattcccctgttgtgtcttgaattgagcaatccgacgtttcttctgctcgatgcgattgtacttgtcctcctggcgaatagccttatccactaacttctagaaatcaggataatccccagtcatgagtgggtaagaaagctcatcattaagtcctgccaagaacttttcctggcgctcttcatcagtgcgtacatcttccggagcataacgagcaagacgattgaactcgtgcagatactccgtaacagagcgagatccctgagtgagcgacctgaattccttcttcttgagagacaccactcccgatggtatatgcgtcttccggaaagcagcggtgaattcaagccaagtgataggttcagcagtagtcctattcagacggaagtgatcccaccattcagaggcagggccatgcaactgatgggatgcaaatgagaccttctcctgatcagtgcattgaagcaaatccaacttcttctctatggcatggagccaatcaccagcttcaacaggattagtggtgctagagaaaataggcggcctcacacgaagaaattctgctaacttgttttggggaggcgcatagttatttccctggttttgctggttctgaagttgctgcatcatcatgttcattaactgagtctgttgagcaagaacttgggcaagtgtgggattctctccattgttattgttattgttgttgttggggccattcccgttgctgcgagtgagcaccatctggcatggacagggcacaagaagagaaaccgggggaaactacttaggacagagaattactttaacttttattgatcttaactgagtttcattattacaaaactgaagactctcacaccactaaactgtcacgcccg

SEQ ID NO: 50928 - DNA, 9783 bp, Oryza sativa
  unsure (1)..(9783): unsure at all n locations
attcctgcagcccagaactgcatgcagaaggttcgaggggaattttgtcgatgacattgaagcagaaccgagatagagggagaacacagttgccgttgtgacatgtcagggtagggatgaaaacggatcggaaacggacgtaaactagctttatcatattcgttttcattttttttggaatcagaatcaaaatcgaaaaccggaacgtaaatgaaatcgaatattatcgaattcaaatacggagcgaatacgaaacagaacgaataagtaacgaatatttgcagtatattaaaatcccctcaaattgagtttctccaaaatttatatcgtcaattttgtagatggtcctacaaccgtatgtgaaaattgattttcatggcaaagagaccaacatgtaaatatgattattcattttctattcccaagactttttactgtatatatagcttacttaccatatcacttatcataagttcttgatgtataaaatggatatgttctttattttatttcacatcttcaaaacgtgtagtgtctgttttatactttaaacattttcaaatacaaattttataaactacaaagtggtagatctcattgagctctacaactttgatatggaacacatctccatcacatgccgtttgaattgtagatctaagatttttaaaaataaatttggtatttgacaatgaatatttagacccttaaatgatcttttatttagtcagcaagaaagctgtagatctcatcaagcccagcttctaccaatntntntngaantanttngnaanangntntnannantncnattnncntngnanccnnttnnccnccttttnaattngaaaaagtttaagtatacatacgtggtttttctaaaatttgatccatgtctgcagatatccgaataaaattcccagatagtttccgaccgttttccgattacgacggatagtacccttactgtatttatttttgtttccgagaataaaaatctgaattcgtttccaaatctagtaatttccagatagttccaaccgaacctatccaaatccgaaaaatggtccggatggacggaaactattcgtaccagttttaaccctatgtcaggatacattgcttttgaggatcatccaccgtgtaacttctatgcagatgcaaacctttgttttattcatcgattaatcagtttcttcgtcccagtaattcatcgaacaacaatgaatcgtataggccggatattaattgtatctaacgctcaaactagctattaactacgagcgtacgtgaatcggatacaacacttaactacatattacatatatgaagtgatcgactaacacaaagtcatcaacagcatacaaattcaccagtatcatttcaacacagttagtttgaacatatcttcccctgcagtacagacgcagaattattgcagaggatcgatcgatcgatcatatcaccagcagctttaatttctccaagcttttagcccttgcactggtagatgttgaggcagctgcgtccgctgtacggctggcccctgccggggcaggagccgtagcacgccgccttgctctccgtgagcccgttgtagctggcgtaccggctgtcgtagaggatcctcctccgcgggtacgctgcctcctcctcctccaccacgctcgccaccacgtcctcgacgtcagccacccggccgcgcagcacgtgcatcggcaacaaggcgccgctgctgccgacatccaccgccgccaccagcaccaacgccgcggcgacgacggtggcggcgaagaggagcatcagcttcatactgtatgtcagtacttgggctagctgctagctagctgagacgaataaaaatggggtggtttttgtgctgtttagctatgtatttaagaggaggtgggactggattggagggtactggatcgaggaggtggtggtggttgagggcagggagagagaagagcgagagctactctcttcgtcaaaaaaaaaaactaatttttagtttaaatctggatatatatatgtgtctaggttgaaactcagaattagtttatttttttatggagaaagagtaggatcaagcaactgaggcagcgacaggacgcctaacatcgcatgtgaagctagaggacgagagagtccagcggagcgtgtctctcatgatggatttgattagcaagaagcgactgctttctctttggaagcgtatggtatggggttcgatcgtactgtgccatccggcacagggtacgtacgtacgcgtgcaggagttaattaaaacattttggatggtgaggacgaaggattaattaattggcagctatgtacgtacggctgttaggtgcacttgatgatcgttagttaatccctaagcagaacagtgccatcgccatgacggaatttggggagtatacagtcgtttcgaaatatatatttagtttcagattttggattcatcttagggttgttttgtataccatcctgttttttggggatacgtcttgctcccacgcaactacgcaaggtacagcacggtaggacagtagcacagtagcagtagtgccttatgttttcctagcctcagatgcacattggaattccgacttgtggatgcacacgctgtgccgagcttgtcgcgccgactgccgacttgccgccttcctcagagacgccggccgagcacggcctaataatccgatgggctgggccagcccaagcacggcccatgtgccggtccacttgatgccggccgggaatataataagttcactctaggtcccttaatttgtcgctcagttaatttcgtccctagacaggaaaaccgggtacagcacgtcctccaacttttaaaaccgtgcaatcgagatccctcggcagtatttgaccccggttttgaccaatatggcgcctacgtatattgtttgactaggtcttcgtccgacgtggcacttgcgtggcgcttacgtggcaatttgatccaaatataataatgaaccctatggggcccacatgtcagtttcacacaaaataatgaaaaaaaaggtagggcccatgtagccccacatgtcatctctatcctctctgtttctcccttcttctctctttctcccttcctcggcaagcatagcaggttgggtggtggtcggagcaggccggtggcaagaaggccccctctccctccttgcccgacgacgacgactactagcaccacacgccgccgccccaccgggagatgacgagttggagatgagatagtggagagggaggacgaggggaggccaacgagggtggcggagaggcctcccggcggaagtggatggccagcgagcgcgcgcgaagagagagaagaacggcggccagcggctggagggaagaagggcggtagacggcggccatcggggagaagggtgatgactagcaggaaggagctaggcgacgacgacctcgagcggaggctgtggatccgctcgccgcccttcacccctcttcctcctggcatccttcgtccctccccgagctccatggcttgccgggaagcaccacgtcctgttgcggagtggctcccccatgacaaggtgttagatgcacacggcgagctcagcgcagaggtagtcgacgctggggcgggacatgcggaaggtcgcggcaccaggggatgtgggcagagcggtcgagacatggcgaatccactcgtctccctccccacctccatccatggcaaccctgcagcaggctcccctccccccccacccccagcggggctcccccttctccatgcgcaccccgctccgcgcccctccgtacgacccccgtctccggagctcccgcctccctccgctcccatgggcgccgcgccgcgtcggcgtcggtctcaaactccagcatcttattccgatggaagggagaggtgccgctcgcctctgcctccgctgctagctagaaggtttcctcccacaagtctaccgccatagcgtcgccgcggcggcattcacgccactccccccatcccactccatcaggagccgcgccgcgaagaacagaggaagaagagcagcagcagccgcaggggattgaggatggcatgtggggcccatgtaggccccaccattttttattatttggtgtgtgaaactaacaagtaggtcccacgggtattattatttttccaaatcgaattgccacgtaagcaccacgtcagctaaaaccgctatataaatcgtcgagggacctagtctgcaccggttttaatagttgatagaccagttatatatggtttttcggttgaatcacgaaaattggattcgttgacaagttagccattcccaaactcaaaccacaatccaccaaccaccaacaccagagcgaaccgggagcggtgtttggatttgcgccgggcggcccggtggagaaggcgtgtcgccgcgcggccgctatcgtgaggcaacgagctcgctgcttgcctgctcgcacactgcctctttcagcctatgcctccatggtgaagcaagaatgaaaattgatagtatcagtttctttttcccgtgccgaagtgctgatatcactgtgtgttggatttgattacggcatctaatcattaggcaggaaaataaattattgccctctaatttttttgaggcatccactgcatattcttgagacaaagtttttgagaaagcaatttattaataatagggatacaaagttattgtctcattaaaaaaaaacttatgccctagaatacagctttcaccgtaagaaaaaaaaaagtacaacagctgacttacactatcacatagattataatttatcacatacattatcattttaattggcacattcgtcatcattattgatgccaaaatccatcaaacactgccattgcttcaacaatctgctgccatccagtcttaaagggcaaaacaatttacacaactatctccaatgcaaggcatgacctacattcttcaataattcttccgatcccgttaaatgcttactatgaaggtatagaacacgccataaccaatagacttgtgaagtgagctaagataagaatagtgtgttgtttttcttttcaccacccaaggagatcgacatccgccattaaacgtttgatcatgttttgtgtgattgcctgattggtgctgaggtagtgggtaagttctgtatataggttcaagtttgacctggtgcctagagaggagagttgttctactcaggcacaaattgaaggtgcttgatctactcaggcacccagcgaacaactcctaacttcatttgatatagacgaaaaaccctatctgttgaaagtgtcaaaaaaatctttagaaaaatcaagatccactgcatcacccattgatttgttagcaatctctacaatttccagctttttgtgaggatcaagtatgaaagcaagagaattaaatatgtggaatagcagtgaagtatttgagaaattttgcttccatgagttgaacaatgggagctcaaattctatcaaaccgattttcttcaaacacaaatgacaactgctaaagccattcaatcaccaaacaagatgtattatagtgaactcaagatagttggattatggcattattagatggctttaagaatttacgcaagcatgtagtgatgtcccataattgctccgtaaaaatcaaaatctcaccatcaccatccttattgattgaattgatgaaaacaaaaattaattcctcatatcctttcacatgacgcagcaagatgtatgttgccgtcgggattacctagcccgttgtgagtgttcttgccatactcgtcattgtgtcgcccctagcacctagcatcgatcgtgcccctttcgttgctagatccacagctcgaggcgagtagggcactatgaccatggatggtttggtgacagtaccagcgcgtgggagcttggtctgcttgatgccgaaattggtgatgattgtgggctccacactctccctagaggcgatgtcacgatggactcagattgggatccaggtgaaaagttggtttcgggtgtctagaatggtgacagctgcatcctttgatgccatgaccttgttgaaggcgtcgcattggaagcccccggctccatgtacggcgtgataatgttgggccgtcggcctaaccttccttcctcccgcgccctctctccctccttgtcgggccggcccattgcccctcctctcctccctccgggtcatcgacaggtggggcccaactatcggccccgtcttcttcctctagccgcctgcgcccggtgggcaaccgccgctcccacgtcgccgtctgcgtctcccgcgcccactccgcgtccacgcgccgcgcccacatcgtcgtccgccgctcctccgcttttcccgcttgcgcgcacgcccgcaaatgggcgggattcgatttgaatcacatcccctctctctctccactcccccacatagccggccaaatcggccacctccccggccacgtccgcccctcccccgcccataaaaaccctcccccgggccccctctctcgtttcccactctcgccgccctttctagtgcttcctaccgccaccgcaccgcgctcaccgagctccaccgccgccgcccatctccggccgcgcaccgccgccgctagagccaccgccgcgctgcgcaatcgccgccgtcgcgctcaccaagcccgcccgcacctcggtcgccgcctggttgtcgtcaatcgctgccggagcccccttctccccgaaagccggtgagcttccccatcccctccgcctccggccgtcaatggcgtgcgccgtggtcgccttccctactcctaaccccctttatgctctctactaaggtgccgtcgtcgcctcctcttccgcgcgcgcctccgctcccgcatacgcgtcgtcgcgctgcaccgccatctgcgctgtcgcccccgtcgccggccactgccgctggccggtcgccgggcaccggccgccgccgtgagccatgcctgggccggccttggcgccgcccgtccccagctgcccgctcggcactcggccgatcgtggccgtccatcccatggcccgcgtggccagccacgtggtgccacgtcagcgccacgtggtacaccaccaccccggccccgtggacccggtccacggtggaccaccccctttgagccactgacctatgggccctgcctgtcggtgctcctccctccccccccccttcgctgacatcagccctgggcaatattgcgcaacaaattgattaaggactttttctttattagaaaaaacacagattatcttctaaaattcttatttaattcattcgagctccattcaagtctcagtaaattcataaaaatccctagaatccattaaaaatggttttgttctctgtttcagtagtcttatagtgtgttttgcttgtgtgctttgtttgtcgcatagatctcggccgtttcgtcgatccacggttcctcgaagacgttgctgaggtctcatcagtgcgagagcaaggcaagtcatgcattacaattgattatattgtacccaatttacaaatatcccgcatttctattaaatgttgtattcttttacaatgtcatgtgggatgagtcctattactcagccatatattgtttaccttatgccattgataacttgggtatcaaaatgattggatgttggtttaggaaatgcttagccatgcctagttcaactagtacacaaacggagatcacattattacatagactttgtctattagcatagctttggattggtgccaccgcaatggtgttaattaattaaaatacactgaatggtgggctgtgggtgcatggtttcgctggtcacacccatggcaattaaggaccggttcacgggaaaccctaggagacttaccgtgcttaccacaagcgggagtgggtaactgcttgatctgaagtatagctcgaccctttcctaggcaccgatggtgagggtaggcgtgatggagttgggtcggccggggtatccggttgtccagctgccggattcatcgcggcgcaagaggggaccgcccactgcctttttaggggtgggggtgaaaccttagcatggtgtggatggttatgggagggttatgcggagggtcttgtcacaatttccccctttgcagtatcatggtgatacttcggggcatggcgacatgtgtggaatcgtgtcttgtgggtagagttgtacacctctggccagagtaaaactattcgaatagacgtgcccgcagttatgggcgatcaaccagattcaccgtgattagtctcacccctagtttagcttaatgaactgttgtagttcaggtggttggttgggcccgttgcaacatgtgtagcgttggacagtgattggttaatattgactaattactacaattgttttacatctttcaactactgtttttaaatgtatgctttattgcaaatgaacccttagcctcctttggttatatcctacatcatacctcctcttccggtatgacttgctgagtacagtgagtagtacttagtcttgctctcttttcccccacaccagagttgaagttcttctcagttggagatgtctcgaagaagttggtttcgtcgctgccgtcaaggatgcctgtggaatggaatcgctcgctgcaggagtcaagtcttcaagcttagctcgcttttatcttttccgctgcatttgtaatcttttatatttttgtaagacgtggatctgtatgtcaataattgtcgtttgtgtaccctggttggtcctggacaagggtttaatgcatattcagcttagaaattctggttcgtgaatttctaggcgtgacaagttggtatcagagccgaccttgaccgtaggacaagccaactggaaaacctaaaagccctctgaaaccttttcatctgcatatgctctttgcacttggatttgtttcgggaaaattttggggtatgttcttttgatttgtgggaaaaatcttggtcgctcatttaattggatttctcgactagggaaagtttattcggaatttattcgacagtcggtcgggaattattgggtgatatgcactaagtagtgtataggttcgatggggagattttatgcatatcattataactatgcatctattttatgcattaatttattgtttagtcagatgcattagtatctttatctgggttcatgaaaaatgttctatgcataaaaatcgccatgctcagttatttgtttgagtcatttgttgctttgtttatttggatttgagcatgtgttgattcctatcccttgtctattttagatgtcagacctgttcttcgatcgcaagcgtcgctccgagcttcagagtcgccgcccttagctttatcgtcttcttatttttgtttgcttgctactttccgtgcttaggtttgttggttgtgggttagtcggcggtcgatatcatgtgtcagtggtatggctgctttaattaggagttgcgtgcctctttttcggtgttttaatcaagattaagataattgcacctaaatttataagaaagattagtttctaagccccctgttttccttcatttttctcatatttctacatatccccctctagatggtgaagacaggaatggttcccgtgaatccaacaacgtcagtggcagcgaagagcagatcggtggagcacgtgccagtgatgtatctaacagcagttcatctccaccgcatgagaacccaacgatcgctcaggtgttggataatcagactcagatgatgaca

SEQ ID NO: 50929 - DNA, 1981 bp, Oryza sativa
  unsure (1)..(1981): unsure at all n locations
gccatctgcaccatcacccccatcatcgaccgctgccgttggccgatcgccggtcaccggccgccgccgtgtggcatgcccgggccggccttggcgccgcccgtccccagcctgccgctcggccctcggccgatcgtggccgtccatcccatggcccgcatggccagccacgtggtgccacgtcagcgccacgtggtacaccaccaccccggccccgtggacccggtccacggtggaccaccccctttgagccgctgacccgtgggccctgcctgtcggcgctcctccctcccccccccccttcgctgacgtcagccctgggcaatattacgcaacaaattgattaaggactttttctttattagtaaaaacacatattatattctaaaattcatatctaattcatccgagctccgtttaggtccattcaagtctcagtaaattcataaaaatcccaagaatccattaaaaatagttttgttctctgtttcagtagtcttatagtgtgttttgcttgtgtgctttgtttgtcgcatagatctcggccgtttcgtcgatccgcggttcctcgaagacgttgctgaagtctcatcagtgcgagagcaaggcaagtcatgcattacaattgatcatattatacccaatttacaaatatgccgcatttctattaaatgttgcattcttttacaatgtcatgtgggatgggtcctattactcagccatatattgtttaccttatgccattgataacttgggtatcaaaatgactagatgttggtttaggaaatgcttagccatgcctagttcaactagtacacaaacggggatcacattattatatagactttgtctattagcatagctttagattggtgctaccgcaatggtgttagttaattaaaatacactgaatggtgggctgtagatgcatggtttcactggtcgcacccatggcaattaaggaccagttcacgggaaaccctgggagacttaccgtgcttaccacaagcgggagtgggtaactgcttgatctgaagtatagctcgaccctttcctaggcaccggtggcgagggtgggcgtgatagagttgggtcggccggggtgtccggttgtccagctgccagattcatcgcggcgcaagaggggaccgcccactgcctttttaggagtgggggtgaaaccttagcatggtgtggatggttaggggagggttatgcggagggtcttgtcacaatttcccactttgcagtatcatggtgatacttcggggcattggcgacatgtgtagaatcgtgtcttgtgggtacagttgtacactctgccaanggtttaanannnccaanccttnaatntncgnanaataangncncngntnggcncncgncggtnntaatgggcgatcaaccagattcaccgtgattagtctcacccctagtttagcttaatgaactgttgtagttcaggtggttggttgggcctgttgcaacgtggagtagcgttggacagtaattggttaatattgattaattactacaattgttttattgctttcaactattgtttttaaatatctgctttattgcaaatgaacccttagcctcctttggttacatcctgcatcatacctcctcttccggtatgacttgctgagtacagtgggtagtactcagtcttgctctcttttcccccacaccagagttgaagttcttctcagttggagatgtctcgaagaagttggtttcgtcgccgccgtcaaggatgcctgtggaatggaatcgctcgctgcaggagtcaagtcttcaggcttagctcgcttttatcttttccgctgcatttgtaatcttttatatttttgtaagacgtggatctgtatgtcaacaattgtcgtttgtgtaccctgactggttttggataggggtttaatgcacattcagcttagaaattctggttcatgaatttctgggcgtgacacatatcctc

SEQ ID NO: 50930 - DNA, 786 bp, Oryza sativa
ctgcagtggtaagtccctgaagggtccgttgggatggccatgcccgacgccaccttcacatggtgagaggttatttattattaatcaatatatataagcagcaacttgcggaatggacaagtctaaaatctataaactacgagattacctttattgataagttctcaaagggaatatgcagctcacatggtgtccaccgagtgatgacattaacggggcaggtggtttcgtcctgtatttgcatggcgtccatgctctgtgatcctacctgccccgttgaggcgcagctgctacgattgcctgaagggctgaccattgcaggaggaatgtacggctggggatctagggaccgatgtgtggccatgcgttcatccaccttccttgccacctcctcttgcatgctaagctcgtagctcgataccctgtactcaagatctgcaatcttcgcctcggtatctctcttgctcctcattcgactcctgtacgtgtggatgtcctccttgaatccaatcttccaaggaatcacccctttccctcgtgtttgtcctggatgcttgggagtctgcagggcgagtgacagctcgtccttctctctgtcgggtcggaacgtgccctgagaagaggcttccactgcgtccgttagtcgacttgcagcctcgcgtatctgatcgctgaagaccagggagccatcaactgggttgagcgttccaccgtgagcatagtaccagaacttcgattgatccggcatttagcggtggccggttcgatacccctctcaagcaagct

SEQ ID NO: 50931 - DNA, 10060 bp, Oryza sativa
cccttagcttcgggaatgtgttgaagttcggtgtctgccccttcacgatatatttctggtacagatctcccttgatgctatgaaactgttctgccattttctttagagttcaccttttcactatgttctctatacccgcgggaagggtgaatgtctcgagcattgtggtccacagcatctctttctccgaatctgggacaaagctctcatgatctccgcgtgcccttattctgcgccagtacaccgtactgacagacacgttatcctgcacaacccaaccgttgtgtcgtacgtagttcttggctgcttctgccggggcactaggtcggccgtcttcgtccacttccgttatgatgtgttgaccctctagcttcttcgcggcaccttgttgtccgcgtgccctcttctgtcagcggagggttgacttccactagcctcctcctcctcgttcccctccacatccctctccacgttcccctcctggttcctctccgcatccctctccatgttccattcctcgttcaagtactggtttggatcctcgttcccctcttctttgttccagtactggctgcttccctctgcgattgtatcgtacaatatctgttcctcatcgcaatcagccatctgttcatacaagaaatatttgctaagtctataggtcatatttgctttaacaatcatatatgctaacaatcatatatgctaagtctaagtgtcgtatattagaaccctagataataattaaaactataccaatcttgtattaaaactctaacaatcatatatgctaagcctaagtgtcgtatattagaaccctagataatcatatatgctaagtctaattacaaatctaataatcttatattaaaactctaataatcttgtattaaaactctaataatcttatattaaaaatctaatagtcttatataattagtcctatattaaaaatctaataatcttatattaaaactctaacaatcacatatgctaagtctaagtgtcgtatattagaactccaataatcatatatgctaagtctaagtgtcgtacattagaaccctagataatcatatatgctatgtctaagtgtcgtatattaaatctaatagtcttatattattagtcctatattacaaatctaataatcttatattaaaactctaacagtcatatatgctaagtctaagtgtcgtatattagaactgaaataatcatatatgctaagtctaagtgtcgtacattagaaccctagataatcatatatgctatgtctaagtgtcgtatattaaatctaatagtcttatattattagtcctatattacaaatctaataatcttatattaaaactctaacaatcatatatgctaagtctaagtgtcatatattagaattcaaataatcatatatgctacacattagaaccctagataatcatatatgctatgtctaagtgtcgtatattaaatttaatagtcctaattatattaaaaatctaacaatcatatatttacatcacttgcctgcgcgaattctgtcacaccctaaaaatcctaaatatataaattgttgtttaaatggaattattagaatttattttaaaagcctagaagagaagatctaattttaattaataaattccaacataaaatggggccagttaaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctccccggcccaagtcggcccagtccgcagccgcgcgcgctcgtgcgaccgtcgctgacaggtgggtcccgcctgtcagagtcgtcgtcttcctcgcgtcggccgccgcccgaaaccctagcgtcgcgtccgccgccgccgctttccaattcggccgcgtctttcccgatccggtgaaatcgtttgaggggaaacaatcttcgggatctcctctaccttttctcttttggaatcatcgtctaaatcgctttggaagttcgtggattcgaggtcgaatcggatcggtctctttcctccgaaccccgaggtttccttcgcgtcgccggtcgccgtgggcctccgccgccgcctcctagcccctttaaaaggatccccggtgtctcctctacccgccgccaccctcgccttcatctctcgtcgtcggaagcgccctagcgccgtgtgacctcgagccgccgtcgtcgccgctgctccagccgtgcttcgccgtcgctccagtcgtcgtcgtcgctcggggaggtctccatcgtggtcgccgtcgcgtcgccgtcctcgtccgcctcttcgccgtcgctatcaaccgccggagcatcgtcgccgccgtcgacccgatctccgccgccgcttcttcctcgtcgccgacgtcgtccgttgctcttccgccgcttctttggtcaccggtgagttcgccgtgccgtccgctacccgtgggtgccctccgttcgcgccgccgcgccgtcgttcgccggcgagcatgcgtgcccgagccgccgccggtgctgacgtcatcgctgacgtagccgctgacgtcatcgttgccgtctgtcgtagaccggtcgtggaccgatcgatctcggccgtccgttttggataagatcgatctcggccgttcgtttccgtgaaccgccgccgtgcgcccggtccaccgaaaaccctagccgctgacacaataaatccctttttccttttcaaaaataattcattattgcgtcataattcaattaaaatcaatataactgttttaattcgatttaatctttgaaaattcataactaattcatcttagcttggatttagttggttcaagtctctaaatttttctaaaattgagatctacatgttaaaaatatccacatgtactgttcatgcttgtttatgtgctgttctggtgattttgctctttcctgtttagattccgacgtttccggagagtctgtttttgcaggaaaagaatttgaagaattccaaggccagcaaggcaagtcacacagatcccaaacaaccctttgagcatgttgatcccgtttaaagctattgttttcattcaactattgcatttattttcgaatgtcattgggtggaattaacctattgtttgttatagcccttttgttcttgattactttattccttgataccttgggttattttaacttgactagttgggctttatatattggttcagctagatattagatatgattgcttagccatgcttagaaacattagcacactattgggataacttatgactcactattatttaatgatggcttaacgatagctcacgatggtcaatcgtgattggttaattaattaatgtgccaattaaaacctgataatggtgggttgtgagcacatggttttgagagtagtgctcatgacaatcaaggaccggttcacgagtttcggttgtgaaacattaaccgtgccaaccacaagccagcgtgggcaacggctttaccttttgtatagcatggtttattgcggggcaccagactgagaagtggcggagataagcccacaggcgtcgctggggagtcaatgccttgtttataagggggtgattatgatccaggaatggtgcgttgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcttagtaaaagatgctataactggtaataatttgtttagctcctggtttggaatggtatattcctggtttggagatagatctgtacagctgggtatggttgttcagaaaggttgggcctatacaacagggtatgttgtatagcgttggattaatattgtttaattattacttaattgttttattaaattctgaaatgtttattaaatgctgcttttgcaaatggaaccctattatgccatcctttggtatccttgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctgcgccatttatcttattttccgctgcttagatctttattgattgagaggaactatctacctctgtaatgacattttattcgcttattaattagagtaataatggtactctattatcaatttgttattgtgtgcctcggctgattcctggacgagggtttacacacatgtaagcgtttggaattttggatagaaattccgggcgtgacaaattccttcgagggctagctacctctccggcttgagggacaacgacgacgacgtcttttctgcaacatacaagataatgtattagtctaaacgcaaagtaacatatatagtatttcacgtagtgtcgtataaggcgaccgtttgcgtttcattcacattcgttcacgtttcattcacgtttcgttcacgttcgttaacgtttcattcacctttcgttcaatttcgttaacgtttcgttcacgttcgttcactttcgtttaggtttcattcacgtttcgttcacgttcgcgttctcgctaagttcacatttcattcacgttcacgttctcgttaagttcacgttttgttcacatacgttcgttcacgttaacgtacgttaagttcacatttcgttcacgtacgttcgttcgttcacgttcattcatgttcgctcacgtttcgttcatgtggcggcagcggagcggtagcgtggcggcgcagcgtcggtgtggcgcggcggcggggcgtcgcggcggtggcgtgtcccggcggtggcgtggcgcggcggcgtgccgaggcgggggcgacggcgtggcagtggcgtcggcatcgtcgacagtgccggcgcgacgtcgtcggcggtggcggccgcatcgaggtcggggtcggcatcggcgggaggcggagtcggggtcggccgcgtcaacgtcggcggcggcgtcggcaacgaggcggcggtagtttggagagagagagagatcgaggtcgagagagagagggaggcggcggcggctctcaccctagagatgcggcggcggcagaggcgacggaggaagcgacgacgacgcccgcgagacgacggcgagatacgacggcggcgtcggcgcggggatgccttaggcagtggcggcgaaggagaagccgagatcagggaaaaaccttctaagtgttgatggagaagacgggggcgcgcatcgggaatatatatacccgtagatctttagtcctagttggtgagaacaacagggactaaagatattttcccgctatttccaaattctttttaaacccggttagggttgacaaccgggactatagacaatagcactgaatattgaatttcattaaatacgtgtttctaaaatagtaaataatgcattaaaattatttaaagtcgaaaaattaatgacaattacttcgaaaaattattgttgtctgtagtaaattaagtagataatacgtaataagcaaatatatgatttaaacttgttaaaaattctaataatcatatataattagcatatgcatatttaaaattgttaaaaattctaattaacatatgtaaataccacatccatgatttaaacttaataaaaaatctaataatcatatataattagcatatgcatgatttaaaattgttaaaaactctaattaacacatgtaaatgccacatgcatgatttaaaacttttaaaaattctaattatcgcatataactagcatatgcatgatttaaaattgttaaaaattctaataatcatacataattaacatatgccatacaacaattgatttatatggataatcagtacatccaaaatagtttacatcgtgtacataataattacggcaatacattggaggtgacggttgaccgcacgtactttctcctcactactgttccctccttgtgatcgctacgtgagtaaggggtgtcttcatttgataggaggatgctagggtcaatcgtcaccatgaaagggggtttcccatccaactgatcgtaatcctcgtcagtcttgtcctcaaatccgacgatttttcttttgcctagcagaaccacgtggcgcttcggctcgtcaagccctttgcccttctttcctttgctagacatgtccttcatgtaaaagacttgcgttacatcattggcaaggacaaaaggttcgtccgagtatccaaccttgttaaggtcaaccgttgtcatcccactgtcatcaatcgttacgcctcaaccagtcaacctaacccattggcacaagaacagagggaccttgagaggaccatagtcaagttcccatatgtcctcgatggcaccgtaatacgtgccagttgttccatcgtgtcccatggcatcgatacaaacagcgctgttttggttcgtgctcttcatgtcttgggctctcgtgtagaatgtgtacccattgatctcatttccttggaatgtcgcgatcgagccagatggtcccctcactaggaaggccagttgttggttaatcgtctcgttacccatgagatgttgtcatagccacgcgggaaaagtatcaatgtgatgccgtgtaatccatgcatcggacttaccgatgtttctggcgtgaactagagccaagtgctcctcgatgtaaggagccaccaatgaagattgttgcataaccgtgaaatgggctttacggaataaattattgtctaccgtcattattgctttccttccgagagtcccctttccccatagtctcccttcatggcgtgattcaggtaccccgattgggcgaaggtcttcaataaattctacgcagaattcgatgacctcctctgttccataccccttggcgatgcttgcctctggacgagcacggttacgaacatacttcttcagaacgcccatgtacctctcgaaaggaaacatgtattgaaagcagatgcgtcattatattcaaaaatgaaggtggaaatatcaactcaaaactgacaacacattgcaccacatcattctgaagggcttctaatctattcggatcgatgaccttctgcgaaattgcgttcatgaaagcacataactttgttattattgcccggacattgtctggaaggataccccttcttacaactagtagcagttgtgtcatcaacacgtgacagtcatgacactttaggtttgtgaacttattctccttcgtgcttactattcgctttatattcgtggagtatccagacggtacctttatgctctccaagcattcaaacatactttccttctctgccttgctaagagtgtagctggctggactcaagtaatagcttcctttctcctttggttccgggtgaaagtcgccaagttgttccatatgcttcagatcattacgtgcttccagtgtatctttcgactttccatatacacctaggaagccaagaaggtttacgcaaaggttcttagtgaggtgcatcacgtcgattgcatggcggacatccaagaattcccaattgggtaactcccaaaatataaagttctttttccacatcgccgcgtgaccatcttcgctctctataggctggcttccaggcccctttccaaacactactttaagatctttaaccatagcaaacactgttttcccgctgcgatgtttaggcttcgtacggtggtccgccttatgttcaaagtgcttgcctttcttccgtaccaggtggtttgcaacaaggaatcgacgatgacccatgtacacaaacttcctacagtgcttaagatacgtactttttgtttcatccatacagtgagtgcaagccttataccccttgttggactacccggaaaggttgctaagtgtaggccaatcgttgatggttacgaatagcagcactcataggtttaactcctcctgtttgtcctcgtcccacacggggacaccttcctttttccacaacagtttaagatcttcaaccagtggtcttaggtacacatcgatgtcgttatcaggttgcttggggccttgaataataatcagcatcattatgtacttcctcttcatgcatagctaaggggggaggttgtagatacacatcataacggaccaagtgctatggctgctgctcatctctccaaaagtattcatgccatccgtacttaaaccaaactgtatgtttcgtgcgtcctttccaaagtctttaaattttctgtcgatgtttcgccactgcgaaccatcagcggggtgtctcagtatcccgtcctgttgacgttcttcagcgtgccatcgcatcattctagcattccccttgttcctgaacaaacaccttagccgtggtattatagggaaataccacatcaccttagtagaaattctcttctttgttggctggccatcaacttcacctaaatcctctcgtctaatcttgtatcgtagtgcttttcaaacagtgcatgcttctaggttttcgtactcctcaccacgatatagaatacaatcattcggacaagcgtgaatcttctgaacttccagtcctagagggtagactatcttcttagcctcgtacgttgtctcgggcaatttgtttccctccggaagaatgttcttgacgagtttcaataaatcaccaaattccttgtcactaacaccattttttgccttccattgcaagaactccagagtagtatccaactttttgtgcccctgctcacaacctggatacaacgacgttctgtggtcctctaacatccgctccaatttatgggcctccttttcactttcatcgttctcctttgcatcctgcaatatctgaccaatattgtaataccctgaaattaaaaataaaataacatgtttggaattgggccgaatcaatttgggccacgtcgcagtagtccagcccacctcccccacctaataccctagggagaggcgactcccaccttcccagccgacgccgccacacctccccctcggcacctatggaactcacgtctcccctattaaccctactccatggatctccaagaaccatagccctaatcaagaatctgattggaaaaacagatcgaggaagaggagacgagcaggaagagtggtgggttggttttcccatcatattctctcaagttctccaaagaggcttaactctcctgtgcagaggttataggttgttttagggttgtaattcgtcgttattggagggttagaggatgggattaggtgttgtgttttggattagtgtttctgggcgctgtcagctttgctgtgtctctgtatttcgccaattagaggatcaaaatgatttttgctgcgaaagtttataactaggaaattgtagagtttttccttagctttccatattggtaaagtacactttgattgggcgagtagaactccagatatggctgttttaagtgtggcagtctgaattcttgggcagattctgaatcttgtcttgatttgcagtttagggcatctaaatggcagaataaaaatatgggttctacacgaaagttgtaggtctcattctgtagattcccaaaatgtatttatttgcagtcatatcatttttatttttcgagatataaaggtttgaagcaacagtactgtttatagtccaagcggcgttccttgtttttgcgttttgaggtgttgaggccgtagatgcatgttatttactgttctatatgcatatttgagtgtgttttctgaggctttgtttgtgattaggtggtggtccttcagatcgtgtatgataccaacccttcattagaggcaagtgaatgtagctgtgggctgcaggaa

SEQ ID NO: 50932 - DNA, 12294 bp, Oryza sativa
  unsure (1)..(12294): unsure at all n locations
aattcataataaattcatttgaagtcagaatgaggccgttcaagtctcataattcatctaaaaatatgatctacatgtttgtttactttatatgtactgtttatttggtttttattagtctttttccccgttttgcgtgatagcttgtcgtttccgtcgttgcgaaggttcgcgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgagctatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttggtttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagtagagcaatgtttttcgtgattagtctcacacctctcacaataattattgatgttataactggtaataatttgcttagctcctggtttagagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagtctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtagttaatttgatgaatctgtatattaaattgttagtttgtgtacctcggctgattcctggacgaggattttatgcacaaataagttcggaaattactagtgaatttccgggcgtgacaagttggtatcagagccatctcgactataggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgttgatgaggtcaacttatggaggtcagtaaagtggatcgaggaagaaccgaagtgccaactggtcaagatggaatgaagtttgcatcctaccttagaacctatgccaccaaagtgactttgaagaatagttagtaggatagaacgtttgttgcttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtgaaaacaataacaatgaagggaacccaactcttgctcaagttctggctcaacagactcagttaatgaatatgatgatacagcagatgcagaaccagcttaaccaagggaacaacaatgctccactgccgcagaacaagttagctgattttcttcttgtgaggccacctaccttttctagcactaccaacccagtggaagcaggtgattggttgcacactattgagaagaagttggaactgctccagtgcacagatcaggagaaagtcgtgttcgcttcacatcagttgcaaggacctgcatcagaatggtgggatcatttccggatgaacagagcagaaggacaaccaatcacttgggaagagtttactgaaggattcaagaaaacacacatacctgtaggagttgttgctttgaagaagcgtgagtttagggctttgaagcaaaaggatcataccgtggcagagtatcttcatgagttcaatcgtctggcacgttatgctccagaagatgtgcgcactgacgaggaaaggcaggagaagtttttggaaggtttgaaggatgaactgtcagttacgttaatctcccatgactatgtggattttcagcagttggttgacaaagcaattcgacttgaagacaagaagaataggatggataaccgtaaaaggaaaatgactgtattccaggaggcacaaggtagtagccagaggcagcgtatcaagccactccaaattggtgaatcttttcccgctggtccaggacagtcgcaacagttgaacatcggtggtgagatcaaattagagactaatgaaagcaaagaagttaacatcgagcaagctaatcagccggtgctagttcagcaaggtcagtctcaagagaataacagtagtggaagggagcagcaggtatgtttcaactgttacaagccaggccactttgcaagagagtgtccgaagccgaagcatcagcagccgcaaggtcaggttaacaacattgttgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcctgattttcgtttcaggatttataaattatttaataaatcattaatagaatttatattaaatgttctttaatttacaagtgaagttaaatgtgggaaataaaatttcctaaatataaagcatggatggatttaatttttattaaattctccatgattaagtcaactctctgaaatattctcggatctttcggagctcaattcctaaatgatacaaagaacagttcagtaattatttgatcattaatgatctaattatttttgttaagagcttttcttgtttaaaaatccttaaattataaattgttgtttaaaaggaattattagaaataattttaaaagcctagaagagaagatctaattttaatttgttaaatctcaatataaaattgggccagataaaatttcattaaatactttgcttaattctataattcctagatttttctgggatttatttgagctaaggaagtatttttaataaatgaaattgcatttaaaaaataatttaaattgaaaaaggttttaaaaagtcttcttttggctttgggccgaaagccggcccaaaaccctctctctctttccctcggcccagtccggcccagtccgcagccgcgcgcgcgcgttcggtcgctgacaggtggggcccgcttgtcggatccatcgtcttcnncaanccnccnccncccnaagccctatcgcaaggcagggccgtcttctgccaaattcggccgatcctttccttctccggccgaatcttttgaggggaaataatctcctcgatctcctcttccttttctcttatagaaactccggtcaatttcctttggaaataggcggattcgagtttgattcggattcgtttttccccaacctttccttctcgtcgccggcagccgtgggcctccgtcgccgctcgctagcccctttaaaaggatccccgagctctcctctacccatcgcctccctcgccttcgcccgccgtcgtgtgtagcgccctagccccgtgagcttttgcgccgccgtcgccgccgccgctccagccgtgcgccgccgccgttccagccgtcgccgtcgctcgggaaggtcgccgtcgtggtcgccgtcgcgtcgccgtcctcgtccgccccttcgccgccgccgaagaccgccggagcaccgtcgccgccgtcgacccgaaggttgccgccgcttcttcctcgtcgccggcgccgtccgttgctcctccgccgttgctttggtcatcggtgagttcgtcgcgccgcgctctacgtcctggtgctctccgtttgcgccgccgcgccgtcgttcgccggtgagcttgcgccgcccgagccgccgccggtgctgacgtcatcgctgacgtcatcgtcgccctctcccgtgagccggtcgtggaccgttcgatctcggccgtccgttttggatagggttgatctcggccgtccgttcccgtgaaccgccgccgtgcacccggtccaccgcaaaccctagccgctgacacaataatcattcttttccttttcaaaaataattcattattgcgtcataattcaattaaaatccatataagtgttttaatccgatttaatctttaaaaattcacatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcctaattcatctaaaattatgacctacatgtttgtttactttttatgtattgtttatttggtttttattagtctttttcctcgttttgcgtgatagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggaccttttgttcttgattactttattccttgataccttgggtgattataattggactagttgagctttatatatattggttcaactagatactagatataattgcttagccatgcttagaaacattagcacacaattgggataactaatgtttcactatcacttatggttatatttaatggtagttcacgatggtcaatcgtgattggttaattaattacttgccaactaaaacttgataatggtgggttgtgagcacatggttttgagagtcatgctcatgacaattaaggaccggttcgcgagctactgttgtgaaacattaaccgtgccaaccacaagccagcgtgggcaacggctttaccttttgtataacatgattcattacggagcaccagactgagaagtggcggagataagcccacgggggtcgctggggagtccatgccttgtttatgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattattgatgttataactggtaataatttgcttagctcctggtttggagattagatctgtacagccgggtatggttgttcaggatggtcgggcctgtgcagcatgggtctgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaatttccgggcgtgacagtagcgcccgttccgtcgtggcgcctagcggaaaaactatctcttaaaaaccctagttgcgaaatctgtttctttgcttgttgtctagtgtccgtgccatctcagatctcaaatccccaatctatcgtcgagttcaatcccgaatccaaatccttcccaaatcaaatcgctccgcaaaagtctatttagcctccctcgggttcgatgggccgaatccctctcggcccatctccccctccctccccggctctgtctctctctctctccccgctctaccgtgagccgcgccgagccctccctcccgctctcgctgccattcccgccgatgccgcccaaatcgtcgcgccgcccgcgcgcgcgcgcaccgtggtggccgaccggccagtcaccgccgccgtcagcgcctgccgcgcttgccccgcgtctgccgcccatgtcgccgctccactccaaaccggtccgccgtcatcgccgtcgtcatcgacccggccccgccaccgccgcacgctggcttccaagggacggaggctgagccccgccctcctctctgccgcatcgccccctctccctcctccttttccccaagtggcaaggaggcaagccccctttctctccccccttttcccttttccctcccgccggcatcatccttccctccctgtcgccgatttggccgcgaccgccgagcgcgagctccctcccttgaccgcccaaggtcggtttctaaaccgacatcgccgccctataaacccaggcgccctcccttccttttcccctcccaatcttccccgtttttcgcccgcgccattgccgtcccctctgtcttgctgatcgccgaccgacgccatcacgtgtgccgaaggagtcggtgcgcgttaggacgcggaacgggactccggacgcaccctctcttcctcttccccggcccgaggccggagagatcgctcccgtgccgtcggcccatcgtcactgcgccccgtccgcacggtagtgcatctccccgttctccttcctcaatccatctcttccccttagttctcggtagtagcatgtgtagcctccccgtagctagccggcgccgccccgactgctaccgtctctcgccgtgtgctcgccgccgtcgccgcccgagctcggcaacgcctctcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgtcggttgccgccaccgcaatccgccaccgtcaagcatcccccgtcgaatccgagccattggctcgtctcccctcgtcctgtgcaacatcccggtgtgctcgccttcgcctgaattgccatggttcgctccggccctcgccgccgtcgtccgccgtccgttccgaccggcgtcgtcgtctacctcccaccggcccgcgtggcagccacataggcgccacgtcggcgccacctcggccgtgaccgggtcaagcagaccccggtccgccgcttccctccgccccctcgcgcgcgcggtccaccgcgagccgtgaggctgcgagtgggcccgccgcaccgcgtcctccgcgaaccgcacgcatgcgccgcgcctccctccccaaaccctagcacgccccgcgtgcacctcgctcacggtgagccgagtcgacgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtgtaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagtcgtcccgtttcgcgtgtagtttcggagcccgaagacccgcagtgcgaggattttgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattagcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttggattttacaaaagacttggaaaacccgacacctgggtcggtgcttgcgaactaaatgaatttccaaaatcgcggaccggggaacgtaccgggtgtacggtttcccgttcttgcacttaaggaccatttccttggaatttcatccgaacacatgacaagtacgaccacatgggtggaatgggacacccctggctgagtaactagcttatcgggggagccatgatgctaagagacatgtggattcgccgggtggtgtcggagaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctcgatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatttgcggctgatgggatcagccaggcccgggtggccgtttgaaagctgttggccgggtgccaatcttggtcaattcaaaagactaatacattgcacatactccgaccggacgagacgcactgtctcatccgtgtcgtttgagaagcactcacttagttgtttcagaaaagagttcaaataaaatcaattgcaaaaacaacagcctttctctgaagcctgcattaaacacttatttcccatggctggctgagtactcccgtactcacccttgctctatataaataatcccccccagttgctgaagaagatgaagcggatcctgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttgcgctcgggactagttcggggcgtgacaccatatatgagagacaccattcacctatacttcaaatacaattttctaaactactcatctaatctacgatccgattacaccgttgtgttcataacaattaaatctttacaacaagatctcacattattatattttgatgaaaaatcacaaattacttttatgatatgtctaaattacttttagatttcactaagttacttcttagacatacaaaagtaaattcagaaagctttaaagtaatttacatatattatagaagtaacttataaaaaaaagtaactttaattaatacactttttcattgaacaaattatcatatatttaattatcatatatataagttactttttgatttgattaaaatacttcctataaattcataatgctctgaggtgattacttttattattgtttttagttaatttcataatttgtgctgattaatttaatttctagatagagtcatgtttttatctctacaacggatttacttcaaataacatgccaaagttacattcgttttgttctaagttatttctataatatatgtaaattacttctaggctttactgaatttacttttgtatgtctaagaagtaacttagtgaaatctaaaagtaatttagacatatcataaaagtaatttgtgatttttcatcaaaatataatcatgtgagatcttgttgtaaagattaattgttacgaacacaacggtgtaatcggatcgtgtaatcggattatagatcggataagtaatttaagagaaaatttcataagaagaaaaaaatatgcacaacctaatagcaaaaactacttgcatgcatgtctgtaatgctactagtacttttctcacgtaactgtccgcgtcgctcgttaagtctaaatcgaaatgcctcttgaaatagtttttgcgattgctctatgttcattttttcttatgtgaattattagagctatttcttctacttcaagtgccaagttttatgtttccatattataaggttcataacttggtgattctacggaaatttagttcatccagattggagctaaaatgaattttatatgcaatttacaagttaacctatttttctgttgattagatattcactaaggcattttccttatattttccagattttaaaaacatagggcccactggtcagtgagagatcttttgcagaaaggtccctagagtgtgggggaatcaaccctcactccaaaaacgtgtctatgacatagtttataaagactcccccattttcttttatatttacgtttcagttcttgaccctcctgtcagtgatttagatgtttacatactgagacctacagttgttcgaattctcaaaacaaagtccctgcttttctctacctcgttcattcgatacagaggctgagcagagccatggctgagctcgatctcgagctcaccggcggcaataggtggctcctttggggttgaggtcaaaagatgaaatgaagagcacgctctcgggattccattcctctacttttctcggattgcggtcatcggagtaacgccggcggcgagtccgagcggcggctgtgcacgggctgctactgcatgtgcgcctatagccatgtagtgatcaaatggatgcatgaatgtggcattaggaagtgctatgacgctcaccgaagcttgaccgcggcttgaaaaggtctggacagcggtgacagtggaggagatggctcggcggcgatggatagcgtcggcttcacggcgacggtttgttccggtcttcgggctgccaaggagaggaggggaatggatcaaagatcatctaaggatgcttcatatgcgaggaattgcgccgaagctcacccgagagcgaggaacggacgacgttggccggcg

SEQ ID NO: 50933 - DNA, 775 bp, Oryza sativa
ggccagcccaagccgactcctccctcctccctaacccctccgggtcaccgacaggtggggcccacctgtcggccccttcttccacctcccgccgtcgaaaccgccgcctactgccgccggtttccccgcttcccgcgcccactccgcccatgccgcacgcccacgtcgccgctcaccttccccacaccttccgctagctcgcgcgcctgcaaatggcgggggatttgctcttttcccccactctctctctcctcctccacttcccccacgtcgccggctaaatcggccaccttcccggcctcgtccgcccctcccgaggccttataaaccatccctccattcccctccaccttttcctctttccaccgctccctcccgtgccctctatcgctcccacgccgccacacccgccgccgccgccttttccactcctccggccgccgctcgccgccgctggagccgccaccgagccaatccgctgccgccattagcttcgccgccgccaaagctaccccggccgccgcatccccatccaatcctgccgtcggggcccgcttctccccgcgcgccggtgagtaccaccatagccgccgccgtcagccatggctctcgctcgtcgtggacaccctctctccctctaacctctcacacttcctctcttaaggtgtcccggagctcggccgccattcgccgtcgccctccggtcgctcatcgtcgccgtttgccgtcgtctcctcccgcgccggccgaaccccggtgagaactccctcccctt

SEQ ID NO: 50934 - DNA, 9410 bp, Oryza sativa
  unsure (1)..(9410): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgtccgaataggcggaatagctgctaaataatgcaatatttctaccttagtgttaaaatgcaaaagtttcgttgttgctaaaagaaaacgagcatgcagttcgtacttacccccttttttttttgactggagcaaacaaattaattgatgaaataatcgcgttgagtttataccctcattatggttatttattttattacatgacgttgtaaacattttgacacatgtttgatcattcattttattaaaaaacattatcattatttattttattgcgacttggtttatcatattataggtactttgcacaaaagttttaaataacctaaatagtgaaacatgtgtaaaaagtcaatagcttcatctattaaaaaccgaaggtattatcatttaaacatgatctctcccttgacaactttgactattattttcaaacaatgtcaaagtgaatagattcgaaggtaagatattactatagttctttcgattagatttaatctaatgataaataataggttatttaaaaattattgttggtcaaagttgtacaattcagagtcaaaaccgacaagtatttcttaatgagtaactatacgagcataacggtagtagaattaacaccaatggtatataacatgtcaaatggatacaccaactaatcatatttcttgacaatcgcagaaggtggatacatcaagataaaacgtaagtccaagatcatcagttcttttccgaacacagcacagttcattatgcatcaccaacaaaagtctaaataaatattatttgtgtatttttttttcaggtagcacatttgcagtagtaatagttttcacagtcatgctgattgctcttatcattgcactcatgagatacatgagcaaaaagagcaaagctgatgagaccattgactcaacaagatcttctcaaggttgataaacgataaccccccctacaacacatgaattctgacaaacttcagatacaaatcaacctgcacaacatcatctactaactactaactttcattatccaccaagacaacaaggttcatggggaggtgatcaacaggtggtcagggctgtacaagttcagcaagggcgagatcgagaaggcgataaactacgcgaacagcaagatctgccttggctccggtagcgcaggccaggtataccaaggagtgctaccgagtggtcagcttgttgcgatcaagcacatccacaagtcggccatgtccgggtccttcatgagggaggtggaaggcctttccaaggtgaggcaccccaatctggtctgcctctttggctactgtgatgatgggggtgaccagtaccttgtgtatgagtattgtgccaatggaaacctggctcagaaccttctaagtaagaatagttattttgagctttgagcagagctgatgacagttctttttttggtttcaaatttagtggaaaaaatttaggttcagctatgtttggaatgatccttttgtcttgattgacagggagtgactctgtgctgtcctggccagcaagggtgaagattctgagggattgtgcatctgtcttgaggtttcttcacacacaccctgatggatgcattgttcatagagacattaaggtgaggacagtactgaatggttttgtgattctagcaatgtgaaccataaatttgatcaaaccattacccactggtgtcctgttctggttttgcagctcactaacatcttactgacagagagcatggagcccaagttatctgatttcgggctggcgaagatgttgcaaatggaggagactaaagttttcacagatgtgagagggaccattggctacatggatccagagtacattacacattccaagcttacttgtgccagtgacatctacagttttggtgtggttgcactgcagctcctgtcaggaaggaaggtcattgaacttgacactgttgccagggattcccttacaaagaaggtaaaaaatgatacttctaaccagcatatgtttgatgctacgcaatctataacaacctctctaagtatgcaattatgatttcacttagaattttaggagtaatgctcactatctgttctcatattagtgtcatttatgttcaaaattcaactgactatatatgttaagacattttaaattgtttttggaataattatctaaaagaatggaaatatgattgtgctatgaatatgcaacacccaaaacaacaaaaagaagtaaaactaaattctatggaggaaaaaaatgtaagtaatgcaactaaatgcaaccctagaaaaaaaaatccgacaacccagaattcaaagataaaaaatgtaaaactcgttgttttctaaagatagttattgtagtcatcgtctttcaaatgattatgattcaagtgcacacacaacttttccaaatgaaggccagggatgtggtgagcgggaaaaaaccattggacgaattcatagacccccgtgttagagacgaggttaacattgaagatttcgtgttgatattgaaaattgcggtcctctgcgtggcgcattcaagtgtagggcgtccaacaataaaggatgtttttgaggagatggacaaagcattgacgaatacagattcaaaggttagaattacattgtttcttttgatgaactttcttaaacagactgtgaatatattaatttacttgtcattttatttaatgctgcctctaattctgctgatcaggttggcagagcgagagaagagataaacccatccagtacaatccagtatcagtatgcaacggggcttaacatagtatagtgtacatttccagaagttacaaacagtttcttgcatggagtttcagttgaatggaatttccaaggctgcactttgaaattggactgtaagaaagataagagagctatgccaaactagtattgtacttgcaacggtgttggccctgcaactagtggttgcttatgggtgatgtaagtatatatatatatatatatatatatatatatgtacatgagcaagttaagaacctagataaaatagtactagatccattattaaatagtacttgataggattgactgaaatatcagtattatgaaagtacttgaaacttataaatattttctcaacaataaacttacaaatatttaaaactctacactattatgaaagcacgatgcaaacatatgagttttacgattcaggatatgattaaaactggatccctacttgagatgaacttgtttgctttttcttgggacgacgtttagttgtgtttttttttgtgtaagttcccaacttctccttatttgttttccgctcgcacgcttcccaaaccgctaaacggagtattttttttaaaaaagagttttctataaaaaagttgctttaaaaattatactaatttattttcaagtatttttagctaataatacatactccgtccataaaaaaaccaacctccgactattctaggttggctttttttttttaatggagagagtaataattaattactccgtatgtgctaaaccagtacgtctttttgcgtatcctccgaatagtttttcaaagaaaaagtacacccaaggtccctcaacttgtcatcgaattaaaaaatcgtcccccaaccacaaaaccagatatataatatcccttgacttacaaaaacattcactttaaatccttaggtagttttaaacccggttttatccgatgtggtgactgagtcagcatgggacccatatgggccccacgtgtcagtacgccacgtcactctttcccctctctcccttcctcatctctctctcacttttatcctctctggtatggtggccgcccggcgggtggagaggaggtcgccgggcgagacgagggaggaaatccgacggccgacgacgtggcggtggcggcggtgacgcgggagaaagggagggccgcggcagcggcgcccgccggcacgccgccatgtcctccccccgcgggccgccgtctcgtccgtcccacccaaaccttgtcgatcccttcgcatggtgatcgtcgatgcaagcaggctggtgcaggtagttgtacatcaaattgtagtaggcaacgccaacactgccatggccatcgccgtcgccggagaagaagccatnnnnnnnnnnnnnnnnnnnnnnnnngtcgtcgagcagctcgcgccgtcggggcgaggcaccgttcaatgaattgcctcatcaccgggtcgctcaccctgtacaacgcagcaggcttgatcccctgatcataaacaagcattttcttgatcaaatcgtgtccaagaattcacgagaaattctgcaagaatcgaatagatggtgatcactgatcagatcgtacggagatgactcgcttgtagatttggatggggttggagcactcgctgtaggggtaatcgagggtgaccatctcgaggacgcacatgccgaaggagtagacgtcggcgagctcgtcgtaggactcctcgtacacctcgggagccatgaactccggcgtgcctacgcagcgagtgtggtcgccgccgccgccggcggcggagaggcggaacgcagcgaggccgaggtcgccgatcttgacctccctctggttgccgttgacgaagatgttgtcgcacttgaggtcgcggtggatggtgggcggcgagtgtgcgtggaggtaggcgagcccgtcgaggatctgtgcgcaccagcgccgcaccgccgccacgctcacccgccggtgcttctccctgtactgacggagcgtgccggagacgaagagctcgatgacgaagttgagggcgccgcgtggcgcgtcgacccagtaggccagtaggcgtcgaggcacctcgactccgccgccattgcgcggctgccctgcttcgtgctcccgccccgccgcggaggtagtgcggcggcggcagcggcggcggagtgcgcggtgtgcctgcgcgccgtcgaggaaggggagacggtgcgcgcgctcgcctgcggacgacgtgccccctgtgccgcgccgacgtgccggtgccggcgaggccgacgagctcgacgacggtgaaggggaagcagcaggaaaccgcggacggcgccttcctcctcatacaccctcgccgccagcctctcccgcgccgtcgcagccggaggagccgccccctacccgccaccgccgccgccggagaggccacccccgccgccaacgccgacgacgaggcccgcgccctcctccctcgcgctcggagccgccgccgacgacaaggccgagcggcgcggagtcgtcggcgccgcctctccgccaccgctctctcccgccgacgccgcaccggtctcgcccgccgacgcggcgcctccgcagcggtgctcgccttgtcgcccagtcgcccagagaagataagagaagagtgagagagaggagaaaaggagaggggagagggtgatgacgtgcccagctaacacgtggggtccacgtgggtcccacgctgagaccaaaaccgggtcaaacccaccgaaggatctcgggtgaccggttttgtatagttaagggaccccgtatatctggttttacggttgggggagggacgattttgtaatttaatgacaagttgagggaccttcggtgtactttttccgttttccaacggtcctaatggcccacatatgagatcttggatgggcccgatttgaaatcccacggagaaagtcaggccggcccaaacggcccacgaatccccccagctttagccgagctgacctcctcctccttcccttatccagatcaacccgagccaaacccaaacgccatctccaccgtcgcctcgcctcgcctccacctccacctccactaccaccaccgtctccggcgatggaggccgccgaccccaggtgattcggcggccggtctcctccccgccaccgccgccgccgccgccaatggcgtgcctcgcgccgcacttcaagtgggcgccctgcccccacgcgcaccaccaccactctacttcttctttaccgtcgtcgtcgtcttcgtccacctcggccccttcctcgtcgtcgaggtgctccttctcccgcgggggccccttccgcgtccactgcgcggtcaccgccaccacctccgccgcggcgcccgtcgtcgtagaagctcccggcggggggatgcggctcgcgtacgccgccgccccggactcctccgcgccggctctccaggtgacttgcctcctccactcggttggttgattgggatatcgtatcggattggggactatacgttttgctggtgatggtggtcatggaattgagctgcgacgaagctatttttgttcatttgcttttagtgcgctagtggagagctgggcagtaggcggatgtgggattaggttgttggtttggaacattcaagagtgaaattagatcgaacacgcttaccattacatactttacactaagtttgataaaaatttggtatgattgaacatgaccatgagcttcgttggtgaattgttactggaaattccatacttttattgcatcaacataattcttaatggaaatctttgttgaacagttagtgaagtggaaatttttggaaagagatttgatttcattttttttttcacttcgagtgggtataatttttccttttatatgtacaaggtgccaactacgacggcgccagtagcaatacttaggtcccaaacaatgcaggttctaatttgtggccttgtaaaattggcactttctcatatcaccagtagaattagttgattgctaaataatacatccatgtcctaactcgaggacttgcaaaattagcagttcttcgtctgtgatattcactcttcttttttgtaatttttccacctgtttacagaaaaaaattcaatcggccctggcatcagaagtatttctaaatgaagaggctgttgtaacagctgctgcagcagaggcagttgcccttgctagagcagctgctgaagctgcacaggaagttgttcgtatggtacaaaataataaaaatgaacgtaacaccagaccaaaaaaagctgtggtcaactacttggcaaatgaaatacttcgcacggaaatgaaaccaaacattcttgataaatatagtgatggcattttgtcagaggagatagagtcttatggcatcttgagtgatgaagctgaactagacggtgatacacaggacatccctagtatagctgtgaagtctgctcgtcaaactgagagaagagctcggagaacgagggcagcaataaaggctgctaccatagtccgtacttccccaaaacctgcaacgtcctcaaagaagaagcggtcaaagggcgcctcttctggcacaaatccattaggttccttgtggaagatgacgggtcgcagacttcttacagcaaaggaagaggttgagttctcggaaggtattcaggtgagattactacattataagtaatgaacatattaatcccttcatttcattcatgtgtgggtgcactatccgatcctctcagctgaaaagttaggcttatgtgttctgtcctgctacaatttatacataaccactatcaaggtggatatgaaataagccaaacacaaagcagatgtagaaaaaatcaaacaatttctgaatttgcctttcagttttgagccaaagatggtgaacccttatcctgttattaatttgcttctccaagatgatgagaaatatttgtacgtttaggttgcattcgacagtttaagtcagctatgattcataatgtcaacatgggctgactgagttgaaacttaacaaaatacatggaaattggtgatcttcttgaatagtggttattatatgaaaaaaggcatacccttgacttcgtcaatatattcattggtatacaagcttacaatagcatggcctttgcaatgttttttttgtgtcttgcgttgcataagttttgaatattccaatagtgttcgatctacagtttacaggttcattaaagccactggtggaatctgtgaactcttgaacataaattttatattggaacccactattcaccgatacactagaatcagttgctccttttatttagtatagttaccttgccattgagtaagttttggagttaattatgcatacttgtgttggatatgattaggacctcttaaagctagaagcaatccaagctgagcttgcagagtacaatggtggccagccaaccttcgctcagtgggctacagcagctggagttgatgagagaactttgcggaagcgtttagatcatggtatttattgcaagaatagaatggttacatccaatgtgcgacttgtaatatctattgccagagagtttgaaggtccaggaatggaactttatgatcttatccaggtacatgcatgtactttgtaccttttctggttaataagtaataaagcatctgaagtgctgtatttagcaccaacattttatttttaggtcttcattacaggaagggatgcagggccttataaggggtgctgaaaaatttgatgcatcaaagggttttaggttctcgacatattctcactggtggatcaaacaagcaatgcgtaaatctgtctcagagcaatcacagatatttcgcttgccggtaggtccctcatcctttgttttccctgactgatgattcatttgatgctctatttttctgccccattatgccctccacataacctggttagctagtaactgacggcaaattatgttactcaacattgtatgtacaattttgttctaaaatggtcaatggtggagtgaatgcatttccatatcttgtgcgaatacttatgatgaatttaatgttcctactagtcagtgaccagtgcaaaaatgtttgttaagatttcattccatagcatcaatcattgctgacagttggttgttgcaatatgagacatgatggaatatttttaacagtttgtgttgtcatccatttctcatatcatgaaaaaacacttgcatttgttacatattacatatgttttgactttgcttgaactatttgtgcttatcaatgattcgtataaactaggccttttgattgagataatctcagtacatttgattggg

SEQ ID NO: 50935 - DNA, 13481 bp, Oryza sativa
acgttgccgcgagaacgtgaacgagaacgagaacgatcgaaagaacgagagtgagaacgagaacgatcgaacgaattaacgtgaacgagaacgacaacgaacgtgaacgagaacgaacgtgaatgagaacgagcgaacgaacgtgaacgtgaaatgcaatatatatatgttacttcgcatttatcctaatacatattttttgtatcttgcagaaaagacgtgttgtcggagtcgtccctcaagccggagtggaagagctagccctagaaggaattcgtgcaggcaagtgaagtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagaacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatctgtcacatcctgatttttgtttcaggatttataaattatttaataaattattattagaatttatattaaatgttcattaatttacaagtgaagttaaatgtgggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttaacaaacatttgagaatttaataaagcagttaagtattaaacaatattaatccaacgctatacaacataccctattgtataggcccaaccattctgaacaaccatcccggctacacagttctatctccaaaccaggattgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtataacacaatccaccgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaaaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacgatgacgtcagcagtgacgtcaccaccggcggcggtggctcggcggctcgggcttgcatgctcgccggcgaacgacggcacggcggcgcgaacggaaggcaccaacgggtagagcgcgacgcggcgaactcaccggtgaccaaacgagcggcggaagatcaacggacggcgacggcgacgacgaagaaacggcggcggtcttcgggtcgacggcggcgacggtgctccggtggtctacaacgacggcgaaggggcggacgaggacggagacgcgacggcgaccacgatggcagccttcccgagtgacgacgacggctgaaacggcggcggcgcacggctggagcgacggcggcgacggcggcgctagggcacacggtgctagagctcttccggcgacgagaggcgaaggcgagggtggcggcgggtagaggagacaccggggagccttttaaaggggctaggaggcgacggcgaaggcccacggcggccggcgacgagaaggaaagttcgggaaaatcgaatccgaaacaaactcgaatccacgaatttccaaacgattttagccgatgtttccaaaggagaaaaggtagaggagatcccgaggatcatttcccctctatcaattcggccggaaacggaaaggagcggccggattggaaagcggcggcggcggcgcgaaactagggtttcggccggaggaagacgatgggccccacctgtcagcgggcggacgcgcgcgcgcgcgacggcggactgggccgacttgggctgaggagagagagagcggttttgggccgactttcggcccaaagccaaaagagactttttaaaacctttttcaatttaaattatttcttaaatgcaattccattcattaaaaatacttccttagctcaaataaatcccagaaaaatctaggaattatagaattaagcaaagtatttaatgaaattttatctggccccattttatattggaatttattaattaaaattagatcttctcttctaggcttttaaaattatttctaaaaattccatttaaacaacaatttatatattttgaattttcagggtgtgacaggaaataaaatttcctaaatataaagcatggatggatttaatttttattaaattctccatgattaagtctactctctgaaattttctcggatttttcggagctcaattcctaaatgatacaaagaacagttcagtaattagttaatcaattaatgatctaattataagtgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaatagaaaaatgtttttaaatcctccttttggctttgggccgaaagccggcccaaaacccctctctctttctctctccctccccggcccagtccgcccagtccgccgcgccccttcctcctctctctcagccgctgagaggtgggccctacctgtcaggcccgtcttcctcctcgcgccgctgccggccgaaaccctagccgccgccgctttccaatccggtcgatcctttccgtttccggtgaaatcgtttgaggggaaataatctcctcgatctcctcttccttttctcttatagaaacttcggtcaatttcgtttggaaatcgacggatttgagctcgattcggatcgacttttctccctccaaccctagctttccatctcgccgccggtcgccgtgggcctccgtcgccgctcgctagcccctttaaaagcacccccgagctctcctctatccgccgccacctttgtcttagcccgccgtcgcgtctagcgccgcctccgcgtagccctagccgtcgctgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgccgccgcttcttcctcatggccggcgccgtccgttgctcttccgccgtggttttggtcaccggtgagttcgccgtgttgtcctctacccgttggtgtcctccgtttgcgtcgtcgcgctgtcgttcgccggcgagcgtgcgaggccgagccgtcgtcggtgatgacgtcatcgctgacgtcaccgctgacgtcatcgtcgccttgtcccgtgaaccgcggtagatcaagttgatctcggccgtccgttttggataggatcgatctcggccgtttgtttccttagaccgtcccgtgcacccggactgcctttgatgacgcaataatcctccttttccttttgaaaaatagttcattattgcgtaataattcaattaaaatccatataaatgctttaatccggtttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatcttgtaaaattcgtaataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgtagaccgaatattgcaagtcaagtcacacagatcctaaacacaatcctttgagcattttgatcctatatttaaattctctatttatttcaactgtgcatttattttcgaatgtcactgggtggtgtgaatctattcctttgttatggcctgtttgcattgattactttattccttgataccttgggttattataactagactagttgagctttatacattggttcagctagatattagatgtaattgcttagccatgcttagaaacattagcacactattgggataacttatgacttattattatttaatgatggcttaatgatagtttacgatggtcaatcgtgattggttaattaattacttgccaactaaaacttgataatggtgggttgtgagcacatggctttgagagtcgtgctcatgacaattaaggaccggttcacgagctactattgtgaaacattaaccgtgccaaccacaagccagcgtgggcaacggctttaccttttgtatagcatgattcattgcggagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacatatcacaccctgaaaaattcaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaagagtctcttttggctctgggccgaaagtcggcccaaaaaccgttctctctctcctcggcccaagtcggcccagtccagtccgcagccgcccacgcgcgcgcgcccccgcctgtcaggtcgtcgtcttcctcgcgtcggccgcctcccgaaaccctagcgctgcgccgccgccgtctccttccaaatccggccgctcctttccttctccggccgaattgatagaggggaaatgatcctcgggatctcctctaccttttcccttttggaaacatcggctaaatcggcttggaaagcgtttgattcgaggtcgaatcggatcggcttttctctctccgagcccgacctttccttctcgtcgccggccgccgtgggccttcgccgtcgccctccaacccctttaaaaggacccccgagctcttctctacccgccgctaccctcgccttcgcctctcgtcgtccgtagcgccctagcgccgagtagcctcgagccgccgtcgccgccgtcgctccagccgtgcgccgccgccgttccggtcatcgccgtcgctcgggaagaccaccgtcgtggtcgccaagtcgccgccgtcctcgtccgccccttcgccgtcgccgaagaccgccggagcaccgtcgccgtcgtcaagccgaagagctccgccgtttcaacctcgtcgccgtcgccgtccgttggtcttccgccgctcctttggtcatcggtgagttcgccgcgtcgcgctctacccgttggtgccctccgttcgtgccgaagtgccgccgttcgcaggcgagcatgcgcgtccgagccgccgagccgccgccgccggtggtgacgtcatcgctgacgtcatcgttgtcacatcctgatttttgtttcaggatttatagattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattgttaattttaatcatacaaagagcagttcagcaattgtttaaatattaaattaatcattaaatggtctgattataattttgttaagtactttgagtgtccaagtattttcaagatttttcttgaaattatttgagcattggaagtatttttaacaattcaaagatcatttcagtgattaatttaattggaaaagtaattaaagttcaccttttccttttcgggccgaattaggaaaagtcctctcactctcggcccagtctcctctcagcctgcagcccttttcctctctttcccgaagtctgctttatttccctcctttaatcagtccttggaagtagaagcccagccgaaagtctagtttgcctccctggcactattcatcttcaagcttggacagagccgagccgccggtgctgtgccctgtgcagccgccgcttcctccgttaaatccgccacatcccgagctccgtttgcaaaatttgttgaggggaaatattcctcttatcctcctctatcctctcccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgttttccccctctcccgtcctctcccgtgcaccgtagcccgccgtcgacgccgcatagtccgccgccgccgccggccgggttgcagccgcgccgagtcgccgtcttcgccgtcgccgccgcttgccgccgccgcctttaggtgcgccaaggtgaagagaagcccggccgcacctcctccttcgtcgccggccgccgtagctcgccgttgccggtcaagccgagccgccgccgccgttcatctcgtcgccggccgtcgtcgttcgtcgtttggctcaagggtgagtaccgttgggttcgtctcgtcgttctccacgtgtacatgtcctccaaatttgcagccgaccatccaatctccggcgaggtcgccaacccgggccggccattgatgatgtcatcatgacgtcatcattggttttttctttttcccgtttttctaatagattaaatcttctgaaaatcataactaaataactgtagatccgattcgagtggttcaagttgctaaatttttctaaaatcaagatctactgccggccgggttgcagccgcgccgagcagccgtctccgccgtcgccgccgcttgccgccaccgccattaggtgcgtgggagcgacgagaagctcggccgcacctcctccttcgtctccggccgccgtagctcgccgtcgccggttatcccgagccgccgtcgccgccccttcgtcgccggccgtcgtcgtttgtcgtttggctcgagggtgagtaccgttgggttcgtctcatcgtcctctacgcgtacatgtcctccaaattcgcagccgatcatccaatctccggcgagcttgccatcctagccggccacctttggtgatgtcatcatgtcatcatcggttttttctttttcccgtttttctaatagattaaatcttcggaaaatcataactaaataactgtagatccgtttcgagtggttcaagttgctaaatttttctaaaatcaagatctacatgttaaaaatatccacatatactgtttatgcttttttttgtactgttttgttgatttttattctttcgctttagtttccgacgttccggaggagagcgttttcgttgagcaaggttcggaagtgtttgcggaagctcaaggcaagtcacacagatcccaaacaaccctttgagcatgttgaacccgtttaaagctattattttattttaactatgcattatttttgaatgtcatcgggtggtgaacctttccccgttaattaatggccgaagatgatcttattttcctatgggttataatttgattagcatgaaccttatatattggtttggttcagttaaatgctatatgtatgtttgcttagccatgcttagaaacattagctaattaaaggggattaaatataaattatattacattattcttattaattatggttatatttaatggtagctcacgatgattaatcgtgtgatgttaattaattgataattaaaacctgtttaaggtgggttgtgagcatatggttttgatggttgtgctcatgacaattaaggaccggttcgcgagctactgttgtaaaacatttatcgtgccaaccacaagctagcgtgggcaacggctttatcttttgtatagcatgattcattttggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatcctttggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctattttcttttctttgtaagtatgtaacgttattattaagatggatttgtatattaaattgtcagtttgtgtacctcggctgattcctggacgaggattttatgcacaaattagttcggaaattactagtgaattttcgggcgtgacaagttggtatcagagccatctcgactgtaggataagccaaatggtcaaactttaaggacgaatttttccaacaaaaatgatttgtgaaaatttctcctttcttccttatctagaattctttgcaaattgtttcattgtctactctcctctctcgttcaacttgagtagttctgaaactagttgttgaaactagaagatgttgatgaggtcaacttatagaggtcagtaaagtggatcgaggaagaaccgaagtgccaagtggtcaagatggaatgaagtttggatcctaccttagaacctatgccgctaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaaactggttaaggtcttgtctttagtgtaacccctctccttctatcttctctaatatgcaacagatggtgaacacgcgcaccagaagtggaagtggaagtggaggtggagctgctaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctaccttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagagcagaaggacaaccaatcacttgggctaagttcacggaagcattcaagaagacacacatacctgtaggagttgttgctttgaagaagcgtgagtttagggctttgaagcaaaaggatcataccgtggcagagtatcttcatgagttcaatcgtctggcacgttatgctccagaagatgtgcgtactgacgaggaaaggcaggagaagttcttgtaaggtctgaaggatgaactgtcagttacgttgatctcccatgactatgttgattttcagcagctggttgacaaagcaattcgacttgaagacaagaagaacaggatggataaccgaaaaaggaaaatgactgttttccaggaggcacaaggtagtagccagaggcagcgtatcatgccactccaaattagtgaatcttcttccgctggtcaaggacagtcgcaacagttgaacatcggtggtgagatcaaatcagagactaaggaaagcaatgaagataatgttgagcaagctactcaattagtgccagttcagcaggatcagtctcaagagaataacagtagtggaagggagcagcaggtatgtttcaactgttacaagccaggccactttgcaagagagtgtccgaagacaaagcatcagcagccgcaagtcaacaacattgtcgtcacaggagccaatgcagtgccagttgcgtcttcaagagttgcgtcttcaagtgttacagctcagccaccagtttcaaagcagcagtagttttctttaaagccttagaataattatctgagttatggaataataagatagaatgcagtttacctatgcccttttctttctagccgttccgaatctcgggacgagattctttgtaaggggggtagatttgtcacaccctgattttcgttttaggatttataaattatttaataaattattattagaatttatattaaatgttcattaatttacaagtgaagttaaatgtgggaaataaaatttcctaaatataaagcatggatggatttttttttttaaattctccatggttaattatactctctggaatattctcggatttttcggagctcaattcctaattttaataatacaaagaacatttcagtaataatccacatattaaattaatcattaaatggtctgattataattttgtta

SEQ ID NO: 50936 - DNA, 1191 bp, Oryza sativa
cgttcataacagagctacaccagggggaagcatcattgaaggtaacacgaccgcggaagccattgagtcttatatcgattacatggccgagactgatcctatcaaagtttcctacgtctcaccaccaccgttggtatgcggtgtcagcacaactgacagaaaaagaattgttcccaatcaagtttcctacgcgcaggctcatttcgcagtgctgcaacatatggctgaagtaaccccatactttgaggagcatttagcgaaggtccgacaggacaatattggtcgatcagatatttggatcaacagagaacatggtgctcgcttcaacgaatggatcaaggatcgtgtagcacagtcgaccgatggcccaagtgagatattacaaaggttggcaaggggtccatcttgggatgttgacacatggcaagggtacgatatcaatggatacacattttacaccatcacacaagatgagaaaagcacagtgcaaaacaatggagtccgtatagatgcatatcaggatcaggctcgatcgagcacatactacggccgcatagagcagatatgggcgctgaaatatctgaaattcaaagtccctttgtttcgttgcagttgggtgacaaggtcgacaaggaaggcttcacattagtggacctggccaaggttggatacgcagacgaaccattcgtattagcaaagcaggtcgaacagattttctacataaaagacctcgcaaacaagaagatgcacgtcgttagggatggcaagcgaagaattgtgggggtggacaacgtcgtcgatgaagaagaatacgaccagaatcttcatgttagacctcagatcgaccttgatgatgatcccgaagacgaagtggcttacgttcgttcggaccattcggaaggcatatcactgtgaatgatgtatttaatttgtattggagccttaatgaatgaattgcatatgtttcatgccattccagttaaaactctttgaagaaatggatttgttaattatgtggttttaaaaaattatactggttattttaaactatatgtgagatagcctattgttaattatatgaatttaaaaaagtaatatgaattttaaactatatgtgaaaaaggcatttgtcaattagatgattttaaaaaaattaataggatttttaaactatatgtgagaaaggcaatt

SEQ ID NO: 50937 - DNA, 3143 bp, Oryza sativa
ccctctacacttgttcttatatagttgtttgcaaaatttttgggatattttgggttcaatgggatggatgaattgatgtgggctgtgatggttgaattattttggaggaaatgtgagttttggtatgttttttatggctatttttttactgcataaggacagaccctctacactgtttttatatggttgtttgcaaaattttgggatattttaggtccaataaggacagtgggggcagttgcaaatgatggtaattgatgcataatttttgagcaaaattgaggccaaacttattatatgtcatgacttgtgtttttaggtacaaaaataatatatatgtgactgttttgggttttgggtcattttgagggaattgggatggatatgcatagaaatctattattaaatgaagttactaaaattatggcatttaggagaatatgaagtgtcccggtcgccaaatctggtttggtcgggttactgtctgcacggtaccgaccaagacaaattggtaaaaagaacatttcgttcaaatacaacatttgtagaaatctgttatcgttaccaatatcctagattgatttcaaggtcatttctttatggaaccctgttgggggaagtccctcgatagcgggaggtcgtgagacccccctttcgtgggtttggccgggggaagaagctcgcttcatagaaatcacgtatccgcccctaaggctgctaatcaacttgcacacaattggattatacaggttcgggccgctgtggagcgtaataccctactcctgtgtttgggattatggttaagtgttacaaggacgtcttccctccgtatgagttcaggttttctcagaatcatccccttgttcggtgggcaaggtcctccttttatagttcaaggggataccacatgcaccgcctctatctacccttccatgggagggggacccactttaccttgaccgggtcacgatccgtgccttcgcttggaagctaagcagcagcccttccttgagtgggacccagcgccgccccctgcctggtacggggggcagccctgtcattctctcataaatgagtgaagacttgtggtggtcctcctccgaatgacgtttcgacgggacgggtcatacctatctctactccaccggatacagaggcgacatgggggggcacagccgcccattcaattggacgtgaccggcgacaggcccgtcatagactggtcacgtcctaattgacgggggtcagctagacggcaccacacgactgcccttactgcattaaacacagtgagggacagttgggcaccgcacatcgatggctgttcagcctgggtccccttcccgctcgttccccccgccacatggtagctgggcgagggcctcagggcaaagcagcgcgaaagcccgaggggcacaacgtggcaccccgaggcccccccggccgcttctgtaactcatgaggaggtgagcgtgggtgaggcgaggataaaaggatacggaggcaaggactttgccttcttcctttcgccaactgcccacttgccttctcgctccttaagccctaatattctcgccacttcacaatatcccgcgcgccaagccctccgccgcttctccaccagccatcatggctcaagacgctggtgacacagtgctcccggcatcacgcattacggcggatagacaccttatcctcccccgtaagatcatgccggaaggcgccgtcgtgagggcgggggagtggcggccgcggccacggtatctggagcgatccgtgcacctcctgtccttctctatggcggggttgattccgccgttctccggattctttcatgaggttttggatttctatgaaatccatgccttgcatctcgcacccaacgccgtgatgacgctggccatcttcgcacatctgtgcgatatgttcatcggggtgcgcccgacgatgcggctgttccagtctttcttcattccgcagctgctgcaaggtgcggtggtagggggatgttacttccagccccggccaggcacggcgggacaatacatcgagagtcatctccgcaagaaatgggaggactggaagaaggactagttctacaccgcgttgccggaccacccgcgacttcggcttcccgccggtcctcccgaaagatctgccgcatggctggcggtttcggaactgggcaaggagtacgacgcgatgtgggatcaccttaggggcctgcgaagcctgggcctcacaggggcgatggtctttggtgactatttccgccgccgcatcgcacctctccaggatcgatcccgtggtgtgtgggagtacactggtcccaacaaccccatgcgtacgcatgtgggtgcgcgctgggactggggggaggaggacgcgaagatggtgattcaacgggtgctgggcctagactccgccgagcaaatgctaattccagatgagatccttcccctccgctgcgaccgcgaccgggagagcatcttggccgtgatgtcggtcgtcggcgttggcaggggctggtccagccggggcggcaccggtggtagcgctgccggcatgggtggcggtggcgcgaccgcaggcgggagtcggacatgcggacccggcgggggtgggagctccaggtctcccggcacaaaccgcggacccggggacgactcagctagcgacccgaaagagaaacggaagatttccgaatctcgaccgccctctcctccgcgtggagggggcgccgagcgcgtggcggaccgaccgccagcgggccacaagcgccccgccggtgctgaggccggacggaagaagaagcggctccggaagataggtcaaacggagccgtgtcgggggagcttcattgagcccccgaagtggacttttaaccgccctccctgcaggtacaactgccggcacccacttcgatgctttttactcatcttaggtttcttgttccctccgtttcttttccttcattaacgcgatccgggttctcttgcagcgagattccttcccagggggtctcggggttcgacccttcgcggcggaccaaatccgaacgatcggagcggccctggcttggccgatccaaggccgcggggccttcacagcccctcggcggggcccacggccgcataccgggt

SEQ ID NO: 50938 - DNA, 2655 bp, Oryza sativa
ggctcgagcctgagcccgaggccgaggccaaatctaccctaggacccgaggcggggggcgagagggacagccactcccccttgcatttggggcgcgctcggggctggtcgtgccgaaggagggccgagagcaggccccagtctcgcgggggatctagcagcactctgtcgtcccgggggtggaccggcgacgtataggtgctgaaacccacctcgagccgccttgaatggtccaaggatgtctagcccccagaccgcaaaaggccaggagagtgggatgacctgcaaggcttgggctggctggtggcctcccttcgcccaggggcagagagagggcgaaaccactcgaacgggtggaatcctccctccgcgagggttcgcgacgggaaggagttggggagtcgtggcgacggtgacgagggccgtggctcccactagagtccccactcctggatggggtgggggtaaacgccaccgcctcctccacctccaagacctcgaccatgatcatcaagggccccgggaaacttggggcagaagaaaatgacttctcttcaaagtgtgcgactgccccttacctggcgcgccagctgtcgggggaagtccctcgatagcgggtggttcggccgggggaagaagctcgcttcgtagaaatcacgtatccgcccctaaggctgctaatgtgcttgcacacaatcggattatacaggttcgggccgctgtggagcgtaataccctactcctgtgtttgggattatggttaagtgttacaaggacgccttccctccggatgagctctctcgcccttgttctcctagagtttaggttttctcagaatcgtccccttgttcggtgggcaaggtcctccttttatagttcaaggggataccacatgcatcgcctctacctacccttccatgggagggggacccactttacttgaccaggtcacgatccgtgccttcgcttggaagctaagcagcagcccttcctggagtgggacccagcgcagccgcccgcttggcacgggaggcagccctgtcattctctcataaatgagtgaagacttgtggtggtcctcctccgaatgacgtttcgacgggacgggtcatacctacctccactccgctggatacagaggcgacgtgggggggggcatagccgcccgttcaatccgacgtgaccggcgacaggccggtcacagactggtcacgtccgattgatgggggtcagctaggcggcaccgcacgtctgcccttactgcattaaacgcagtgagggatagttggggcgccgcgcattgatggctattcagcctaggtccccttcccgctcgctccacccgccacatggcagctgggcgagggccccggggcgaagcagcgagagagtccgaggggcaaaacgtggcaccccgaggcccccccggccgcttctgtaactcgcgaggtgcgggagtagggccaggctgtagagccacgcggctggatgggaagatgacttccccttacttcacatacccccgggcccatatctccgacaaaccccattcccataaattcagtatccaaagatggttgctgtatctatgggaataaaggttccataacgaaatgatcttggatgcaatctaggagtttgcttatgataacgttagggatcttggataggaagggttttggttgcctgtgtgttctatctgcgtccgcctcgtcagcagatatgtagcatccatattccttagggccggagcagacgggatcttgacctcgacatccatatcccactagaacctgctaccgttgccactatcttatggtagtgacattgatagcaagttcgagtgggatactgatgtcgacgtcgagttcccggctgctctggccctattgagcatggatgctatggttccatcaacgaggcgaacacaggtaggagatagaggtatatcaaaccatcagagaatgtgtgtagatgcaattttgtgtttaaaaagtactttctccccgtacaacagtgacataggacatgtcgcagcaagacgaaccgatgtcaacgaccactacatcgagccggaatcctagggcctagaataagattcctaaggaagtctacaccataatagaggtggacgatgttggatatccgatggctccgacgaaagctgtcaaaaagttccctacgatatgcggaatcctagggaggcggaacttcactattctgaaggaccacatcgatctggtccctcaagaagaaaaagaagaggcctggaggcagttcaaggaaagcttccgataccctacagagcccgaggcaggactcaagcggcaggctatccgcaagatagggaattgttggaaaaatttcaagacaacgctggtcacggagtacgtcctcaaccccgcccagccagaaccatttgagaaatacccattcatcacccgacccgtgtgggatgagttccatgcccaccaaaccaacgaaagagtctcgggtaaaaagccaggcctaccgtgatctgcaggcaaggaaccttcacccgcaccggcttggcaccggaggctacgcggggaaacaggcagaacgggacaaggaggatgaagctgcagcggaatctaacaccccgcaagtgcttgctgatatcccgttccagcgg

SEQ ID NO: 50939 - DNA, 1057 bp, Oryza sativa
tgcttggcatccataatgtgttctacgtctctcagttgaagaaatgtttgagagttcctgaggaacaggcaagtccggatcacatcgaaatccaagaagacttgacgtatgtggagaagccgactcgtatcctcgaaactagtgagagaaggtccaggaacaaggcaatcagattctgcaaagttcagtggagccaccactcagaggaagaggccacttggaaaagagaagatgagttgaatgccgcccatccgcaccttttcgccagctcttccgaatctcggggttaagattccgtttaaggggggtaggtttgtcacgccctgaagttttccccttcttctttctttaaaaattgggttaaataaatcgtccgaagaagttgttctaattaacctagagttaaatccctaattaataaatgcaattcataattggagtcggcgtggtagaatttttcttgagttccccatgctgcaatacattaacaggatttttagtggaattttcagagccctataagtaattttaaccaattaaaattcattaaccgcaatatttaatcccaggaaaatccttttcctttttctcttttcttttcctccctttttcctttgttgggccatcggcccaaccttccttcctcccgcgcgctctctcccaccttgccgggccggcccattgcccctctcctccctccgggtcaccgataggtggggcccaactgtcggccccgtcttcttcctctggccgcctgcgcccggccggcaaccgccgctcccacgtcgccgtctgtgtctcccgcgcccactccgcgtccacgcgccgcgcccacatcgtcgtccgccgctcctccgcttttcccgcttgcgcgcacgcccgcaaatgggcgggattcgatttgaatcacatcccctctctctctctccactcccccacatcgccggccaaatcggccacctccccggccacgtccgcccctcccccgcccataaaaaccctcccccgggccccctctctcgtttcccactctcgccgccctttctcgtgcttccta

SEQ ID NO: 50940 - DNA, 1639 bp, Oryza sativa
tacttgaaaagttaaaagagcaccaactatatgccaatttcagcaagtgtgacttctggcttaaagaagttcagtttctcggtcacgtcgtgaatgctcgaggagtagctgtggatccagcaaatgtggagtcagttaccaagtggaccccaccaaggacagtcactcagattcggagttttctgggacttgcgggctattaccgccggtttattgagaacttctctaaaattgccaagccaatgacccagctattgaagaaggaagaaaagtttatttggtctgctgaatgcaataggagttttgaagaactcaaatgacgattggtgtctgcaccagtgttaattctgcctgatcagacgaaagatttccaggtttattgtgatgcatctcgccaggggctaggatgtgtgttgatgcaagatagcagagtggttacttatgcttcacggcagttgtgtcctcatgaaggcaactacccgacccacaatctggaattggccacagttgttcatgctttaaagatctggcggcactatctcatcggtaaccgttgtgaggcatatatagatcacaaaagtctaaagtacatcttcactcaacctgatttgaatctccgacaacgaagatggttggagctaataaaagattatcatatggaatacactaccatcccggcaaggctaatgtggttgcagatgccttgagcaagaagagctactgcaatgttgcatgggtagagaaattatgttgtgaggttcaacgtgatttggaacacctgaaccttagtatagttgagcacggaatcgtggctgccctagagacacaacccacactggtggagcaggttcgcatagctcaggcaagcgatcctgagatagcagaactcaaaaagaacatgagggttggaaaggcccgaggttttgttgaggacgaacaaggaacaatctagatgggagaaagattatgtgtacctgaaaacaaggagtaaaagacctgatactgacagaagctcatcaaactcagtattccattcatcctggcagtaccaaaatgtaccaagacctcaaaaaaaagttctggtgggtcagcatgagaagggaaatagctgaatttgtcgcactctgtgacgtttgccagcgagtaaaagcagagcaccaaaggccagcaggtttgctacagccccttcagattccagaatggaaatgggaagaaatcggaatggatttcattacgggtttgcctaggacatcatcagggcacgattctatttgggtagtcgttgatcggctcaccaaagtggctcacttcattccggtgcatactacctactcagggaagaagttagcagaactttacttggcaagagtcatgtgtctacatggtgtacctaagaagatcgtgtctgatcgagaaagtcaattcacttcaaagttctggcagaaattgcaagaggaattgggaacccgtttgaacttcagcacagcctaccatccgcagactgatggccagactgagcgagttaattaaatattggaggatatgttgagagcctgtgcacttgattttggtggagcatgggacaaaagcttgccgtatgctgagttcttttacaacaacagttaccaggctagtctgc

SEQ ID NO: 50941 - DNA, 713 bp, Oryza sativa
attcctgcagcccaacaaacatgacatgtgcagcagaaaatgatcttagtgaaagtgctaaacatgaacatgctaataattaaaaggacatcattaaaaaatagttttaacctatagataagaaggtaacatacccgagaacgctccggtaaaacataagacattgttggtgttgttgcctccgttgatgttgttctcgcctcctccaatgctgttgcctctaccagcaccgttgacgccagcgcctccatagttgcttccactggtagacatgattagtgaagtagatgaaacagagtagaatcaatgtagaggaagaagacaacattgtgcagaactgatgcagcagagcaatcacactagaaagcgctcccgaaaaacttgatcgcagcctaccagtgcaggtactcaagcgaatggagtttcggaggcctgctcgtcctcgccgcctagcagtgcaggtactcaagcgaatggagttctgaggcctgctcgtcccaaacactgcaaccgaggatgcaaaaatgtagcaaagtaacaaaaacaggatgtgccgaggagaaccagtgtgggggagaggagagcagagaggtgttttcccgtaaccgctcaacaggtgctctccaatagtagcctatttaagttgagatccttccacatggatatttaaggtggtattaatccattagcattagttgtaggtctatcgaatt

SEQ ID NO: 50942 - DNA, 772 bp, Oryza sativa
tcaacctcgtcgccgtcgccgtccgttgcttctccgccgcttctttggtcaccggtgagttcgccgcgtcgtcctctatccgttggtgccttccgttcgtgccgaagcgccgccgttcgccggcgagcgtgcgctgtccgagccgtccgagccgccgaaccgccgccgccggaggtgacgtcaccgccgacgtcatcgtcgccctctcccgtgagccggtcgtggaccgttcgatctcggccgtccgttttggatagggttgatctcggccgtccgttcccgtgaaccgccgccgtgcacccggtccaccgcaaaccctagccgctgacacaataatccttcttttccttttcaaaaataattcattattgcgtcataattcaattaaaatccatataagtgttttaatccgatttaatctttaaaaattcacatttgaactcagtttaatgtggttcaagttgcaaaagttgtataaaataaagatctacatattaaaattgtccataaattgaatgaaatttatttaattctttttaaatgggctttaaatagatttaatcttgtaaaattcataataaattcatttgaagtcagaatgaggccgttcaagtctcctaattcatctaaaattatgacctacatgtttgtttactttttatgtattgtttatttggtttttattagtctttttcctcgttttgcgtgatagcttgtcgtttccgtcgttgcgaaggttcgcgagtgcgtcggaagtgttcaagaagattaa

SEQ ID NO: 50943 - DNA, 2502 bp, Oryza sativa
attcctgcagccccatgtgataatttttaaatttaaatatagttcatatcaaatgtaatcataatattttcactatacacatctaatttagataagtttattagagacggatggatgttgcttgtatgtataaagattcaaattagaaaacagtgcatagtatgtatgtacccggaggatttttttgtacaatccggtggatagtagtacatatttattgtacaagtgaaaatattttttattttttttgggtgaacagcacatacgtacgtttctctcgtagcaattacgtgggactgtcaactgtagcagtgctaatccttctttcttaatcgtaattacgtttttttttcttttttgcggtgagtagcaaagtacggtaggacatatatatgcgtactattcacgggattttttctaccggcgaggttagacgggatgtattttaaataattctaatctaatggtttgaaaatagtaggttcaccgaattaaaatcgaggattggatatttttcttttttctcaaaatttatatgtttttctctaataaatattacagacagcttggtagtgcttctagaagtgatctaatatatatttttttctttattatagataagataaatatgcagtgttttaaatagtcatttaaggattgatcgttgttattccagatagtatgtatgcctgtgtatgtacaattctctttgttgtttttgtcaaataacgaatagtgtactttttttttttgcttttttgggatacttacagatgtttatttcccgggccctttttctgttgggtcaagcatacgtatatacgtgggctgataagctgaggggtggggatagcagggagaaggagatggaaagatttatagagataaatataataataattaaaaatagtgggtccaccgatttatttggtgccacatggcattttaggagtgtttgtaggagtaccacgtaggagcgtttgtaggaagtttaatggacttttagtatataatagatagatagataacatgctacatgcttaaattttttttaaaagtaatacaattttaatggaaaattataaaaatataggtctgacctatactaataagctattatctcagcccatcatggtgaaaaaagtcttggcctataggcttttcaaccccaagcccagacattagcactactgcgtcgcagattctgctttgactatggtggatgaaagaggggcagctggagcgaagcagccgtgggatagaataaggtgggaagggagatgggccgtgggcgagtaacgcagggtgaaatgggccacacgagacttatcactttgcttgtctccggcgttggtcaacaagtatctccggacgattttgctaaacatctcccgcgtgatttttttcctggcatttgacgtttttttttggccacatgatctttgcgccaagatttgtgcagcaattgccgtggatgaagtcgacagggagtcaaggtgtgttagtcttggtgtgtgaataaaatatgtgaagtatgtaattttcatatgtcaaattaagaaatatctctatgttaatttacatgtcaaattaagtactaatcgatacaacaaatttaacatatcttaaaaatctaaataaaaattgatttttttaaccattgaaaaattaagacatttgaaactaaaataaaaaataaaaaaataaaattacggggctatctatacatcttgtgacagaaaatcccaccctatatcattcgaattttggaccattagatatacttcaagattcgtgcagacccttttaacctaactcctctcctcctccccaccgatttagatcgcacgccaccaccaccccgttctcacgcgatccccgccgcaaccgccccaccgcgccgccgcccgcctcgccggctagccggaaggggtcaacggcgctggcgaggcccccccggtgagccccctccccttcccccttccctccccttccctcctctcctcgaggtggcgacggcgaggtgcccccgccccgccgtcttccccgtctccggcggctccccgccgctggattcgccaccaccggccgccgcctcgccgcccgccggagtccaccgcccaccgtcggtcctccgtcgcccacggccatccctctaaaccccgaggaaatcccctcttctttctcttccaacccccctcctaccctcaccccaaccctaaaccataacctgccggagttagggtgtcgtcggcgctggagaagaaggagagcccgccggagatggagcagagaagccaacgcacaaatctgggcatggatctagtggtccaaaatctgtaagatttcttccccaaatttcattcgaatgacatataacaattccgtaaaaataaatgtgtaagtaaatatgtacttattattttctttaaaatataaaattacagtcctatataactaaaattacatttgtaaattaaatttagttaatttgatatgtaa

SEQ ID NO: 50944 - DNA, 3475 bp, Oryza sativa
  unsure (1)..(3475): unsure at all n locations
ctcatccggtggtccaaaatctgcaagatttggggatacaatttctgtgggcaggaggttagcaaatctatatatttttttttcagggctacatgcagaaggtctagtaccgacataaaggcagaacacactgttaccggtgttacaaaccttcaatgaatccatatatccagccaggtgacaaagatcatcgagatcatcaagactagtggtggcacctgtagacggggctgcacgggcggagttggggttgggagtagggcgcaccgcgcacgagcggcgcactgaccacgaaggcaacctgcattgtccttgacgaggagtttgtggccgacgttcctgttgctgccctgcagaatcctcttgtacagcggtgggcagctccccgactccgccgcctccgtctcctgcaggctcaggtcctccacgcggcggatgcgcaagccgatcgtggcgccagcgctgccataatcctccgttttatattataagactttctaacattgtctacattcatatatatatatatatatatatttggtaggaagctaaacacttaattttactaaataatagtatggtttaaaatagcatcaatcttaataggaccataaatcagttggcaagctagaaaatagataatgaactatagtatgtcttgctgcaatccacagagacattctgctactcatatgctcttaagtgataattaattagttgctataattagttgttgatatataatggagtaccgtctatcataggagtatggaggcgtacttgaattagttggcaataatcaatatccgaccgcgtcggcaggccgaacgctgcaggctctcgcagcatgtgaagctccaggacaactggacaagactcacaagagtgaccaccggcagagctcgcgtcgcgcacttctgcatgattgcattgcatccggagatcgattttgctaaacatctcccgcgtgatttttttcctggcatttagatgaccatatgccccgaggcccgacagcccggcccaaagcacagccatttggcctggcccaagcatggcatggtccgactggtgtcgggcctgtgctggtatgacctgacagttgggccgtgtctgggccgatgccttggcacggtggccggcatgacacggcacgatcgaagaaaaatagtagacagacctaaaatatagacttaattaaccatataaggcaaggtccaaagaaaagaggaatacgaaaaaggcttttttttcagccatatatacacatcccaaagaattgagggatgcaaaatagacttattatgtggagaagcacgatgggttgtcgtgcctttgggccggcacgtcacgacccgagtcttattgggccgtgcctgggccatgtgtgcagcccgtgggctagcacaacatggcccgacgtgtaggtcgggctgtgccggcccgactgacctcggcccaggcggccatttggccatctatagtatacggtgtgagggcacaaaccctttgtccacatcggctaggggcggcggctgccctcgtcgcccatcggttgctcgtcgtccgtcgctgcgcttgtgaccaactcgtatatacgtgactcgcgctcaccggtgctcctccaggcctcccggtggctagagtaagcgagcaactaactcagagagaaagagaggggagagaaaggagagggaagtggagaaagaaaatgagatgatataagaatcacttacatgttggtcccatgttgtgatgttgatgccacgttagccaggggcgaagccaagatttatggttagaggggtgtgggcagggcgaacaagtgataaatcagagtaagcaatactgatgataaaacaagacatcatgtattctgccctaaaaaagcttgaatttagctttttagttgtatcgttggatgtttgatagtttgaaacttgagacaccatgctcgacagcgagatgcaatgggaggacggagagacgtgtgaagccgaagcaatgaagacgaggagttgatttgcgttgtctctccgtctctttcttattaattaattttctaaccatatttattcatcatggactaattaacatgctaatgcgctagttagtatagaggggggttggatagggtgttggctctccagcaccccgcgtagctgtgcccatgaggttagcgaaaaccactctagaaacaggtgagggagtcattttgcacggtttcaatggttagagggatcaatataccctattttttggttgagggtacaaatcaaatccgaactatattcgaaggatcaaattgcatttttttcccactaattagctcggcctatcataatggcaaaagggcttggcccatacgctttttactccaggccccgggccacagcctagctaaggtgtacgggtcaggatcggatccactcctgcacatagcgacactagtgcgctgtagcttccgtttaggctctacggtggattaagtttttgccacgcccagaaattcacaaaccagaatttctaagctgaatgtgcattaaacccctatccagaaccagccagggtacacaaacgacaattgttgacatacagatccacgttttacaaaaatataaaaagattacaaatacagtggaaaaagtgaaagcgagctaagcctgaagacttgactcctgcagcgaggcgactccactccacaggcatccttgacggcagcgacaaaaccaacttcttcaagatggctccaactgggaagaacttcaactntggtgtggagaagagagagtaagactgagtactaccaactgtactcagcaagtcataccggaagaggaggtataatgcaagatataaccaaaggaggctacaggtttatttgcataaagcaggcatttaaaagtagtagtcaaaagcagtaaaacagttgtagtaattaatcaatattaaccaatcactatccaacgctacaccacgttgcaataggcccaactaaccacctgaactacaccagttcattagctaacaaggtgagactaatcacggtgaatctggtcaaccgcccataaccgcgggcacggctattcgaatagttttactctgatcagaggtgtacaactgtacccacaagacacagccccatgacacgttcccgtgcaccgacatgctaccacgacataccggaaagaggccgtgacaggacccttcgcataatcccctctaaccgatcgcaccacacctcagggttcgccccgtccccagcaggcaatgggtagcccccctctcgtgccatggtgaatccgaaagccgatcaaccgaacaccccgaccgacccaactccatcatgcctatcctaacctgagtacgtcggctagaggaaagctacactacaagctcagtcgtagtccacgctgacttgtggtaagtacgataaattcttccagggcatcccgcgaaccggtccttaattgct

SEQ ID NO: 50945 - DNA, 2486 bp, Oryza sativa
cggcctcgagctgatcggacggcgcggtgagcagccgccaagctcggctcggcttcaaagccggccagccggccatggctagtggcgatggcgcgcacagccaccggcggtgaccggcggcatgcgaggcgatggcagacggtgcggaaggcggcggcgtcggccgaaggcgacggcgtgcgcgcggagaacaggagagagaaaaggaaggggagagagaggtggtcctcaccgacgagctcgggccggagtgggaaacgaaggtggcggcgtcgactggcggcgcggagggatggacgggcggcggcggcaccttgggagggagttgagaggggttaggaatagagagagagagagaccacggtggtcgccattgtcggctggaggtggaaaggatggatagctcaccggcatgcgaggagttggagctacggcggtgatttgcggaaaccgagcggtggacggggtagctcgtacgacggcgaagctggcagcggcgagcgcacagcgtggcggtgaccattgcaatggcatcgtgcggctggaggcggcggcaagcggcagtgcgtgcggcgagcgacgcgagtacggtaggacgcacgggagggggcgacgagtgtgggaaacgagagagggagctcgggggagggtttttatgggcgcgggaggggcggacacggccggggattggcctatttggccagcgacgacgtgggggaggtggagagagagagtgggatgattcgaattgaatctcgcccttacgggtgcgcgcgagctggcgggaaggcgagggcgtgggcacaggaggagcggaggaggtgggtgcggcagtttcggcggcggcggttgccggcttgggcggaagcgggcggcgggaggaagggggaaggcccgacaggtggggcccagctgtcggcgcccgagagagaggagtccgggaggacttcgggtggaggagggaaggaatgggccggcctggcaaggagggtggtgcgtgagagaggttgggccgacggcccaagaaaggaagaggagggaaaataaaaagaagaaaaggaaaagggattttcctgggattctttattgcggtttgatgtttttaattggttataattatttccaaggcttctgaatagaacccaagaaaaattccacatgccgattctgattattatttgcatttattgattaaggaattcaactctaggttaatttgaaccaatttcttcaggcgatttattcaatgaatttttaaacaaggaaggggaactttagggtcaggtggagccgacggatgggagggccggggcagctggagcggagtggcagccatggggtaggtaggaggaataagttcaccggaggtcccttaactcaacagcgagattttttgaggtcctttaaccgcaaaatcagaaatatatactccaaaactcactcaaaccgttcaaagaaggtccgatgacaatatttttgcccagttttactgacgtggcatcctagtcagcaaaaaataaaaaaaataaatatgtggggttcatatgtaagtgagaaaaatgtgtggtctcggttttttttctacccaagcttgggagtggggcaggtggccggcgggaggggcgggaaacggccggcgggaaagcgagggggaggcggcattaggtgttgccgccaccattcgtgtgccgcgtgctcgacccggtgcggggtcggcgccgggcggagcagggttagacgcggagggcggtggaggcaccgcagctggtggaggagatcgagggccggagctcgtggaggtggagctcgagaagcgtgacggcagctacagcttgagaagctcgagaagtgtcgcggcggccgctgctccgtccctttgccatgtcgcctgcagccgtcccccctttgcggcctactccagccactctactcctcccgctgccatgctcgcccgccgctggtcccccctctgccatgctttctcgccgctgttgtgccttctgccgctctcgctcgccgctggtcccccctctgccaacctactgagttctccaccaaatccctccatcgccgttgctagcagatggacttcatccttctctctcggaatcgattttgagggcgacggtgatgagtcccacctcaccgacaacggcaatggaggggaggagcagaagcgttatgaggctctcgatgcaccatccttctctctcgacatcgacggtgatgaggagcaccactgggaggagcaatggtgaagttacgaggttcctgacgcgccctccttctccctcggtactaactctgatggcggcaacccggagccgccgctcgcccgccaccgcgcgctcgcccactgcttgctgccgacgacgccgttgctccgcacccgcactcactcgctgccgccgccgctccgcctgcctttggctgtgcgccgctgccaccgccgtcacctctaacacctctaccgcaggcctagattt

SEQ ID NO: 50946 - DNA, 3460 bp, Oryza sativa
aggtaggataaggtgggaagggagatgggccgtgggctattaacacaggatgaaatgggccgcgcgtgttttatcagttgtgcttgtctccagtgttgggcaacaagtatcaccggaacccggatgcaatcatgcaaaaagtgcgtgacgcgaactgtgccttagctggtcactcttgtcctggagcttcacatgctgcaagagtctgcagaatgcatgcatttggcctgccgacgcgctcgatcggatatttttgccaaccaattcacgcacaccaacaactaattataacaattactcactccgtcctaaaatataaatatttttaacttaatgacaagtcaaatattttaattatcattaagcaaactatcataatatataattaatttttgtttaaaacatcttacttttataaatattggtggtcaaagtagtatctcatagactgtgtcagggtcaaaaatagtaagattttgaaacggagggagtataattaattatcacttgtagcatataactaacagcatgtctccgtggagcatatataactatagttcattaaccttgatcgagacactcttcacgaatagtattatcaacaactaattatagctactgcatttcaagttagtaatatataactagaagcatgtctcagtggatcaagcaagcagacatagtattccctagctagctaacgggagggcgggcggcacgtaagcacccgaagaagagtgatgaagctgcaactcccgccggtggagaaaccaactttggtcggtggctacaacgcgtatatgtgatctttagtcccggttggtaacatcaactggaactaaagatcatctttagtcccggttgtagagatgtcagatgttgtcagggcccccgggatctttagtcccggttgttgttactaacaggggctaaagatccgatctttagccccagttggttggtaacaccaagggaataaagatccccccgttatatatgccttcttcctcctctagcccgagagcaagcttcaaatttctcaaagaaagaggaggtcatgccaaaatttattgtgaaaattttttagtaattatatacaaatcggatatgtctaaaaggttagtaacttcatcctccaatattttttttcttgttatattacttttggagctatgtttcacacatttttttttctacaaaactttgttgtaagttgatgagagagaaaatttatgtggggaagaagaatatatagaaattttattctcatagtttaaaatatgatgaaaattaatcttaaaaaatagaaaacaaactaaattgaaaattaagagaagtacaacattaatattagtttagaacttcaaaaattgttaataagaattgctcgtcgaaagagttttaaattattttatcattactgtttgactgtcattattgtatcaaaatttatttatgtatgatttttttttcatttcatgtagatggatcggcaatggatgtatgctgaccggcggtccaaagagtttatcgagggcgtgcattattttttgagagtggccgaagctaacaagcgtaacggttttatttgttgtccatgcaataagtgtaagaactagaaggagtattctgcatccaggactattcatttttatttgttgtccatcaataagtgtaagaaccagaaggagtattctgcatcctggactattcattttcacctgtttgagtcagggttcatgccaagctataattgttggacatcccacggtgagcaaggggttgaaatagaagaagatgaagtggaggacgagaacattcccgactgggctcagtacgctggatttgaaggaaatcaaacgggcgaggtggacagggatgctggcgataacaatgctgcggatgatctttgtaacaccccagaaactacaaagacatcgggatgctactaaatagacatacatttaacaaagaaggagaaatttcgacagcaactcctctaaaacataagcattgcggaagcgtcaaatataagtatagcattgcaagtagccatctacaaaaaaaaaggagaaaggaacattcagggatgaaataaactaatttcaactctcagattcatctagtgcaacttaacaagggtacaattcctttattataaaaatcatgacaactttaaaaattagggtggcagtgtggaatgcagctgtgcttctactcccgttttccccaagcgagcatgtcactttaagcacctgaaaacactgtaggggtgtgagaataaatctcagcaagagaattattttatcaagttatttaacctaccaaatcattaaattatatttataagaaaacaaaggaacataacattaaatataaaggcaaacatctagtgttcataggttcaagagtaaggaggataaaccagatctgcaaagacctcaggagaaagaagccctctcatgaactcaatagagtatataacttccataccccaaaatgctaaagtgcaatgcaatgcaaatgcaataatattcctgccttcacacccaacaaggtgtgaagctgcatcgtgttacgacaatacacgatgctgtaccggtacggtcgcgaccataggttcacgacataacttcgaatgaaatgcaatgcaatacaataatagaggaaagatacacagccataaatccttccaatgatatcacatataataattactctcactaaaagcataccacattaaccatagttaccgatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaacttgggtataagccaaacgtcttctccttctggatcctttttcttcaactgaggttgattgattattgcaaggtgagcatatgacatactcagcaagccacacagtaaatatgcaagtgcacaaggataccaaaggatggcataatattggctcatttgcaaaagcagcatttagcaaaacatttaagagaagtaaaacagtggagtaattaatcagaaattttaatcaacactgaacagcatacccatgctgtacaggcccaaccatcctgaacaaccatacccggctgtacagatctaactccaaaccaggagctaagcaaattattaccagttataacatcaatacttattgtgagaggtgtgggactaatcacgaaaaacattgctcaactcgcccataaccgcgggcacggctattcgaatagttttactctggccagaggtgtaccactgtacccacaagacacagcctcaa

SEQ ID NO: 50947 - DNA, 702 bp, Oryza sativa
attcctgcagccccctagatgcttcagtctccctccacctccacgaattagcacttaatcctatatatatattcctctataaatttctatgtacaccctctagaacaattgggttttgtttagttgaattttgccaagtgctattcaccttgtctctagtcctcgctcaattagtcatgatcgactatagattcagagcccccaatagttggtgtgttgatttgccgggtcgattagatctaccacttcaatcgcaactattccttgtgcttattcacctattcgcaatatttagattgcatcttatattgttcttgcagtgttctcttgtctgcattgcaggggtcatcaaccgcacgtcacggttggtacgacatcgtttgtggtgtagcgattgcacggcgtcctggacttgttctggttggtagccacgccgcaaatgtcgcactcgatcaaagcgagagttatccccttaccagaagatcgggccatgagagagagcgtcatcagggtaagtcctacgttccctcggccctggcaatcttatcggctacattggtgttgttcaaggctgcatcgcttcgacctcttgaatcactctggttcagttgatatttttgcctacctatttatcatatatcttagttaatctaagtagatttttcaatttacttgtatcggtcagatctttttctagggttt

SEQ ID NO: 50948 - DNA, 1146 bp, Oryza sativa
ttggatattttcttctggttttcagttgaagaaacagaagataacaaattcacatcaccagaattatctaatgttgaagttgcatgcagtacaaggttctcatcttggcgaacatcgtttataccactttggctgattttatcaacaatgctactgtctcgtggacctgaatcagtataaggcatcaaaatataggcattagatgactcgtttttcagtaatgactaatgagcacaagtacctttattgtcttcaagtggagttggctgatttttttctgaaggaattgctggaccagcaataacattggtaggcagttcattatgttcatctctaaaaatcagcttggtctctgcaacattttgttagttagcaacttgctttgagttttctgtatcgtggtttagtataaacttacgttcttcagagattgctgcaatgtcgtgggttccctcaattgtttcgtcaactctgtttttcttcatctgcatttgaagtgtaaaaggtaatcaagaaaaaaagagaattcagtgctcagcagtagaaggtttagaagagttaaacagaacctcctgaatgtgaaaagaactgagagtttcaggattcacccctagttcctcaggtgcttgaaaagaaacacattcttttctttttctggacacatcaattccagcaaatgacacaaagttgaagctatttgcagcacttgaaatcagacaacagccttcatcagttgattgcttttcttgatcagtcgatgcctttgatccttcatttctgctgagatctggatgaggtgattgcattactaaaagtggatcctgtgggataggtcttagtttcccaaacaccccaaacagtgaagcttgcagccctgcagtttgcggcacagagggcatgacatccatctgagaagatggtagttcaataggactacctagaataagtgaagaagtatatttcaaatgaccagatcctgtcattgataactgtaaaggaagttttatctgagatgctaatgccagcactgcattttgttgcttcatagtttctttaggtcgtggtactacatctgcagtctccaacaatttatcagagcttggtttatctctgatttcatcactgtcattacatgatgccaagtca

SEQ ID NO: 50949 - DNA, 7062 bp, Oryza sativa
aaaaaaaagccagagaatatgtacctttgcctttgtatcctttttctttgtcatgcagcgcatccattttcgaccatcccattcaaactgtggtctcagttttgtattttcaactgtcaacttatccacgccatccacattatccatgcccgttggtaactcttcagtttaacaacatacatcttgccaaatacaccacttgaagtctccaaaataattccaggccaccagctaccttcatgaaagacctctacatgagaagatggagaaaatctgtattttgagtccatacgaatgattgagcgtgctggccgaatatattcagtatcaacaatctccgtgaccagctccccatcatctccgacgtgtctatactgtactaagaaatttgtagaaccaatcactttcaaaatagtagctggattccaagactggccaaagctttccgcagatctactcacttcaactaggcttccctctctgaatgctggacctccattgtcctgcacataacaaaagcataggaacataggattaagtattgcagcacactgtaacacaaaaggttacctgacctttttctatgataaaaaagtattttttttgtttgtgataattcaactcattcacacaaccatcaccagagttacattaaaataatgaaaatgaattatccacaggaggcatagacaacctattccgcatattgatggtgccaaagctatgcctttacaatgttgtctgtttacctcaaaaaaaaagcttgtttgtttagaaaggctttatgtaacatgtagatgcgctaaattctgtgaaattatccacaaaagttattttaagatcatggaaaaatggtgctcaaacttatacactgatacatgagcaattgcagatctaaaacatcgttgacttgcatatgaaactctcaatcttatagtcctctccaaacccatctcacttgggtctattgagcctaatggctaacaattgtacccattatgattcaaattcctaataatagctgaattagcaaccattttacaaagcaaccatagcgaccttgttgacattagatgttatgcaagattcctcctatgcttccatgtttgattgtcaagacagactcattgacatgtcaatttggcacacagaaacgcatcgaaatattttattttttttaaaaaaagaaaaacaattataaaatactacaaacaaaagaagacgtacatatttatttattatttttttttaccaagaacaaaaaaattgtttactagaactggtttcttttactatatctcatctgattttatttcctaaattataaaatgttacttgattagttgggtaagctaaccatattgtacaattgtaaaattggaacattgtaagtgcaaaaaatagcgtggtatctccttcttgctcccaagtaccaaccacttctacttgaacagcatgacatgtagattgttaagcttttggcgtaataacacaaaacggacataaacattcaaactcttattaaattctgccaccctatctactatcatcgtaaattttgcaagttaccccgtgaacttcttaacatttaaaaaaatatcaaatccaagataaccacacaaaaattagattaagatgaatattccctacagcaaaaagatggggacacattaatacattttatagatggggacacattaatacattttattttatccgtaacaaagcacgggcatttaggaaaagcgcatggcctctccattttagactaaaaattacactataccaccatcatgttaaaaaaaatgagtactgcccaaatctgtaaaagaaaaaaaaatgactagccctgaaacacaagttcgcacagctcagcttattaccacatcagcggccgggacccagctgccgcggcggaacacgcggtgcggccgcagcgccgcctcctcgaactccatcacctcccgcgacgtcgggaacgccaccgtgtacaccctccggcgtgggtcgacggggagcacgtccagcggcagcggcaggccggtgaccacgcccgaccaccacccctcgttgtggaacgcctccaccatgtcgtgcatcgcgaacccaccggcgcccggcgcgcccggcgcccccgccaccggcggcggctgcgggcgcacgtcgcgggcgcgggcctcctcccgcagcgccgcgccgccctcctccagcgtggtgtaggcgacgacgtatccgtcgccacccgggaggtgggcctcgacggtgccctcgtagaaggagccgacgaagcccgggtcgtcgctgccaacctccacctccgcgccgaccgggaacagcagcgcctcatcctcctcctcctccttcacctccttcccgtcaccctcctcctgatccccacgcgccgcagcccgcggccgctttgccagcttcttcgacgggccgcgccccatggcggggggccgacccaccggcgttcgcgtgcggtgtcctcggcttctccggcgagagaaagagcgagagtgtgtgtgtgaagtggggtggggtggcggaggcaacgatggatgaggggattagcggtgggtggagcggcacgaattccgaggtgggtgggtggatcggacggtggaggatggagagagaggaaacgtggagggacgggatgaggtcgcgggggttgtgggtggaggcgggctcgtggcgcgaggcggcggaggccgcgagggccgtggtcgtggactcgcggtcgtggagtgtgaatgtgtgtgatgggacgtgaggtggcagttggtggtaagagcaagtttaatagtatagctaactactagctccaatttaatctatagtcaatgtaatagctcattatacatactatactattaatatctgaatatccggtttcaactatcatacacacaatgcgtcttagagtctgtgctatagctgactacaaatctgtagcccgttgctcttctctcttcttatttatctctttaaaatatatttgtattgctctgagggtggaggaagcgtccaggcgtgcagctgtaaaaaaatattgatagaacggaggaaccgttcgatatttttctttaacgactcatacaatgtgaagttaatattgatagaatattgatatagtaaaaaaattactataaaattaaaactaatgaagataaaatagccatcaaccacgccccgacaacactaatactagaggatgcccgggagaaggctagcaccggaccagccaccgctagaccagtaaaggaactactgatgaggatgcccgaaacccaaccctaacaaccgacacataactacactctatccacatctttggaattgagggagagagggtgagagagaagaatggaaccactctccccctaggccctccgacgtggccaacttgcgtaaactagggcaccgacacaatagaaccggaatctatagcgagcttgcataagaagattaggaggtttcggtaagggggtttcctggatgacgtctccaaggagagaagcgataaaagcaccgccaccgccgtctgtcgaggtctcaaaggagaaccgagataggttttcacccgacaacccactagaggagatgggacggcatgacaacaccctcaagagggaaagtgacactcgaaaacaccgttgttgcgggccaggtcaagaccgggctaggttttcacccgccacttgcctatgcgcatgtgatgcaccatttctccaccaccatcaaacctccgtcatcacatgggcaccactgaaccaacgcccgctgcccgtccagcctttgcgtgctgtcctgcgggcactcccatcacaccatgctgcccttccctgccagcaactccacctatgcgttgagctggcctcagtaaccatcggtcgtgcaccatgccggccttcgtcgtcagccgcacctttatgctgaccgtcgcccttagcctccttgtcgcgactgccgcttagccatcggcgccggcctcccacaccattggtgctattgcggccgccccccgttcagccgccggcctcccttccgacgtcgttcttcccgcaccacaaccggacagatccattgtgtaggtgccggatccgtggcctccaccatcaccctgccgcctccacgtcctcattgctgtctccactctactgtacccagccgccaccgactcggggtaggagggtggtctcctgcgccgtggaggctagatccggcaccgccgtctcgccgtctctatgtacaagtctctatgtacttgaagaggagagaatattaaagatatgtgcaagtctttgtgtactctagaggctagagttttagaattttctaagcatgttactatattttttctttaggacgaaagatcttattaaaatgactaaaatccattttttctacaatgatttaatttttctattttataatcggtgtgtttgactggtattttttagctatagctgcaactacaataattaagaattgttgcaactaatttttaacccctccgtcccaaaaagagtctaatctatgcagcagccgcatcagctatagcttgtatggctacctaacaaaagccaatattagagaatgggggataatttactactccctctgtcccaaaatataagaacctaagattggatgggacagtccagattcgtagtactagaaaatgtcacattcgatagggctcaaatgtcactgtctcaaattttgtgaggctgatatgtgggcccatataacatttgagagtaacaatttggaagagtggcaaatacttctagattctccctcaatccgacagaccggacccagcggccagccacatcgcataatctcgtcgcgcacacgacacacccccgctgcgcacccacccaaggcgaaatttcgccggcgcgcgggccccacgatcatcggcccaactcaggaagcgcaagaagaagcaaccggagagcctcctccggcggccatggccagggccctcctcctccggcgcggccaccccttcctccgccgcctcctgcggcctcccccgcctcccacctcctctgtactggttcgtcgtctccaaccctctcgagtcgccccctccccctcttccccttcctttttttgcagcccccgatcaaaggcgtcgagccgcggggatagcgctctcacaactgcaggacggacagctgggcgcccccatgtcgggcgtgcatgcgcggccattataggctcgtcgttgggggccatggccgcgtggtccggaagttatctcgcgtgcctcgagccatccgaagccaatcgattccttttctttttctttcttttttttttgttgatttcgttgtatccttcttagattttgtggattttcattgttgctgggttagtgggtttacaaaagggggaaatccctttgagttgaaagctgatgatgcattggtaaatatatgggtataacaagtttctgaacctgatgtgatggatactggtgacgatgagcatgcagtgcccactacttgaggtcttttaaggttttgattgtcgttatcccctagaactgcaagcccttggagttgtgtaccatttaccatgttgattaaggcagcacgattaattacctgtttttttatctgcatggattggctataacagcggacaacttaatctagccctgcttgttttctcctagtagaacggtgaaagaattttttatgactcaacacaaaaatcaacattcaggccataattattgccttctgttttgtttttgaaggaatcctgcaatagaaatgtgtcaccaagagttcagttgtggagattctctgcagaaggtgcgtaaatgcctagttctttcactctaatgcagtgacattgtgctaggttgatgatacctccttgctggaaatttttcctcttgtaatacttatgttttccatggtacttctttcttacgacagatttacttttttgtttctggatttgtcgtatggttatatcctgttaatttcgttggaaaatcttcatgggaatctagctggcatgtgtacagcatgcatgggaaagaaatatttgttttatacttatcagttatcataatggaagtgttatacagttttagctaattatcattataggaaaatatttttccaattcaataagaattcatgtgctaacctttgttttttatgtacaacacgaatcgttgttagtggttcccctattctggaaaattttacatgattgcatcttgagtttgtttccagattccagataacttgaaaattctattccaaaataacaataccgatctcatttgtcaagtttattggtgaatttgttcattgtatatatatccagatttaccactgactctatatatggtttattttttagggaaagaccagacaaattcaagtgaagatggttacagtgaggcaaacattaagaagaaggactttgcgctacaacaagctttggaccaaattaagtctgcatttggtgaggagtcaattatgtggctaaatcactcttacggtcctaaagaagttcctgtcatatctactggatcctttgcattggacatggctttaggaattggtgggctcccgaaggtgagttaagggtattaattcttttgtttaataattgttatattctagtatccaggatcactgatgcatgctctatttaggacgagtaaatgactttctactattgaaagtttaatgaaacttattttctattaaaaagagtaaattgaatcagagctccctgaatttgtagacttgtctcacctagctccctgagctgacttttgttttctaggctctttgaacttaaacccatttgcatcactggtcatctattccccgtttgctaacagaataatccgagcctaacagcaaatggatgcaagtttagggaggctagcaagcaaaataaaactgctaggtcaattaacatttaggaagttccaatgcaatttaatcttttaaacattactgacctgtttatcgccatagccagcatgtcagatagagttgccctttttttttc

SEQ ID NO: 50950 - DNA, 7405 bp, Oryza sativa
cagggagagggggcggtgatgataagttacccgagggtgacccggcagggccctggggtgtgagttgtctttctaaaataagagtgtctaattctatatatatctatatatcctatcaatagcattggatcctctcatgctcaataaattcatgtcttatgtacaattgcaattccaaatcaaatactatgaagcttaaaatgttgttttttaagtcatttctatatcctatatagttggagcaatgcttattatttgatcaccatgtcacatgcaattgagattatccattgatacttgaaatttattccaaaatttggttagtcatgcttcatttgatacttaaaattgaatcaattggcatagaaaatttcatttgatactttttgaatcggtgccaagaatttgagttgtctgttgttttacttttggtatctcttatcacacacaatacaccccatggatacaaagagttaggggggctctcacattctcaaaaatatgtgcatataagttcacttcatatatttatatgcacagatttagggggagatcaaattaacatttggattcaaaatcatttattatcaatcttttgtaagttttaattgtgttgtcatcaatcaacaaaaagtagaaattgaaaaggcatctatgcccctagtgggttttggttaattgatgacaaacaattaagagactaatgtgcttattgagtgtacaaccaagggattagtccgatgaagagacgatgaagatcgggatggagaagatgtaatagcttgtggtttcatggaaggttttttctgtgggtgctaatggttcttcccctaagtaagttaatgcagaggttgcggacatgaagctagcaccgatagtgggattataaagatcatgcaccatgacctctctcataagacattgaataattaaggatgggaagctaatctgaattacttcaaaagaaagctcgacctcccttaagcactcatcgctcatgatggtagtcaatcctctcaccgtctttttgagaaaatgttattcgagcggcgcagagggactacacgggacaggtggtctcttctgatgggaataggtcgaggtacttccataatcttaaaaaagatcatcctcgaactagaaaaggatttccagaggcagaatttcttctttcttcggtacccgaggctcgagtgagggcttaacagttgaattttgggatgtggaagtataggcttggattcaacgggtatactcgacttcctagcgggtttcacatcggacgatgggaggtgttctctacgatacaatccctaccttctgcagtgcgactagcctccggtgaaaaaatcaacatacgaggcagacttcttctcactctgctaaaagccgagaatttccatccataggaagacatcacgggttaacaggaagaaagcaagacaaaacatgcttttgagttctccccattcaccatgtgtcttcctaactgtgcgagaaggagtgctcccgaaccatggctacaaagctaggacggagttcaaagccagatgggttttgaaaggtagtggcttagagaactcgccttttgaagcggaaaggttttgaatagataggctgctccgtggtagaagagaagagaaaggaggaaagaaagaaaaagaaatataggggatgaaccaagttcgtagatgatacagcaaccgttccccggcaacggcgccagaagatgatttgtgcgccctccattccgtgtactcacgtctgattggcaatatgtgtattttgtcgtatggcgggtgtgttttctccataattcacctgcatacaaatattcacccagacttgtagaaatggttagtaataaccactacctctaagtttggtattttattttatattctttcatttgcgtttatataggatttgacggttggatttggtacttaaggaccgtcaataggcagcttgacagcggccagtcccctttgaggccaatggggaacaagctgtggccgacggctagctcagcggcttggccattggcttgtagactgggctagtctagcaaaatgggacatgttggtaggctggactagtgtttggtggtttgtgggctgatctgtttggctaggccagcataggagaagaaaataaaggaaaaagttcacttgaggtcccttaatttgttgtagagtttaaaattcatccacgagctataatattaggtatatatagcccgtccccaaacttataaaaacgggttatattagctcccaaggcagtattgctccggttttggctgacatgacgacagagtcagcatgggactcactttttaggacatttcattctaaaaaaaaattggtggaccccacatgtcatcaacaccacacacacaaacagtcctcctccctctatttctctccatcctctctctgcaacgggaacgctagctcgcgtcattcaggggaagtttctcctcctcctcttcctcctcccgtgggttcgtgtagcacccggtccaaatcggcagccagcaaaggtgcccgcgactcgagttatggtgacgtgaccgcaacgtcatggatgacgtgtacatccccttcattcttgaggaggcggcgacatcgtgggccaagatgtgggagagtaagctccacaccaacagttccagtttctacgaaagcggcggtggcatggacaatcactaaatactcgccatcgatccgacactgcgcgacaccatttgagcggacctgcaccagttcgtgagcaatcacgagcactacgcatgagtcggatgcgtgtggacacggggctacctgctccatgacctgcccagcaccggctagggtttgaaatttcgaaagtaggatttctgccgcaggtgggcgatagaaccaaaatttcagatttttttcgtacgaatttttttaaaattttgactgattttgaatggatttgaataaaatttgaccaaattcacaaaaatttgcaaaaaaaccaaaagtttcgggcgagatatgagcatttcggtgggggacaaatttcgaaccaaaatttcaaaccttggcaccggcaagaccagcctcgtggtggccatccaacctcctcgagttgaacatatacgacctggtgctaactcaccacagtgatgtccaactttgatctccgaaggctgctggcctcgacgcggtccaagtcggtcatggtcatcgaggacgtcgacttctccctcagattgttagaccggacgcgcgcgccggcatcctaggacgacgacgactagggccatgggatactgcgacactcgctcaattttatgccaccagtgcgtttcgtggaggctactgtggacgtgccgctcgccgtggtggtgccattcagaccatccccggaggtgaagcggctatacccgagcatcgacggcgcccctgtgaaggaggagctgcaggtgcaggtgtatggtgcttggcttcgtgtctcaccatcacatcgccaacgagcagggccactgcgagcttcctggtggcatgggggctcaccacatggcagctgcccgtgggtgtggtagcgctgcccccatccgcgaccatgccgcatctcaagtcccggaccttgtcggggctcccgccgtcgcagcactggcggggatacaccaccttccagggtttgcaatttcgaaatcatgttttttgctgcaggggagcgatagaaccgaaatttccgaaaattatttcgtacgaaattttttgaattcaaatttgaaaatttcacccgaaatttatgggaaaaaaatttgggatgcactgagaacaattttgcagtcatacaattcatgatttcaaaagaaataaatcatcttggaagcaattagtctattatagttgcatacaccaataaatccatcgcaagttcatcacatagctttaacagtccattacataagttttaacagatggtaacatagctttagcagtccattacataagttttaacaattcatcacataacagtccattacatagggttaacagtccatatgacaaatagtccataacatagatttcaaacattccaaataggcttaataatacatcacaagcataaattgtctcaacgtagcaaaatagcataatccaacagagtttcaacatcttccaaaagtagtcattcatggacatccatgtcctcattctcagtgaattcttgttggagttactttttctttgtctgatctgaaaaaagtaaagtatatatgtactagtcagtgcacattccatatgatatattacaggcttcactagcagctccttttatatatatattttttcagcataatagctcacatggagttttatggagtaatggcaaatatatgcagctatactttttttttttttgcggggaatatgcagctatactttaaacagatgataatcataggctgagcatgaatatgagacagtgcagcaattcagtttaacatgtatacaggattacaaggcagcaagcatcaattttaacatgtacacatccaattgttcacttcctagttcctacaagtagcgagcagcccagcatcataaattcagcagcaagcagcaaaattcacagcaagcagcaagcagcaagcatgctttagaaattcagagtgggcattcacaaaattcacaagtgatctgaatacttactgttataaaccaatgcattgacattcttcagcctccttgttgtacgccgagcatgctgcatctcaacacctacaaatagagaaatacattagtcaaatagagaaatacacacacctttcagccaatatgacaaacatcaaatatttaaaatgcacctgtagatttcattgcttgtaaatctctttggtcaggattcacatctccatcatggtcatggtcattatcactagaactactgtcccctgactctgcatatacagggctaccatcaatttcgctgtccgtgtcatcaccacttgcaaactcgtcctcttccacagccattgctttccccttcctcttcctgctgttaggcccatctccaggattctttctctttgttgcccatgtattaatgggctcatcaagtaacctctcgccagacatgtcgatgcggacagcgtctgttgggatacgcgtaggctacgatagcataaatcaaaaatttctatcgcgtaaaccaagaaccatgcaagtattagatcatagatcgttaccgctcgacgcgctgcgcagcggaagaagacgctgagaagtcgaaagaactctcgcgaagtagcgcgcgtcgatgtagaggaagtagtcgatcgcaccggctcgaccttctcctcctcctgcgttctcctcgccgtactcctacgacgatcagcaccgcaaaccagtggcgcctctaccggtatccacacgtacagggacggaacgccacgcacagatgtgctagcacccgcgcgcggctagggttttgctcggggagggaagtgacggctagggtttctcacgtgatgcaatacctccgccggtcacacccctcacgaatatataggatccatcactcgggcctccaaagcccgtaggactcctattcggatccttatctgcattaagctcatattggatctctatccaatccccttattccagcccattaagcgtgcgaccctgtaggttcatatatactcggctgtaacccgaaaactcattttcggtccacgcgtcaacagcggcccctagcagaacgtattgacccaccaggcatatataaagatcatatcggctgaacctctagtgtatacttgtataaacccctttgcctcacgatatcgattaagctcaaggctagatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactatccaattacggagtagcgtttagcagtccctaagtaagctactacgcatgttgggaaccatgataatctcaggtctaaggattcaacaccaacactaaatgagatcactgatgacacaacacatatggctcttgcattgtctcatgttgggtctatccaacaacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagcgtcaatttcggaaatttcgaaccgaaatttcaaaccctgccaccttctcttttcttgttctcttttgttcttttctcgtcctccaagcttgcgcaccatagctaggttgggaggcagtggatggcgcggaatctcgggcggtgtccgaaaggcgctcattcggcggtggagtggccaagcgtagcgaccgccttgacagtatggggaggcggtagagctgcggtggcatcataaagttggcaaaggcgttgggtcttgggaaggtagaggcgatggggtgctcggaggatgatgcacgtgtcaaggacagccggcggagggtggccatggtggcggagtacgtgtggaggccgttctggccgagcgcaacggcgccactagagagaagggagagggcggaggcaaatggagcggctctagtgctattggtgagctcaagaaaggtagaaatggagaggattgtgtggaggatggccaaaggcatgaaatcgaggccgtaggccacggcggttcgatttgggcgtccctctagccacgggaggggaagagagggaaggggaaagagatggctactgacatatggggcccacgtgggttccacactgactcagcatagctgagcatagtcaaagcgtcacatcaaacaaaacagggagccatcctgtcttagggtgaaagttggtgtggttttaaaagttcgagaacggattatacctagtattacggttcagggacagattttgaactcgacgacacccaaagtgatccaaaaaaaaaagaggggttgcgcttaggctttagtataggtaaggtgggctaggcccaccagaaaattagagttcggaaagaatatttcctcaaaa

SEQ ID NO: 50951 - DNA, 805 bp, Oryza sativa
atagagaggctaagtgcttctttcttattagagtatgcccaaagagatacatgatactatttccaatcatgagatattggagatttcaagaaaaaaaaagagagactacacaacggtataccgttgaacggtataccacttatcccccatgccgcggccccacgtgccggcttctcccgagtatgtcgcgtgctgctaggattatcatcacgcacgtttgctgtgtgtatcactgtatagtcttgttcctgatagctagctagtacctagcatgcctaagtcctgcctttggtactagcctagctagtaaataaaaccggaggtactactagcttgctatgcatgccaaatccctgtaatagctactagtagtcccgtaccctagctatgtagggtacttattatggcagagcctagtagctgtggacccctgtttttataacaggaatcaattgtgtaaacagtgccatttccctggatcaagtagtctggtacacatgagttcatagctgaaataccaaatgcacatacacgaaagtctagtgcgaattattacatcaaaagcccgtaggcatagtcttaaatcatcggaccgagcggtccggaatacattccaaaaacagaagtagataaggcagcggagttaaggcagcgacacgccattgccacaggcaacgaccgtaactaagacctactgagcgccatcgtcttcatcaccctcctggtaataggcatagggatcctccgaagcttcatctccggcctctgattaagtttatatttgcaagggtgagtaccaaccgta

SEQ ID NO: 50952 - DNA, 994 bp, Oryza sativa
ttgatcagtctgtgctaggtctcaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactccgctgccttacctacttctgtttttggaatgtattctagaccgctcggtccgatgatttgagactatgcctgcgggcttatgatgtaataattcgcactagactctcgtgtatgtgcatttggtatttcagctatgaactcgtgtataccagactacttgatccagggaaatggtactgattacacgatagattcctgttataaaaacaggggtccacagagttggtatcagagccatacgactgtaggaaaagaccaaaaggcgccccaccccttttctaagattggccaagggagaaattcccatttagtaatactttcaaaaataaaaactctatgtttacaaaactctgtacgattttcatcttactcttaactactttcttcacaaaacaagttttactctcagctgactttgggtttttcttaaaattagatggcagatcaagattcacccaccacctgggagatgggcgtaccccgctcagagggatacgtcatagagctacatcgggtgatgaggcgccttcggtaccccagatttccgatctaccgagtgagacaatgtggacccttttgggagggccggattgaggttcatccgcgagtcccttcagagtcagactacagcttctcgacacgccaccgtcgtgacttaccggagaccgcgatgcagacgcagcccgggaggccttcctctgac

SEQ ID NO: 50953 - DNA, 13601 bp, Oryza sativa
ttgtcaagagagagccttgctcctatctagatcacaaggtgatcaaatttttcggtgaattttgctaacatgatattgttggtatttcttagcgactaattcccagcagtagcactagaaataatcctggtatattatggttacagatatgatccgcaagcgcatggatatatcattgtagcatttcacccgggagtattccaaggtatcgcaagagaagatatgataagagagaactatgctaacaattcatatattacttatatacatcaaagtctatgcaggggttaattcagttcaaagggtagggtgacacacagaagaaagaactaagaactactctcactaaaatatagtttaagctaagtggagaaagaataagaaaaatatcattcctgtacttctagtatacatacatctttagtctatacttgctagtatacagtcatgcaaccaatacctcatacccagtgtcctcctggtgtttcgagaagccacccctgactgccgagttccttacgacagcccgtcatgaccatacaaccggggctaaatacggaggagtaccctccccaggaaattaacttaggacaatatacacatgcagaggacacccgtactaagctgtcaccatcagcggccagcatctgaaccactgtatattaccccaattaatggtatctaataatctaagcaccgcgcttacattactaaatactactctacatccttgcaaccgacatagagcaaccgaataatcggacattaaacccacaccaatacacctatctggaaagctagttacacgactatattgattcaagtataaagtaaagtcggcactcaagtaatatgaatggaataaaataccgaacttgtataaagaagaatattctattaattcaataagtcttacaaaataagaaagtaaagctattaaagccatactagaaatctcctgaagacttgaggactatgaagactattctatttcctactccactagcactagaactactaaacaatacttgagagagctcttgatcttcttcttgaggtgtgtgcttggaatgaaggaagtgaaggggtatttataggtggagatgacttgggagggtggagatcctccatagcatccaacgaacatcttccttctcctcatgccatctgtcctcctgaagtcggtaatagcgcgggaaccggtcataacgaccttaggtagtgagtagcctgtgtaagatgggggctgattgggctcagtggtgggtcggccgaccccttgctggctcttctggccccagctttctccagtagactcccatgttggcccctaaatcagtgacatacattctaggcccatttgtgattgttaaattggacatttaggccttctcatgcaattgcacatcaccggcagactttcgactaattgatcgatatatttcctcctccttctcttcatttatgagtgcttctcctgcatacatgttagtagcatagcatatagtggaagtaattattttatttaggaattatgcattgcaagcatagctagtcttcatatattggataatattgatggtcgaaactggttatcatgagatctaagtacttcgttttgtatacaaaagttcatgattctgctaggattacataaattcatgctagtagactcaagattttatttccatggcgagtttgaagtttgggcatcatgtttcgcgtcgctgcttagttcacacaggtttatactagcagattcaggatttattcccaatggtgagagtatggtctacttcttctgaatcgagggtgttacattatagtcatagagattgtttggcgcacaatgattttatctatgtgagattctttggatattgacaatttttatgctacaagaaaattggtctcaaggtgaagattgttaaacatgtgatccaaatattaggactacagtatatttagattagttttctaataggactctatattataagattagtttcctacttggactttgtgtcttcgcctattaagactcctatatttctcttgtaacccttatgaggagtgtgtgacaacccaatgcatccccctgcgtttgtatccaacttctcaatattgatcattgtcggtcggtgcccgtggttttttcccgcaagggtttttccacgtaaaattcgtgtctccgttgtgcatctattttcataaaaaaattatcccagacggacgacttaaggttcctcccacgaagaaatatcttcgcagacaaagctctaaagatgtccgtctaggataatatactatctttcatgtcggacgtcttaaatctctgcctggaatgatacattttcgtagttaagcctccgccttggacgtttgggagcaaaaatcgtgcatgcatgcttagtgaaaaggacctcgtatgcgaaacattttcctagtagtgatagaggaaacccactcaataatagtatttgggagcactgcttgggatcgatagacctcaaatatagctcgagctcccagttcttcacaatcttatagtcactgaagcctgctgtgcctgctgtcttgaatagatcacgccactcattttcatctcgctgtcgacctttggttacgaccatcataaccacattgatgaggagttgggcttctagaagtggccctgaaggagccccattcactatgtcagtgataatcaccttccatctatattctccgtttggaatagttttgttgcattgggctaggatcttcacgtaatcctcaacattccagtggtgaagcagaagctaccatgcacaaaacagtcaccaaaaaaaattaacaaatgcacaatttggtcaaatgtttctttttattactaatatatatatttggtcaaatgtttgttgtataattagattataatttaaattggtatttaatctatttgatttcttgtctttgctttacatgtgattcgtgaaatattttatcatgttttcttcgtatgctttggaatttagttattcgtaggtttgttttaaaataaatttccatacaactcaagcaatgatcacgacatgatgcaaaagttttaaaaactttgaaaccttaatgctttttcttaactagaatgttacaaacctaccccattaagcaaatcatgtccagtagattaaggtagagttgcaaggttacatggacttatttgtccaagcaaaaatttcgggtattattagtgtagggacatgaccctctaaatagaattgtgaggttacatggacttattcgtccatgcaaaagaaatcaaacatgtgtccagtatacttaaggctggggagaccaagttggttgtgggtgatgttgaattgttattcatctaggatgacttgcatgtttaaagtattccctccatcagcatctacaatcaaagccacacctagagtgcccaggggcactcatctctcaatggaggttacatctaagtggtctcttcaaaatctgaagcaaccgaataaaggtactcaaccccacaatgggtgtcccaaccaaaaaacccagggtgggtgttttcctatactacccctctcttctcccccctctctctcttctcttttttctttgctcctgcttcttcttcgtcgcccctcctcttcttcttttcttcgcctcgtctcacttccttcgcccgtcgccgtcctcccgggagtctcgcgccgcaccgccacagacaccgccgtcgcctccctcctcgtctagacaccgccgccttactccctctccatctctctccctccgcctccgctcgcctctttctctaacccgtagccggcggctggaagggcgatgaggagggccgccgccgccgctggagcaacgccgttgctggtggccgacgacttatgagcgcggtggtcaacggtgagcagcgcatggatctggcatgccggcaaccggatctggcgtaacggcagccggatccgccgctcgtctccctctcctctcaccggcacacaacgcgtcgttccgctgcatgcccctgccaaaagcgagcgagggacgtgtcccccagcagaggcgcgcgttccatcgcctcgggcgaaacggctaacggcttcggacggagggtgctagggggacgacctggggctacgcattgaacatggcctaagtgattttacatattgaaattttacataagcaagccggacacattaactcacatgaaacattcaacagaagttttacacgtattaattcacaaaaccaagcttgacatagatcacatatataacaatttgtttcagaaaatatgcccttccttcctttattcacttagatcacatcctccacagaggggacccacacaattagtgttggaaccactgctatgggtagacctcaaagacgcctcgagctcccagtttcttcacaatattgtagtcactgaagcctgctttgctgaagagatcacgccaatcattctcgtctcgctgtcggcctttggtcaccaccatcatagccacatccatgaggagctgggcttctagcagcagtcctgaaggagcaccaataactatatctatgatgatcaccttccctccatcttctcgggttggaatagctttcttgcaattagctaggatcttcacacaatcctcgtcattccagtggtgaagcacaagctaccatgcacaaaaaagtcatagaaaagttaacaaatgcgcaatttgaattacacacttcgtggcgcactagtcgttaactgttcttctatataggaaatggattctaattaattactcaagactcaagacgatgtcttccgtatttgcatgttatcctaatattataaaaaaaataacaagatatatcgatatatgatatatgactttaaaaacatccaaattcaaattcaatcatcacaagttataaaaaataataaatcaaactctcactggtatatatacgtgcgctgaaaatcacttttaattttaatttatttcagttaatactacctggagcatcacagcttgagcaggtgggatctcacggaacatgtcgcccgctacgtagttcaccacaccagttcgtgtctcgccaatcacccggggaaagtccagcacggtgaacttgatgtgtgggaaggcctcgacgatggccttcgccgccctgccgtcaccaccgcggcaatcggtgagcgactccaccccctggaacacctcacggcactcccggagaaccgtggggaagtctgagtggtcgtgcgccgctagagcttcgttgaacatcgagtcagactccgggtcaaggttcgccatgctctcgtcgaacagcgcggcgccgtgcacctcctcgaacggcgacggcggcgccgaggacgacggcggcaggtccttcccgaaccagtccgcgagccccatcgccgcctccacgaagtgcctggacgtcgcggcgagcaccacaagcacctggctcgggtggccgtcgacgacgggcgctgcgccttcgccttccaccaggagccacgacagcggggtgaggcggtacatcccggcccacccggtggcggtgtcgtcggcagcggcgaagacgcccgagttgaccagcagccgcatgaggcggcggaggaacgggagcttggcgggcgggagggagagggcggcgacaaggtcgggcagcgaggcggtgccgccggcgcggtggatggcggtggggatgccgagcttgacggcgcactgaaacgccatggacgtgacgaagtagaggctgtggcgcaacatgtcggcctgcgcgtgcagcagctcgtcgtcggtcggtggtgccaacatgttgggaggctgacctgccattaaaaattgaaatctagctagctatctcgatcgcgattaacttctcgcgactgtggtatgtttgttgtattagcatgggtacgagtgacgggtttaaatagagtgaggctcagcgattcaactgtcaactgtggctcgtgttcagcgtggaaatagaaaattgttgtcaatggccgaatggcctacagttagatatggtagtttgatttcgttttttatttgtacacgtgtgcactgttatggcgatacgatagaaaatctgtaggttgatacgtgggtactagttatttagaaaatctaattataacaaggtagcccgtgcacatgcgcgggcatcttgtttaacacgtttaaaatttgagacccactacgattctctctattgatagtagaaagtaatctaatccgttgatcttatttgatcgaatgatttagatctatttatactaccaccctaaatagcagtagttcaaacatggagagacattactataaaaaaagtgcgtaaggggtataattatcatttagtagtcactaaacctagttttattcttgtttggcttatttcgatggaatatgagcgatgccagcacaataaataaccacagattgatcaatctagcccgaaaaaaatatataaatgaaaaggttagccttaatcaatgtattagtaaataacgaatggatcagatcatttctactggtgatataatagtatcagtagagagcatcggatcaccactcaaaattttataacaaatatatatgcgtgagtgatatttttattgaaatatcttttttactctattctaatttatttgggattacgttggaaatgatttttttttctaattacccttgcatcatataaattgtaaactaaaatcatgtgaaatcgtgaagtcttgaatttatttatgagaaaatatggtgtcgcaatcacaaccatggaattggtttgtatgatgttttttatactgtagatgtttttcgattttaggataaattagttgaagatatttgtttattaaacatattgctaatatgactacgtcatctaattaaagatagacttatactctatagaagtcaaattttgtcctaaaatgtttgaagtttattgaatctgaccaatttaccgaatagtttatgatctcaacctaggaattttggtatataagccaacaaatcatccaagtaattggttggaactaatttatttcctttgcgtatatttgtttgtttcttttgcaatgtatttaatttcaaatactacagtaagaattcaaatttaattagtatcttcgatttttgtttactttttacaactgacagctaattatcaagagtgggttttatcatgtggttcaataagttaatttagtatttacaaagaagcctcgctagcaattaagacccggtgattattatgttgttgtcgatgggggacacccgtagaccggatatagagggtattggggtacgctggtacgaggatctacgtaatatgacatcaagctaatagaaaacatggattatattggttcaggccccttggtaggccccttggtaggtaataaccctaaatccagttgatatgggattatatgatggaatcacagattacaaagggaacaatggaactcgatgataccgacgagaccgtagtcaagttggttcgactagatcacccggcgacttggctcctgtaggctccggcttcgtaggctatggtggttgtctcggctgtgagattcgatgccttaggtccttccggtgggtcccttttataccgcaggtaaggtggtttccaagtaggactcggagacatcggaccctacacgatacagtgacgacccagtccgatccgagtaggaacctttccatctgtggactccatgatgaattttcttagcgtatacaaagaacatccgtatacgcgcagatataccatatcgatgtatagcgtatatccaagggtagagggtataccttattcgtaaccctgaaagtagcccctgacttctgcttaaatgaactcatgtaaccgatcgcgacttctgatgtcgggtttgttgtcgttctcgactggtcgatctcggcgtgaggaccgtagagacaaggagtaatcgacgacgccatgcgaagttcaacggtcgtgagtgaatttaaattgaagtccaaaaactgccgcgtgtaacggacccagaaatttccggcggccatctctctcctttccttggaattcgcatcgtcggtagtgcgtctatttaagggagttttggggatccattttggagcccgcctgttgcaaaaacttcctagcctccaagcgctcttcgtcttctccgctcccgcacaaaccctagcttgctcatcttggtccctcctccggtgatctccggcggcaatggacctcgacaagtccacttccaccagcgcgtccctgaagaagttgcaggaggaaggcgctctccccggtcgcgggaccatggagagggaaccaggaggtattgaacctgaacctgtcctgggccgcatggttgcggttgaggactacattctctgcggttttctcccgccgccttctgagtttttccttctcgtcttgaatttctacggtctttctctgctccatctgaaccccaactccatggccttcctcagcatcttttcccatctttgtgaggtctacattggggtagagctgtttcttgatctctttcgtttctactacgagctgcgctggatggaacgtaaaaatgtgtccgggtgtgttagtttccgacttcgggatggcctgaagtcgcgatacatccccttcaagtgcccctcttctcgtagcaaatggcgggcgaggtggttctatcttcagatagaaaatttggatccaatctttgttgtccctgaggaacaactagacaagattccgttttggaccgccaagcctgccttgaccccatcccttcatgtggacccccgtttttataacaggaatctatcgtgtaaacagtaccatttccctggatcaagtagtctagtacacacgagttcatagctgaaataccaaatgcacatacacgagagtctagtgcgaattattacatcataagcccgcaggcatagtctcaaatcatcggaccgagcggtccggaatacattccaaaaacagaagtaggtaaggcagcagagtcaaggcagcggcacgccattgccacaggcaacgaccgtaactaagacctactgagcgccatcgtctccatcaccctcctggtagtaagcgtagggatcctccgaagcttcatctccgacctctgattaagtttatatattacaagggtgagtaccaaccgtactcaacaagccaccacagcaacaatgcacatgacaggggtattcaaaggatggctatggttcttttgcgcaaagcaagttttgtaattctttttcacaaacctgagacctagcacagactgatcaaattttagtaccagtgttcatattaaacaatgacggttctgtccaccatccattgtgatcccaaggatagcttcccgctattgagtcgtcatggttttctgaggacgtccacattcccgcccctcaggaagtggctccatcagcatagaaatcatcatgcaatatcccatcccacacaagttaagaatttagagtctagccaagtgtaatacatgtcccagtgctcaataaccgcgagcacggctattcgaatagatttggtttactcacactgcagtggatgtacactttacccgcactccgcgactgcccaacacatgagcctcgtcccaacacatgagacgtgttacggcaaagcttttcgataacctcgcattggcagtacccgctccatgaactttacatcctcatgcactctaggcgtacacggtttctagcagtgagaggagttctggtgcacccgggaagggaagactcacacatgcattaagttataattacgtttagattctcacatggcagtcctaccgatggcgacaccactgtagacacccgcctcgcggtcctaccaatggctgccccaccgtagagcccctgcctcacataacaagaaaccactatggatggatactgcctccgctcagctatctactccgcttggtctataccgatacgagaagtgcggttatacgggggtcgtttcatgcttaacttcatggctcggtccttaattgacaggggatggcactagccttttccggataccacccaaatcctccgtccgccccagtcgaaaatagttgtttaatttcatttctcctttcacaaatcatgtcatcaacatcatggcaatgtggcgctcatgtccccacatgctgcatctcaattaccttcccaaaggtaattgcccaagcatatagcatttgataaatatgagtatgcatgattctagaatagcatttctaagcaattgtcataactgagtagggactcatacgtaaatggttacaaaggcataaggggtaaacaagaaccaaggcatggcataatcacaagtaggatgttcatcattgcatgcaatttatttgtaaacaaaataatttcacaattgggatcaacatgttcaaagaatagtgatgacttgccttgctcgaagctttgcgggtcttggtcctcgctcggatccgcaactccctcgggctctaaaattacatgcgaagaaacaatttgaattcggttagaattcaaataaagatccaagtaaatccaagaagatatcgagcgcggaagtcggtttcatacattatctattttcgttcgtgaaatagagctactccgtctatttaactctatccatccccaaactattttgtggcataaatattttattagcacaagtttttaatttaatccgcccgggtattacatccatataataggttagaaatttctatcgcgagctaaatatcggacaaaatcctaaaattatcttataatattgcacgatttaatttagtctatgactaaatgattaaatataatacacggctaaaattcctagtaattaaatccgaatttctaccgtgaatcgattacttatagagattaccgaaaaataatctataattatattaaattttgcaattctacgactataattaatctataattaaattctaattattttaaattttctaaacttccttaatctccctctaatttctatttatttttccttttctttttctctcctcttttctttcttttctttttctcctctttcctttcttttctttttctcttcttctttcttttctttttctccctttcctttcttttctttttctctcctccctcccggcttctttctacctctctctctctcggctcttgctcacccgggcggcaacggcggtgtgcgcgagggggggaggagacggctcaccggcggcggtggtggcggtgacgacggtgacggcggcgcaggacgtggcgcggcactcggtgcggtgcggcgtcaccgaggtcggcggcgtggcggctcaaatgcggcggcgcgaaggcggtggcgtggtggcacaacggcgacacggtgtagtgggtagaggagaggaggagggaatggagtttggagaggggagaatggtgggcttatataggggagagaggggataaggggggagagggaagtgaagggggtgacgcgacggtggcgcggcggcgcggggcgcgaggcggcgataggacgcgcgcgcggcgatggaacggcgacagcgacggcgcggcagtggcggcaaggggcgcgaggcggcgatggaacgcgcgcggcgacgggacatcgacggcgacggcgacaacggtggcgcgcggctcggggcgggacgcgacgtgcggcgacgcgacgggcggcgacacgagatcgaggcggcgacagcgacggtgcgacggcgacggcggcacggggctcgaggcggcgacggcgacggcgcgcggcgatggtgacggcgcgcggcgagcggcgatggtgacggcgcgcggcggctcgggtcgcgaggcgacgcgatggcgcgcggtggtagcggcggagcgaggcgacggcgacggtgacggccggcggcggcgcggggcgcaatgacggctaggcgcggtgtggcagaggagggggatggctaggggacgcactcgagcacctagcgtgcaatgaatagtgacttttcctatttatcccgattttagactattttctatttaaatatagccctataaattctaatttttgcataaatgaagtttactcaatatttgtgttattgtaactaaaaattcaccctaaattaatattacccatattttatttttatataatttatttgaatttttaattagggttaattcttgctccatcgcacttaaatttaattattaccattatggtcgcgataatattttatttatttctatcctcacctaatctttattttaaattatatttattttgccaatttatttttagggtttattcctaattaactattctttactcacaactaatgaatttcgaaatcaaatccaaataaaataggcgaatagaatcggcatgatgcaattaatttaaaaagtttttgaaggtccgcatttttagagttttgtttttattggtcgaattttcagggtgttacaaacctaccccccttaaataaatctcatcccgagatttcttatcggatttcgaatagatgcgggtattctgtctccaagaattcttcgctttcccaagtggcttcatcctcagtatgattactccattgtaccttgtacatacgccacactttggtcctagtcctcttttctgcttcatccaatatccggactgggtgttctggatacgtgagatcattgctaatatgaatttcttccaacggagcttgttcctccggcactcgtaagcacttctttaattgagacacatggaaaactgggtgcacatcagcgatattttctggtagctgtaactgatatgcaacttctcctcgtctagcgatgatttggaaaggtcccacatatcttggtgctagtttccctttaaccttaaacatttttgtacctctcatcggagaaaccttcagatatacataatccccttccttaaattctagatctcttctccgggtgtcagcgtaactcttttgtcgtgattgtgccacttttagacggtcacggattaggcgaaccttttcttcggcttcttggataatgtcaggtccaaataccgtccgttctccagtctcggaccacattagtggggtacgacatcgtcgaccaaataatgcctcatttggcgacatctttaggctcgcttggaaactgttgttgtaggagaattcggcgtagggcaaacatttctcccaatccttgctaaaatccaaagcacaagctctcaacatgtcctccaagacctggtttgttctctctgtctggccatctgtttgtgggtgataagctgtgctaaaagcaaggtaacttcctagggcttcatgtactttttcccagaaatgcgaggtaaactgtgtgcctcgatcggatataattctcttaggcacaccatgaagacatactatccttgtcatgtataactcagctagcttggctccgctataatttgtcttgacggggatgaaccttgcagtcttagtgagtcggtccacgattacccaaatggaatcgtaaccagttgcggtcttatgcaatccaacgataaagtccatacctatctcg

SEQ ID NO: 50954 - DNA, 2836 bp, Oryza sativa
tactcaatatttgtgttattctaactaaaaattcaccctaaattaatattacccatattttatttttatataatttatttgaatttttaattagggttaattcttgctccatcgcacttaaatttaattattaccattatggtcgcgataatattttatttatttctatcctcacctaatctttattttaaattatatttattttgccaatttatttttagggtttattcgtaattaactattctttactcacgactaatgaatttcgaaatcaaatccaaataaaataggcgaatagaatcggcatgatgtagttaatttaaaaagttttcgaaggtccgcatttttagagttttgtttttattggtcgaattttcagggtgttacacttcagtcattcatcgatatcatcaatgacctccgagtacgtgggttgtcggggtatgaagtcgctgccgacttcattggtaggcggatccagccgctccaggctcgagcccacccagcctctgactactctgggtcggaggacgcgacccgggtttctcctcggggtatttttcttgcattctgggttcccttccttatgcatacattcctcctgacttatcaaaatctggttcttgatctataggtttgaacagcgaaaccgtggagcgccgtgttggccaggtgatgatgagcggccccacgatggcgagcaacgtccctgcccctctttgcgagaaaggggcagctgagggcgaagctgcaatcaacgtgagtgtactcgatgaccctttctctttttcttccaggatcgcatcgtgacttcatgtagtgcaggctctccctctaactgacgtcatcgggccgctcgtggaccaccaggcggcggcatcgctgaaggaggacgtcgccaaggaagcgtccgatgttgcccccgttgctgccacgaccagtggcggcaccgttccgaagaaggggaggaagttttcctccgtgctcggtaaccgtcggaaagcacccactccatcggtaagccgtctttggttattgattgcgtagttggaagatgttgtcctcacaccgtactcggtttacttaggcctcggatgcgtctcccccacctccgcgacggcagaggctggtgacacttggcgagaagtaagttgacgagtttgaggtcgtttgattcatcgaattcaggcggctcgtcttgatggccattacgggaatttttcatagggcggtgtgggcgaaggcggcacaagacgggtctggagggaactctagtgcgtctcctgcagtggccttgacagatgtcgtggtcgtgcccaggagccgtgaggcgacgcccagcggccctgccggcgaccttgtgcctgctcgaggcccacccgctgacgtcctcacctgggaggagctccaaatcgagatggggcgcatcctccaggctggcgctcgtggcataggtcgcgagattgcggcggcgagggcggcggcggcttcgtcggcgaacgaacgcgccgacaagttggcgcgttacctggcggaggttcgcgaggacctccagaagatgagggagctggtggccggcaacgagcggcaatggcaggggctcgagcaccgcatgtcgaagctcgagaacaacctgtcggacatccgtggctcgctgcgggttacctacaccggcctgcaccagctcaccggggagtgcagtgtcacgaccaccatcccggtgaatcccgatgagttctcgctgatgacttcgctcgcgaaactagcgatgatgatggaggcgatcccctccaagcatgcggccaggatcggggaggagacgtcaaacgggatctacaccgggacgtgtcacatcctcgcgtgcgtaaggttggcgcaccctgaactcgatctctagaggatcttggatcagggggcggctaacgacgcgcgtaaggatgtgatggaagaagtcggtaatctgggagagtctgttctcccactttttgaagagtaggacttcggttcgcctgtactccttaattaatcatggtttgtaaaacttttgtcggttccaactgcctttgtgcctttgtgtagtcgccgatcgaaagcgtgcatgctcggatgcgcttctcgtggtatcgtcgaagggcctgttggtagctagttactctgacggcaactcattctcgatgttcctcgagaaggttcacatcgtcgcctcgctactcctcctgatcctggcggagtacttctgtacttgtgtactctgatgttgcagttcagtgggaagcatggcttctgagccgtacacgaggaagaaaggtgtctccttgttggacgttgtcggtgtggtgcgcacggcccaaagtaccgaggggagttcttcgacccacttcttgtcatgtgacatgagcctgtcgtagacacgggtcttgattccttgtagtactatgctgtttgccctctcgacttgtccattgctttgagggtgagagaccaaagcgaagcagatcttgactcccagtccaatgtagtaatcctggaagttggcactgatgaactgggagccgttgttagttatgatgcggtgaggcaatccatatctgcaaaatatccctttaatgaatttgatggtgttgtcggccttaatttcccccatgggtgttgcttcgatccatttggtgaacttgtcgatcgccacgaacaggaacttgtagctgccttgtcctcgtgggaatgttccgagtatgtcgagcccccagcacgagaacggccaagtgagggggatggtttgcagtgcttgtgctggtagctttgtgtgtttgctataaaattgacaagcttcacaccg

SEQ ID NO: 50955 - DNA, 5305 bp, Oryza sativa
tggcttgacgggttattttcttggcttctgcattgtcctcaggcagcgcgtcgctacttatgaatttaattagtgggatccgccagtcgtctgtggtctcgatgtcagcaacggtgcattctgcctctgttgccctcgagctgatgtcgggtgcgactgtgctattttcgtcgtttgcttctttcatcgatggttttgtcaggacgtccaggaaggtgtcgggttcgagtggctcccgtctagacgcacgccgtgccagattgtctggttcgatgttgtccttgcggtatacgtgtcagacctcgattccatcaaatcttttttccagcttcctgacttcagcgaggtacttggataactcggggctagagtacttgtagtctttgtgcacctggtttgcgactagttcggaatcccctttcatgatcagtcgcttgactccaagtgcagctgcagctcttatcccagcgagtagtccttcgtactcggctgtgttattggtcgccctgaagttgaggtgaattgcatgcttgaactgatctcccgaaggtgatgtcaagatgaaccctgcccctgctccttggctattgagtgcgccgtcaaacgccattgtccacatttcgttgtcggtttgactgtctaacctgttttaaggcatagtccaatcggctacgaaatcggcgagaacctgggacttgatggctgttcgtggcacaaaatggacatcaaactggcttagcttgactacccatttcgcaatgcggccggcaacatctttgtttctcacgacttcaccaagagggaaggaggaaacaactgtgaccctgtgggcttggaggtagtggcgtagcttttttgacgtcataattactgcatagagcagtttttgaatctgtgggtatcttgtcttcgcgtcatggagagctttgctgacgtagtagactggtctttgcaccttttctctctcgacaacgatgacagtactcatagaatatggcgtggcggcaatatagaggaataattcttcattaggttggggagcaacaagtacaggggggtttgacaggtagcgcttgagtgcgatgaacgcctctttggcttactgtgtccatacaaatttgtcttgttttttcagcagagcgaagaaggtttgtcctcgttctcccatcctagtgacgaacctgcttagtgccgccatgcatccggttagcttctgtacttccttgagccttgtgggcgacttcatgttctcgattgccttgatcttctcgggatttgcttctattcctctgccagagacgaggaacccgagcagcttgcccgatggtactccgaacgtgcacttctcaagattgagtatgaggcgatatcgtcagaggttgtatgtttcccgtagatcgttaatcaatgagtcgcctgtcttggtcttgacaacaatgtcatcgatgtaggcctcgacattattcccaagctgatcgttaagtgccccttggaccgtgcgttgcaaagtgtttcctgcggttatcagtccaaacggcatcttaacatagcagaatacactgaacggcgtgatgaatgctgtcttctcctcgtcctcttttgccatgctgatttggtggtagccggagtaagcgtcaaggaagcttaacaactcacaaccaactgttaagtccaccagttggtctattcgaggaagagggaagtgatccttgggggcacgctttgttgaggtcggtgaagtcgacgcacatcctccacttcccgttggccttccgcaccatgactgggttggctagccactctgggtggagtacctctctgatgaaaccagctttgagaagcttgtcgagctcttctcatatggcctgttttcgatctggtgcaaatcttcacaatttttgttttactggcttggcattgggtcgcaccatgagtttgtactcaatcacctccctaggtacccccggcatgtcggacggctgccaagcgaacacgtctgcattgtcgcggaggaaggtgatgagcgtgagttcctatttctcgcccagtgatgccccgatcttgacggtcttgtcggcgttggcgctggagagcggaacgatcttgattgcaccgtctggtttcggcgtcttgcttgctttgctcactttcttgggtggctcagctgtggcgggtgggctggcagtgtgctcgaccatgtcgaggctccgcttgtcgcattgcaccgccagctttgcattcccttgaatagtgattgttcctttcggcccgggcatcttgagcacttgatacgcgtagtgagatgcggccatgaacttcgcgagtgcatttctcccgatgatggcgttgtatgctgtatcaaattcagcgacatcaaaggtgatatgctccgtttagaagttatttgcttggccgaaagtcacaggcaacgtaattttgcccaatggcttggacgacgactgaggagtaatcccatggaagggttgattggtgggagtcaactcgcttcgtgggattcccatcacatccaaggtgcaggcgaagaagaggttgatggagctgccaccatctatgagaactcgcgcgactttgatgttccgaatagtgggctcgaccacgatcggatatcgtcctgggatgatagcagcttgggatggtcctcatctgagaactcgatcttctgttcggaccacttcatcttgggtgcggccccctgccatgtcgaacaaacttcacgctccattttcttgtattctcgctttgagtagtacgccgtggaacctccgaagatgtgcgagacatggagatcggaatctaggtatgccgagtccaagtcctgagtggttgcctcagtggccttctcgactactcgtactcgcttgcccttctccaatgccagttgcttttccagcgactttttgaagacgaggcaatcatctagagaatgtttgtccgacttgtgtatagggcaccatattctcttcgtgtcgctgccttgtgggtctgggtgcttgggagggcgcttgtattctgacgcgaggacttccgcttgagctttccttttcccacttttgctacttttcttcttgcttggttcaagtgcgtccttggctggtttcttctctccccccaacttcggcttgtcgttcttgcgtcaaagtgcgtcatccgcatgagcgcatcgatcgacgatctcgaaaaatcttcgagtagttgtgatccgtcttgttgccaactcctgggtagtatagcgatttctgacaccggttttgaaagcacgaatcacagaggcatcggtgatttcggggtttgtatttctgcactcattaaagccgattggtttatactggattatattgttatttcattacatcatcatcaaccgattgcctctatatcattatctacattggatatatagccgattgcttaaaccctatcgctatcggctggtatcggcaacggctattatcggctatcggctagaactactccatcggcttgtcagccgatcggctgttttgatctactatttgcatatcttgtcagttgcaggatcaaactgactcgcacgcccgcatctcattaagatttggacctgcacaggagctaagcaggccggtgtgttcgatttttttcgtcaacacaaattggcacgcccagtgggacacgagttttatatccacatgtctgaagaagaagtcaatgccaagatcatggtcacagtggagaatttaacggaggaacaacatcggcttagagtcagcatcggcttcgaagtcttgagattagccgatgagagttgtcaagccgttagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagtgtgctataaggactttatcttttccttttatctttaggaacgtttctttcttggccgacaaggacttgtatcaacccatgggtataaatatgtacacccggggtctatgtaatcatcgctacgatcaatacaattcggcgcatcgccaccctttttacttctacttttgtttttacgttcaggcggaacttggcacccgacgcggtgctgcattgtcttcgatcaacggcgcaaggataagtccaatgttccgtcggcccaggcaattatatcgtctacgtcggcgtcgttcaaggctgcatcaatacattcgacctcttggattgctctggtttggatgatatatttgcctaaccatttatcatatgtctttgttaatctagtcttagcatatcaatttagctctatcggctgcttctcgttttagggtttctgccggtatcggctaaatcgcgttgctatattagattagtttagacatctaccaccctgaaaatcagtcaacggcttgattgtctggatattatgattcttttcatacttagtgctgcatcagttaagtttgatctactaagtcatacttagaaccataatctctagcctgcttcttgattgccaataagggtttcatcggggtttcagccggtgagttatctgtatgttgcatcggctcataaggattgcatatacatataagttggatttagcccatgacaataaaggtttcactgtttaatctaatcttgtggatttcatgacattggacttccagccgatgtgtgctttaaccttcggatggatgcttatttatcatatcattatttgccgattggtttatactggattatattgttatttcattacatcatcatcagccgactgcctttttatcattatctacattggatatatagccgattgcttaaaccctatcactatcggctggtatcggcatgggctattgtcggctatcggctggaactactccatcggcttgttagccgattggctgttttgatctactatttgcatatcttgtcagttgcaggatcaaactgactggcacgcccgcatctcatcaagatttggacctgcataggagctaagcagatctcccaggccggtgtgttcgatttttttcgtgaacagtagggcgggaggtgcatcagccatgaacgcgcagaacccttcaatgccgtcggtaaataatttgccaacacgttgtcgtctgctccggcagcgtagagtaccgtggagtagacttgaaggaattcttctgggtcagtactcccatcgtacttctctgttgctcctggttagaatctctcagg

SEQ ID NO: 50956 - DNA, 1623 bp, Oryza sativa
cccttttataccgcaggtcaggtggtttcaaagtaggacccagagacatcggaccatcggacctatacgatacagtgacgacccagtcctatccggataggaatctttccatctgtggactccgtgatgaatttccttagcgtatacagagaacgtcggtatacgcgcagatataccatatcgatgtatagcgtatatccaggggtagagggtataccttatttgtaacctgacagttgtgttatgggcttttcacctaattgcatattatttttttttaagaattatattctttctagtttttaatagatgccgttgttaacttttactaatatatttaaccattcacctcatttaataagttacgtgactatcatttatttattttgttgtaagttggtttatcgttaatggaacttttcacataacctacattttttatactttaaaaaaaatatttgaataaaataaatgatcaaatttatatctaaaaaagtaatagcgtcaatctatgaaaaaccggaggaactaattagtaaaatgtaaagcgtgaagatacatggctcgcactttttttccatttgacaataatcatagtccatacacaccttaaataattgattgaaatgtcaggatattaaaaaataaactaaaaataaatcgactcaacataaagttaaaaattatttgtacgtagtgcatgtccacgcatgcatatatgcttgcatgaagacacttcttgcagctggcagattgggctatatataacgatggaagtctatgcccttggccccgtgaggcgtcttgagagatatgaagtatctaatatactattttaaattactcatgttaacagaataatgctgcaaatcttaattactatagagaaaaaataggagggaggattacacacgcacgcgggtgaggcagaggagacgggcaacggcgccgcgaaagtatgtgtgggcggaattagggtattagttttcttggatagattaatctaatggtttataatagtagacccaccgatttaactgaaattaagggtagattttctgttttttataatttttaagaatttctctaataatttatttgagcgccatgtgacaactcgagagtgttttgagggaaccacgtggcatcttgagagcgtttttgggaggttaatggactgtttagtatataataatagaagataatagatagatagatatttttatgttttgtgtcacttacatgtgggtattagactattgactagtcaatttgaccaagtcgactttgatccctgctccacttgtcaatgataaagacttttaaaccccttggaaaaatatttagcaaattaattagaaaattttataccccttgggaaaatatttagcaaattaattggaaatactttggaaccacctatcagtgactagagttcttttgttttataaaaccaattcggacactaaaagaaaactatgcaaacagtaggttttcacaattgtttgaattaaattaaatttgaatctttaaacacccataactcactcatcctaagtccaaatctagtgaaacttacacctaaattcatctaaaatcaagatctattgggctgcaggaatt

SEQ ID NO: 50957 - DNA, 2643 bp, Oryza sativa
gatgctcctgttctgttatcttgcttcatctccatttattcttgatgctctagacaaacttcaggtgagaccgtgagagaggggaggctggatgagaagactaagcgcgctcaaactttgttagcgctgcagccacgctcgaccttcgccgagggtcgcgacgatctcgatcgatttgtgatttggaggaaattattaagtcctaggcaaatagaggagagctgacaatgcagtggctctgctccagcaccgttcgtacaatcacccattctcaggctgccctgtgcatgcattgattcaattattcaatctcattgttcttcatcttgtgtgctcgctagcacttgtgcaaggctgtagctggccgtgtaataggagttggagcaggtctgcaggggatagctggccggccgctatatgctggtactggctgaagagacaagctcagctcaccagtgtggatagagagttgggctcagggagttttgaggaagaaggagaaggaagatccaatgacatgtgggccaccggtacaaggtgcaaaattggtaacaatacctagttctaggtgaagaggcttactaatacggtaatgcctggtctaatgtgcaacataggtaactaaacctagcctaaagtggaattcactctttataaatttttatatgattctttgagcaactagcacgaaagccgttgcgcgttaacgcattctccaccacatattattatatgactttctgaagtgtgaagtgctcagaataatccaagtcgttcgacccctggatgtagccactaatgtggttcaccaggttaccaaagagatggttggcttgaagagtttgatgagcatagtcatcgaacttcactattgtcatgacatcttcatctaactgagtcattttgaagaataaatcaggggttttgtgctccttggtattaggcctataatcactttatagataagtgtcaacctcatattgctactaatttggcttgctagcgaggacttggaatttctgcttataatgaaaatggatttacagctaaggttgagtccaccgcccccttattcgaacatgttgaatcaaattgcgaaatgttttgtttgtagataaattgcatagcatgctatgttgaaactgtgttccgatattgttgctcaagcctatccattgatattgattccatgcaatactttatgtccctagtcgattattgacaaaatgccgtagtaatgcttgttaattgatttatattatatgttgaataatagatggtatgggaataatcgctctgggtagggagtagttatgtttatgcatgtggtgaaacgctacttgtgataaacatgtgaaacgtttgcgaaaaaccaaagttaatgaacaaaattgatttcgactgggtgacatggattgatttgggtggttcctttttgcatattggccagacactgatagtggaacccttatatttaacattctggaaaatgtaaagaaaatacccaaaccaatattggttgaacgattttagttgaaccaattccagtggattcacaaaattgttcaccttaattttgtaaattaaaaaggtacgcttacagtacaagaatattcctaaaatttcatgtatgaaatagttaatataaaatatgctccaacttataaaatttgtagaaaattcattttaacttcaaatgagttgaactaaaattatttagaataaaaaaatgatctggactaagacctggagtaactggtacatataatacatccacatttaggtaatatatatgtaaataatcgtcataattaatatgagaacttcaaaaattcacaggaaaatggttccaactccaaatgaggtgatttcagatttgttagattcataatatcacgatcttagttgctttgaattaaaatgtgccacatactgcaatgtaaactgttagggttacggataaggtataccctctatccttggacatacgttgtatactgatacggtatacccgcgcgtatccggataatttctatgtacgttaaggaaatctatcgcgtaatagaaacaggatcaacaaatggagggagtcctactcggacaagactgggtctttaccataacgtgagggatctgatatctccgagtcctacttggagagatcaactaacccgcagtataaaaggaacccctgggcaggacctaaggcatcgaatctcaccggcaacacaaccaccatagcctacgaagccggggccctacaggaaccaagtcgccgggtgatctagtcgaaccaactcgactacggtctcatcggtatcatcgagttccgatatttcctttgtaatatgtggtttccatcatataaccccataccaactagattagggctattacctaccaaggggcctgaaccagtataatccttgtcttttgtttgcttgatgttgtattacgtagatcctcgttccaacgtaccccaataccctctatatccggtctatgggtatcccccgtcaacagtggcgcgccaggtagggggacttggcgctcaaggttctactactacgacttcaaacctcctcgacgacagcgtcaaccccgatatcaaccagggagcttcaacctcaacgatgctggtgt

SEQ ID NO: 50958 - DNA, 2833 bp, Oryza sativa
catcatcatcatcctcatcatcctcatcatcttcgtcatcggacagacatccacgaaggatgtatgatcgccgacaacccactgcccccagcggcgggtgtagggctttcagtcgtgctctacgagatgtccgatggcctgagagattccatagtactctacgctgccggagcagacgacaacgcattggcaaaattatttgccagcggcgttgaagggatctgcccgttcgtggtttgttcacctcccgccctacttgatttcttcatgggcagatttgtggcagcagttcgtcgccagcttctaaggaacatacaagtgccacgcgatcgaggacgacctacatgcgttgacacagaatccggcaaatcattgagggactatattcggcgctttaatgagggcagaaatatgatccccgagatcactgatgcttccgtaattcgtgctttcaaatccggtgtccgagatcgctacaccacccaagagctggtgacgagacggatcacaactgctcgtaagctattcgaaattgtcgatcgatgcgctgacgcatacgacaccctaagacacaagaacgacaggccgaagatagggggagagaagaaaccagccaaggatgcaactgagtcaatcaagaagaagagtcgcaggagtgggaaaaggaaagctcaaacagaagtcctcgcagcagagtatgcggacccgcccaagcacccagacccacaaggcgacgatacggagaaaatatggtgccctatacacaagtcggacaagcactctttggagacttgtttcgtcttgaaaatggcactcgcgaagcaattggcattggagaagggcaagcgagtacgtgtagtcgagaaggccgcagaagcggctactcaggactcagactcagcatatccagactctgacctctatgtttcacacatatttggaggttccacagcgtactcctcgaaacgagaatacaagaaagtggagtgtgaagcttgttcgacatggcagggggctgcgcccaagatgaagtggtctgagcagaagatcgaattctcagaggcagaccaccccaaggctgctgtcactccagggcgatacccaatcgtggtagaacccactattcggaacatcaaggtcgcacgggtcctcatcgatggcggtagctccattaacctactcttcgccagcaccttggacgcgatggggatcccacgaagcgagttgacacctactgatcaacctttccatggaattactcctcatccatcgtccaagccattgggcaagattacgctacctgtgactttcggccaagcaaacaactttcgaacagagtagatcacctttgatgtcgctgagtttgacacagcatataatgccatcatcgggagaattgcactcgcgaagttcatggctgcatctcactatgcgtatcaagtgctcaagatgcctgggccgaagggaacaatcactattcagggaaacgcgaagctagcggtgcagtgcgacaagcggagcctcgacattgtcgagcatactcccaacccgcccgccacagctgagccgcccaagaaagtgagcaaaaccaacaagacgccgaagccagaccgcgcaatcaagatcgttccgctctccagtgccaaccccgacaaaactgtcaagatcggggcgtcactggatgagaaataggaactcgcactcattaccttcctccacgacaatgcagacgtgttcgcttggcagccgtccaacatgccgggggtccccagggaggtgattgagcacaaatcatggtgcgacccgatgccaagccagtaaagcaaaaactacagagattcgcaccagataggaaacaagccatatgagaagagctcgacaagcttctcaaagctagtttcatccgagaagttctccatctagagtggctagccaatccagtcatggtacgcaaggccaacgggaagtagagaatgtgtgtcgatttcaccgatctcaacaagacgtgtcccaaagatcacttcccccttcctcgaatagaccaattggtggactcaacagctggttgtgagttgttaagctttctcgatgcttactccggctaccaccagatcagcatggcgaaagaggatgaggagaagacagcattcatcatgccattcggtgtattctgttacgttaagatgccatttggactgataaccgccggaaacaccttccagcgcatggtccaaggggcacttaatgaccagtttgggaacaatgtcgaggcctacgtcgacaacattgttgccaagaccaagacaagcgactcattgatcgatgacctccgagaaacgttcgacaatctccgacgatatcgtctcatgctcaatccagagaagtgcacgtttggagtaccgtcgggcaagctcctcggattcctcgtctccggcagggggatcgaagcaaatcccgagaagatcaaggcaatcgagaacatgaagtcgcccacaagactcaaggaagtccagaagctaaccggatgcatggcggtattgggcagatttgtcgctaggatagaagaacgatgacaaccctcttcgctctgctgaaaaaacaagacaaatttgtgtggacacaggaagccgaagatgtgttcatcacactcaaacgctacctgtcaaatccccctatacttgttgccccccaacctaatgaagaattattcctctatattgccgccacgccatattctgtgagtatcgtcattgttgttgagagagagaaggtgcaacgaccagtttactacgtcagcgaagctctccacgaggcaaagacaagatacccacag

SEQ ID NO: 50959 - DNA, 8844 bp, Oryza sativa
  unsure (1)..(8844): unsure at all n locations
tactcgctgggataagagcagcagccgcagtaggagtcaagcgactaatcgtgaaaggggattccgaactagtcgtgaaccaggtgcacaaagactacaagtgctctagccctgagttatccaagtacctcgcagatgtcaggaagctggagaaaaggtttgatgggatcgaggcccgacatgtatatcgcaaggacaacatcaaaccagacgacctagcacggcgtgcgtccagacgagagccactcgaacctggcaccttcctggacgtcctgacaaagccatcggtaaaagaggcaaacgacgaagatagcacagtcgtccccgacatcggctcgggggctacagtgtcagaacacgtcgtcgccgacatcgagaccacagacgattggcggaccccactcatcaagttcctgagtagcgacgagttgcccgaggatgacacagaagccgagaaaataacctgacaagccaagatctactgtatgatcggcaacgatctatacaaaaaggtgccaaacggggtacttctcatatgcatctcgttcgatgacggcagacatctcctcctggacatacgcgaaaggatttgcgggtcacacaccaccggtcggacattggtcggaaaagctttccgacaagggtttttctagccaaccgcgctcaaagtcgcttgtgacatggttcagcggtgtgaagcctgtcaattccacagcaaacacacaaggctaccagtgcaagcgctccagactatccctcttacttggccgttcttgtgctgggggctcgacacactcggaccattcccacgaggacagggcggctacaggttcctattcgtggcgattgacaagttcaccaagtggattgaagcgacgcccatggggtaaatcaaggccgacaacgccattaagtttatcaaagggatattctgtagatatggactgcctcaccgcatcataacatacaatggttcccagttcatcagtgccgacttctaggactactgcatcggattgggagtcaagatctgctttgcctcagtttctcaccctcagagcaatggacaggtcgagagggcaaacggcatagtactacaagggttcaagacccgtgtctatgacagactcatgtcacacgacaagaaatgggtcgaagaactcccctctgtcctttgggccatacgtaccacaccgacaacgtccaacaaggagacacccttattcctcgtgtatggctcagaagctatgctccccacgaagttgcgacatcagggcacacgagtacagaaatactccgatgaggaccaggaggagcagcgaagcgacgatgtgcacctacttgtggaacatcgagaaagagttgccgtcaaagcagccagctaccagcaggcccttcgccgataccacgagaagcgcatcagagcacacacactttcgatcggtgattacgtcctccgacgggttcaaaaccaagcagggcgcaacaagctctcacccaagtaggaaggtgttaacaaccaaatttggtaatatcaccatcggaaaagaggattagatcgaagcggagtcaaaggcgaagaccgattcgggaacagagtaagaatcggctggagtctagatcagctacgattggatcggctaaattcgagtcggacttgatttggtgaagcagccgattccgacaagacgacttggtgtacaacatcgggttgagttgatatgcttcaagatgattgccacgcatggatagagtcctgagaaggcaattgtatctattaattaggatattttatataatttccttagagatatgtttgggcaaaagtctgccgtaaagacttatggtatcttagggtatgttagagataagagtcgtgttcgatatggacatagtttgtaattctcgggtataaatagaccccgaaccccatgtaattaaaaaaaacacacacgttcaatacaatctcggcgcatcgccaccctttttgcttttgttttatttcgacgagttcttgctttcgggttgagctgcatcggtttcgatcttcaacaagaggtaaaacttgttatgacggcttgcgttctcgggattagtgcttccatctttatgatactctaatgttgtttatgtaattcgtcaagttatcatatatcttacataatctctagcaatatcgccatctaacctacaatcggctaacatctgtcggtagagggcagccgattaggttagatatcaatgttgacttagattatataggatatctaccactctatgaatcttccagcggcttgattgtctagatattgttcttcttttcatacttaatgttgcatcagttgagtttgatctattaagtctgcttagaacatcaatctctagcccgccttatggttgccgattagggtagcatcgaggtttcagccgatcttatctgatttaactacatttgctttatgtgtgttattgacacgttaaatctgccctttatgtcaagatcttattgcatcttagtatattaagcttctgtttggtatattctgcttgttttaatatcttaacatagagttgtatcggagtattagccgatacatgctagatctatcagatcggctacgctatgaacatatatagtcttgttgttaatatatatttcgatctaagtgatttatactgtctcggcatagcgaccgatctatcccaatcacttgattcaagtatatatcgacaccaggattatatattgttaatatctacaaccgattgagtagatttagttctttattatcttttgacaaccgccgatcgatttaagcatgacatcggctcaaagataaatgatacgacatcggcatctagccgatcggctatgatttatggatttaactacgatttctttgtctgtatttcttgttgatttcaggatcaaatcaactggcacgctagcatatccaaaggcaagttttggacctgcactggagttaaacagatctcctaggcctcgtgtttttcatcaacacgcttttggcacgcctggtgggaccgattagaagtcagaagtcctctcatggacggcaaaccgccaacatcaccatcctcagctagtccgggttctgttaaatggaaggtccagcaattagaccaatctgacgttaatgagggcaacgtcatgaccattactccagacaaattgacacctaatcagaagaaggagtttgaagcaatgatgcagcaagcacggaaccagtttttgaactcatttatgcagacccgcaaggggacagtggtgcaaaagtatcaggtgagagtagtggctgatgtccccgggaccggttcttccaaggatggggagtgaaacaagctccagatggctcggctcaaccaagcaacaaaggtgctgcagatgattctcaaggaaatcaaggtgaccactctcagggagctcaaggagttcaaggtgatggtgcccagggagttcaaggtgacggccctaatcaagacggcgatgcaacacagttgcagttcaacaactttagcgaacatggtaaagtcaatggttgatggttcaatggccgagtatcaagctacaggactagtctacttaccaggacgggtgttcccgaattatcggccattaatcatcgataatcaaccagttgtccagccggccattaatccaccatcggttcagccgacggcaccattaccagctcctgcacccgctgtaccaccttcggccccaggccaattggttaatccccgattgttggtgagagaacaaccacaacacagtggacagaatgtgaatcggctaacccaagaccaggttgcatctatgttcttacctcctcaacatgccattgatccaacccagcaacagccgattcagcaaacaccgccaaggcagcaggttgtgcagccgattcaacaaacacccccagtccaacaggttgtgcaaccaattcagcagacgccacagagacggcaggttttgcagccgtaacatcctggaaattcccaataataaaaatcactaaaattttgaactttttaaaacttttgcatcatgctggttgttatgattgctattgcttgccaaaccgtaaatgatcacaaagaaagtaaagaaaagaactacatttaggcaatagatatatttaatcctacaaataattatgcacaagaaagcaagccaaatcaagtataagtcaaatattaatttctactataaatcacagatcaaatattaaatatttgaaccatgctgatggcttgatgccatgattagctaaaagagatagtaaaatcaaatctaattcatttgaatccaatctcacatgaaatataagaacacatgaaatgatgatcaccactataatgatcgcgcttataaataagtaattcaccagaatatatagattgatacttagaacattttaccgagtccctcatgacatgaaaatcactcatataaaataatggtcatataaataaattaagaatatgtgagtgtttaattaaacaattaggttaatgttgtactgagtctcaatttatatttatagaatgaatagacccacgtaaaatgcattgttatacaaataagttcattcaatgtgctattgcaataataatggccacattaggatattttaattaattttagaaccctcgaagcctccaaaattatctaggttaattttataattagacctcatttaaataatgcaatagaaaaatatatataaacataaaatatgggtaatattaaaaattgagtaaactttcatctaaattaacacatctattgggtaaacatcaattgtgtgaaatctagaattttatgggacaagttttaataggaaatatgccctaaaattggataaataggaaaaagtcactgttcattatggcctaggtgctcgatgtggttccatagccctgcccctccactgctgcaccaccctagccggcttcgagccctgcccgcactggcgccaacgctatcccgtcgccgctgccgcgccaccgtcgccgtcatgtcgccgcgccgcccgccattgcgtcgccgctgccgcctgtcacgcgtctccacgcgccgtcgccgtcgctgtcgccgtcgccgacgcgtcccgtctcgcgccccgtgccactgcgcgccgtcgccgacgcgtcccgtcgtcgctccgagccgcgcaccgccgctgccgcgccatcgccgtcgccatcccgctgccaagccgcgcgtcccgccatcgcctcgagccccacccctccgcgcgtcatgtcgtcgtcgccgtcacgtcgtcatcatcatcgcgccgctgcctgccgcgcacctgacccgtcggccctgtgcccctgccccaccgcgcgcctgtcacaccgccgtcgcgtcgccatcgccgtgcgccgtgagccgttgctgtcagcctcgcgccccgagccgccgcgcgcccgtcgctgccgccgcgcgccgctcgccagtcgccatccctcccgtcgtgtcgccgctccgagccccgcgcgtcgcgtcttgtcgccgttgcatcgcgtcgccgcgcatcgttgttgcgtcaccgctcgtctcgagcccctcccctcggcgcgcgctgtcgccgtcactcccgcgtcgcgccccgtgccgcgccgcctcgcgcccctgccgcgccgcgcgcgtcactgtcgcccgtcccgtcgccatcgtgccccacgccgccgcgccgcgtcgccgtcgtcattaagcaccgcccacccttcccctccgcctatataaaccctccccggccgtccattgcttcccacaccaccctcaccacctcccctccctttcccctctctttcccgtccctggcgttgccaccacttcggaagccgccgagcagacgcgcctcgccccgtcgccgcgctgcgcctcgtcgccgcgccgtgctctgccatcgaccccgccgccggtccggtgagcctcccccttccccaccgcttgtcgtcgcgtcgcgccgcccgccggttccagccgagccgtgagagagagaggaagcagagaggtagcggggagagagagaaaaagagaaaggataggagagattagagtgggccccacgtaattggtgaatagtaatccccttcttaatctttattagttgtgtctattatatgtgggtccgggtggttaaaaatctaattatagaagttttatggtctcgagtctatgacatgcgggccctaccgggtttaatggccggtttgaccctagtcaaaggagtcgggactacctgtcatttgcccatatggattccttcagaaagaaaaataaaataaaagaaaagaaaataggaacaccccacctgtcagtcactatagcttgtggataatattgtattaaaaataaatgaattaggaacagtaccatttcgcaattattagaattaattcaaatttgaatctttaaactagcgtaacttatttgttttagctccgattcgagtgaaacttgaacctaaattcatctaaattcataagatttccaatggtatataattcactatttacgaaaatatatttaaattatgaaatagttaataccaagatgatgtataatagttaacttaaaaatgtgctcataaataggattgatattgtacaatagagtagatgtcaaataattgtctttaacacgctttctcactataaaacctatgtaaactaattaggagcattgtttcaaattaattaaagcataggaaatactagtgccatttattaatatatgtgaatatataactatactcatgacgttcaaattgtataaataatgtttagcctcatactttgtgactaaatttgaacacacgtagatgagtcttcaacttgtttatgagggataataacatgtttatgagagataataacagagctagtgtgactaaaatcacccgcacgaagttagttaacggcatttcctatacagtagtatatgtttaggttggaaattgacccttaagttgtatagacggtaacccactcataaagccacttaaaatcacatgtactgagtagcttgtagtaaatagcaactattcaaataaatgattcaatattaagatagatattgtgcatacacatatactgtacatcacattatagctatatggtatagtatcaatttgcttgttgcatgtattaaattaaagggaatatatgataaacatgtatattagataaatactagttataaatcttgatctcatataattatagttcaactgtaaatcagtattatttattgtaaaattatgtgatgagataatccgtaaccataatatgattaacctaaactattctaacatacaaagcatgggtaattgttaaccttttataatttattttgacaagtaaaatatgtacataattaaaataaagcctccatcaataaaataataatacaaatgattcacaataattatttgaccgatcctaaatccatctaacaacagaacctctagtatataaccgtcctatttagatagatgcatacatagccataatccttccatagccatttgatagactaaaccaccgattagccaaatatatatgtatcccataaatgctatgttggttaactcctaaatagaccacgatgacaatagaaagattaagaagccttagccctagcatgattgaaatccattagcaaacacgaatagtatgagcaaccctaggatcaaccccaacaattatcttttgcttgtgcatatttgcttgttgtttgaatattggtttttctcgcgtattatagacctggtgtatcggttagtcgtgaggcaacgtctgcaacttccaggaggtgaaggttgatcaagattatatcgagaataaggactatcctaagtaggcaagtcatcactattccttgaacatgttgatcccaattgcgaaattgttttgtttacaaataaaattgcatgcaatgataaacatcctacttgtgattatgccatgccttgattattgtttacccttaaaatccttgtaaccatgattacgtatgagtccctagtcaattatgacaattgcttaggaatgctattctagaatcatgcatactcatatttatcaaatgctatatgcttgggcaattacctttgggaaggtaattgagatgcggcatgtggagacatgagcgccacattgccatgatattgatgacatgatttgtgaaaggaaaataaagttaaacaactgttttcgactgggcggttggaggatttgggtggtgtccggaaaaggctagtgccgtccctggtcagttaaggaccgagccatgaagttaagcatgaaacgacccccgtacaaccgcacttctcgtatgggtatagacctagcggagtagatagctgagcggaggcagtatccctgcatagtggttttcttttaggtgtgtgatgcggcaagcagtctgctggcggatgcccggttcggatggccaggtggatggcggatgcccgttccggatggtcagaggttggcttggcaatactacataaggatacccataagagaacaatcatgatggactgggttcaacgacaagaagcaacgtaggagtgtgtgtgtttttcccttctcgagagcgccagaactcctctcactgctagaaacatatgacgcctagagtgcatgagggctaaagttcatggagcgggtactgccaatgcgaggttatcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 50960 - DNA, 7287 bp, Oryza sativa
atgcaatttagtcatgctcttataatcacaaaagtaattaaggacgataggaaattctgacaatacatctgttcttttgatgccttgcattccttagagcttgattgagtatgcaataatcctttgtttaaccatttttctcacaagaatcatctaagactgggtttggctgttggaatccctcacgcacgcaatacagaatgactcattagtgcatgattaattaattattagctaatccttcttgaaaaatggattaatatgatttttttaaagcaactttagtatagatttttttttttgcaaaaaacacattggttagcagtttgggaagcgtgtgctagaaaaatgaggtagggtgagttgggaaaatagggtaaagagcacaacttaagggttcattttctcctcctcaatgtctagaaacaagtctccttttagtcaaggaatttaggctccatacatacctccattcaagcttcctaactttcgaaaagagctcatactgtggtcgtgagatatgcacatgtaccagggaccaccacttggattcttgagtggatggcacatttcaaatggttcaaatgttgataattcgttgcttttgagactgcatgtccattcaagatgcgggaatttgaataacattgtggcgaacccttttaatccatccttagtatttactccatttttgtggatatccagtacttagtgccttttcttagtgtgcttatgacaatatgtgtgttcttgctatatcggtttggcaagagcatagtgtcaaaaataggtaagcacgttatttcccggaatttgtctgcagatattactagtttctttctattttgggtatacctttcaaggtatgtagggtatggatcaatttttctttggttcaagacatggtggtgcgtgcttcatgcacgtccaaggttcgacggtatgcgcaatcaaagtggcacgaggtatgcgaccagtgtggttacggtgtggctgacggtgtaacacgcatggctaatacggcacggattggctggcatgcggtacaacggggttgctagtcggtgcacagtgcaacgtccaacgcgtagcgctggtgctggcctcggtgtgcgtcacggtgtgacgtggtgcatgccgatgaatggctgtaacataccaaaaattagctattttcaaatcttgcatcatgccgggtcttatgttcttaataacctctttaaacctaggacattataattagcgagacctcctaaagctaacctgcataaaatccttctttgatattcaaaagcttttgtgattttcatttaaaattttatcttgaaatattccttgatttggttttaatctaaaaccttctttcgcctaaaacttcctttatttaaatttagtttgaaaaaccctttttactattatgaattatggtccaagaaaccatcctatactgtgctagaacctaaaccaaagcaattccaattttattggaattaattgttaacccatcctttgatcttaaacctatcatttgattctcgatccaaatattcgagtttctccttttaatctagccaccattttaatccctgtggcttgattccctcttcggcacaagaaatattattattacaaatattgtgagtaattgctcttgtgctaagagaatagactttatccctccgccccaaattcaaaacctcatttagcccatatctaattctttaaatttcataccacatattttgggctagaattctatttactctattccctccatattccctccactcaaaaatattcaaatctagagccatattatttatggttttgaatattttgaatttctatttgagtatattaaataaactcctcaaaccaactggagaaatatttcttttggaaattatattcaaatataatttccttctaaactctctctcagtcatttttccttcaaattcaaattattcaaatcctttttcaaaatctagccatccaaattcctctaaatctattatttgaatctctaggaaaattagacttcctccttttcaactttgggcagaattcttcttctctctcgcgcggcccaagtcggcccatagcaagcgcgcgtgccgtgcacgcgcacgccgccgccaacgccttccgtcgccgctaaggaaccggccgccgccatttggtgcgccgtcgccgttgtcctgccttcgccgccaagttgcgccgccaccatcgccgtgccgtgccctccttctccgccgtccaactctgccacggccgccacgtacgcgcgccgcaaatgtcgaccaatcggaagacaaagccggcaccgtcatcctcctctccacgccactgccgccgtgctccccttctccttttcctccgaaaccgtcattagccaccgcctttagtcgtctataaatagacggcaagactcgccattcctcttcagaactcaagctctgagatctttttctctctctcctcccatggccgatcgtcgacatcgtcggtcgatctccccatccgtagctcctcctttcctctcctcgcaccaccggcttcgcctccatctggcgagtccgttttttccctttcccctcttccctacccacttcatcaagccaccacagccacttctcttgccgccggagataagctcttctactcgctgttccggccatctccctcgctccctctgcttgccaccgacctccccggatgcgcagtgagcgggaacatgcgtggccgatgacgtcgccgccctccagccaccggagcgccgccgccccgctcgccttctcctctctcttctctcggctctctctggaaccgagaaaaggaagacgagaagaaggaagaagaaggagaaaagaaaaagaaaaagagaaagaaaggctgacaggtgggcccatgaacagtacattttcgtcttttctagatttaattcaaattccaatctttagaagcccatatctcctaaaccgtagatctgattctagtgaaacttggacctaaatttatctaaattcaaaccctacttttgataccaaatttgctatttaaagattttatttgaatttctttaatttattcaaatatcatttgaataaatatttgatttaaacttataattgaaacttatattcacctttcaattatttccttttattttcaaaataccctttagccactaaacaaccaccgtttggaactttacaccttccatggggacgttcgcacggtctactgaccccgacgtcaaaacgttggttgtaaagtctgacaaaacccaaacctaacgtcaaagtgttgcttctgacaccttacgcctcaatgcgtataacgatcagagcttcactattccctcgacctccactgtacgccacacagtttgctctcaagctctgtgtgatcctagccgctccgccgccactcacggttgttggagtaacacttccacccctctaaacctacacaaacttcctatccctctagccataacattgtctgctgacattggctagacaccaaacctagtcgtcatactacccaattctatgacgactagtaaatacccaaaacccttgccgatgtttatcctacctcgatatcggcttaatcaaatgaaaccctagccagcctgctatccaaactccataccaactatttaccctccaaactacccatagcttaaacatgaaatacgagccgatatgctatttcagcatcgactcgagaacaactaaaccctagccactattccaccaaagcctaatcttgattccctctataacctagcctccaaccccttagagcctacgtataaaatactagctcaataacccattaaggagatatttatacccccaaacctagcctttctcgctcttcatcgttttcttgttattttatggcttttattgaatttggttctctctcttctttaatagagtctattttattctggatggcaacctgtggtatttcgagcatcggataatcaggttgcctatcttggatttatttgtgttggagcaaggcaagttatcattactctcctttgagcataattatcctatactctatagttttattctatgcattagccattcatgattttgaatgcataacttgaacatatagcaaactagatatatgctagattttgcttagccatgcctagttagattgcataaaaatataacaaacttagattgggacaatacttaagatttggttgatttccgggtggctagtactgtctcgatcgatataattgccaccaaatacttatgtcaaatgagtacgactgcagcttctagaatggggatagacctagttattaggttaattaacaatgtggtacctctgtacagtggttcttatatgtaagtcctcgcgaaggaggcaaacttatgccgcgaagggcaaatgtgatatttaccgaggcgcaggtaaatatcttgattatattgcgatcgctgtgtgtgtatattgtgaaaacctaattgagatgacgtggggtctctcaaccagttctctctaaaaacctcgggaacgccagaactcctctcgctgctgataacgttacgttcagagcgcatggggactagagttcatcgaacaggtgccactattgttaataacctaaggctgggctacgactaagctaatgaatattggcaagtcgtggattgcgggtaaagcgtacatttactgcagtaaagtataaatgaatctattcgaatagccgtgctcacggattgagtatcgggactcatatggtatttggttagaaacctaattcaagactttactaaatactgttgcataaagacatcccaggctttcttcctctatattctcagctttctgcaattgaatctagctctactcaaatattaccatttcatacattcattgttgattaatataatagcttgctgagtacgttgtactcacccttgcttcaacctcctttttcagagtccattagatgttcttgccgaagtcaggagttcaatcacataagttaattccctttttacttaatcttcaagtctaggttatttacatggtttaagtctatagtaaaacaacagagttaggtcattctaaaacttctgctgtaatagttagccacaatctcgtaaataccctattactttatgtaataatatcttcttcaaagctatgtctaaacgtatgcaaagacgatccagattgttgaagctgtatcaacttactgatccagggcttgatacagttaaatatgtcggtttccgaattattagttttgggacccaacaatggcgcgatgcgcatggtcagtgtgcgtgacaaataatgtctcatcgttgcgttcgggcatatgatatgagatgtatttgtcttatcgttgcgttcgggcatatgatacgagatgtatttgtactatatccattgcaattttcatgattcttaagattcaacaaaaataactaccaaaatagtcttcttttagcctagatttcttagtgacgaaattgatttcacattctttctaatgattatgctttatgtgcaaatgttttttttccaatttttagggatattgacatatagtcgtttctctagggaaacaatattgtcaataatcgctgtgtgcgattcgaaagatagttcaaatcttttcacagattgaacttgtcttgcatctctcaattttgtattttgtgatgcttcttttcacaatgtttatttcctcttcaacataggctatacaaattgtctatggaaataaagtaaaacatcactatttcataataaggagtaataatttataatataactaagtgtaataatatcaaaaataaattctagccatgcatgacaaatcacggaataaatgttgtactctcatagagcttataaaaccattatttaaagttgttcataatgcaaccaagccaaatcaaaataagcacattatgccctcaaacagaataaataagtgtttagcaccacaaacatttgctcctgcctgacattctcttcacgtgttatgcctgttgcagcggcaaagatgtggagtggagtagtagtggagggagttgccgtggcgatgacgatgacgtgcttggccttcctcttggtctagaatatgtcgatgatgtgctcgggctcctcacagatacggctccagcagccccatgtgccacacctgtagaatgtgtggtcttgctagttgtatggcttgtagtcgtgggatgtcttggcttcatgcatgcacttgccttcctgtgctccctacgcatctggatcattttctgttgtagccgacggcgctccgtggatgcgcatttgaggtgagaaaaacattatatatgccggtttttactattccggcactataacctatagcgccgtatcctttatttgttttttagtagtgtttctctcttattctctctctatttttaagctatgctatgtggtagattgagagtgttttaaaaacatcgcacgtcagcttaactgggtattttatattgataatattttttgaacaaagaatcctatatatctatacaattgatccccactaagtatcaatgatgctattttccagccctatggtgaagccacgtcacttcaattaattttagccatcagattagatttgtctgtccgagatttcttctttctccaccatgcacaacctatatggccttttctgtatcccaatgaacattgctgcgagtaggacagcccagcaatttcccaccaggccatttattcctcagtttctctcccctaccaaccgaggaagccgaggagcttcgcgttaggccagtcacaatgggtgtttcatttgagtgtcatgcgcatttaatacagtgacaagtcagcaaaagagcaatatttgcatgaaatgggtaggagagagagtaaactcgtttcaccatggtgacacgagatagcgccgtttcccaggtcactgaaacggggtgaaacagcattgagagttcatcgtttcacctccgggatcccgtgcgagcgctgctcttcgccatcttcgcgcgcatcgccggattcttcccgcgcgagtcccccatcttcccgcgcagcacctccatgttcccgcccccaaagcactggctcgaagcttttttccccaatctcacctgcaaccctagcgccagactcagtccccatcgccccgtccgtcccataccctagcgcaagaaccacgagcggagattgcggagctggatccacaagtaggtggtgaatcctgtccat

SEQ ID NO: 50961 - DNA, 1660 bp, Oryza sativa
aggtaactcaaatgaatacaagcggatatgacgatgacatgctggagaaggaggcacaacagatgtatgcaaatacatttggaaagccttttgcacttgtgcattggtggaagatactgagaaaagagcccaagtggtgtgcaatgattgagaaggacaaaaacaaggctgaagtggttgatattccagatgaacaaaagcgtcccattggtagagaagcagcacaagccgagcgcaatggaaaacgcaagaaggacagtatgtcagaaggaattgtcatcctaggggacaatattgaaaaaattatcaaagtgacgcaagatcggaagctggagcgtgagaaggtcactgaagcacagattcacatttcaaacgtaaatttgaaggcagcagaacagcaaaaagaagcaaagatgtttgaggtatacaattccctgctcactcaagatacaagtaacatgtctgaagaacagaaggctcgccgagacaaggcattacaaaagctggaggaaaagttatttgctgactaaggttagatatctaatctaatctgagctgcactattatttataataattaaagaatgctgcaatatttagttatattgtctgtatatctgtgctgcactatgcagtcagctgcatatcacgaatttgtcaaatctgagctgcatatctgtgaatggtgcaatatttagttatattaattacccagtgtgaatgatgtattgctgtcagtttcacatatagtatgaatgctgcactatgcagtcagtttcacatgcagtgtgaatgctgcactaggcagtcagtttcacatgcagtgggcgcctatttatgcagagtttagccatctctctactcctctcagaaactcattccctcttttctcatacgaagacctcctcccttttatctttactgtttctctcttcttcaaagatgtctgagcaaaatactgatggaagtcaagttccagtgaacttgttggatgagttcctggctgaggatgagatcatagatgatcttctcactgaagccacggtggtagtacagtccactatagaaggtcttcaaaacgaggcttctgaccatcgacatcatccgaggaagcacatcaagaggccacgagaggaagcacatcagcaactagtgaatgattacttttcagaaaatcctctttacccttccaaaatttttcgtcgaagatttcgtatgtctaggccactttttcttcgcatcgttgaggcattaggccagtggtcagtgtatttcacacaaagggtggatgctgttaatcggaaaggactcagtccactgcaaaagtgtactgcagctattcgccagttggctactggtagtggcgcagatgaactagatgaatatctgaagataggagagactacagcaatggaggcaatgaagaattttgtcaaaggtcttcaagatgtgtttggtgagaggtatcttaggcgccccaccatggaagataccgaacggcttctccaacttggtgagaaacgtggttttcctggaatgtttggcagcattgactgcatgcactggcattgggaaagatgcccagtagcatggaagggtcagttcactcgtggagatcagaaagtgccaaccctgattcttgaggctgtggcatcgcatga

SEQ ID NO: 50962 - DNA, 9882 bp, Oryza sativa
atagttgaagatgagaaggaaaccagaattattgaagaagatttagatctaaatgtgcctcctagttcatcaaccgttcaggaacctgagttctctcctgaacagaacacaccatttgatagagttttagaaaaagatatttctatccgagatcgagcggctcataaccgacttaagaaagatttggtggaacacatttggaataagtttggtggtgctgcacatagaactggaaattgagaatcagtaaatgtaattattttatttttcttgtaatttatatatctatggtccacttgtaaatttctgaatgctcatcgccatattttttaatctctgcaggttccaatctatttacaggttccctaaaaaaaaatctatttgcaggttccagtctgttgtcttcacaatgtaagttctgagaatcaaatcactatgtttttctcttttttggtagctacagggtgttagaacatgtgttattttctttactatgcaattgtgatcctccaatatttatctactgcatgtgtaaacctgtttgtcatgtctgaactactttcatttgtacagggtgaaagaatcaatgaaatctatgggtgcatcgtcaatttgcctccagttacctgcttgtcatcgtcatttgtagcttagttctgtcatatttcacctcgagttaacatctattcagttatctaaactttgctatgtagtgaacttggttgaatggtcatttaaatttatcaagtgaacaatcgtacctatctgtgctgaatgcatgtattttgttttgtgttcaagtggctacacacgtttgtgttacatacgatcccactatgtggctggaattaaatgccttgaatttgcattggaaacgctagagtgaaacacagcattgagaaggtctgtttcattgtacgtttcaacttgtttcatcttcgtttcagctgatgtggcgtctgggaaacagtgtaatgaaacactgcattgtgaatggccttactaggccgccgctgctagcatctttcccgtcgtttcctctacaatggaatccgagacgacagcctcacctgaaactgttacacacgccttcacttcaacaaactgattgggggcatttatttaccgaagctgcagcggcgcagtaatggccttcagccttcttctcaatctccctcctccctgtcctcctcagcttctccacatgagaagtactaatcattaagttatcctcttctttataaactccctgaaggcggctccattgcatatgccgaaaatctctgtctgtctatctctgaactaatgcaaactggattgcaaattttcatttcactgacaaattttcacgttggaggaatttccattccggtgggcttttcttgctggtgctgcaggcgcctggatggttaaattttcaatgatatttttggtatatgtagaagaaaatgcataatccacgttgtttttctgaagaattgcaccgctcctgtcgtcctcaagcattctgtgtttgtaccttggtatgtgcttcctaccgaggatggatcatatatgcttaaaattcatcctccttgtccaggttttaatgagttctcacacctatttggctattttattagattgattcagttgtccgtgccagattatatgcagattttactgtgcgtctaagttgtttttcacatattgtaggcttaaaggagatgtagacgtcttcgtcactaaagttaatgcttacaaatatattctcttaaatccctaatctgtttttactcagaaggactagctagctactcagtattttttttatttagggttaccattagctgcatatgtaactctgattttgttgagatttactttaccgttcaatattaaaactggaatactgtggagggttccaaagcagccctagctgcaactacaccgatggatataaaaggtttctttgcaaaaccccaggacctgctttcttaatttgtatcacgagcaaaaccgaaacatcaattttcacatgctctgccagtataatgagcgatgtaatggatcgagtgattattcctataataacagtacacagggttcaatatttcagaatggaacttctggaatttcacccctgcaataggatattacggccaaaaatttgagtatttttagttaacgaaaattcattcaactttcaactttttcagccagaaatttccacaatttcgcttctatcagttcccactgaaatatttagattttcaagttgtagattttttattttttttgcaatttcaaacttgcagtacacttggttagttttgcaagcttaatttgactataaaataatttcgattttaaatatgttgaaagatcttaacaaaattttaaatttgttgaaagttcctgttttcgtttaagaagaagagaggtggcctagtttttagggaaaaccgggcccgaaaacctcacaagtgcgtggttaattaagggaaaccggccaaagacccacatgaggaactactgaagttcgaacaaaagtcatcgttgccaagctcagaggagcagctccgacttcttaagaacaaactacgaactagctaggcgaccacaatgacaacgtagggcagggtcttccaaacgaaacctccaaggaaaagcgtcagagaacacaaacaacgtccgtccaagaatcggaataaagttttcacccgaagaaaaggagagcaagcaacaacgccttcaggaagggaacggcgcccacaggcgtcgacgttatcagccgtagtccaagaccaagcagggctttcacccgtgctcttgctccctgacaaccacgaaaccaaggccgccacaatgcttcacaacccttagacgcttccaaggacgagagaagggggttattgttgccgagcttgccactgcaagaagctccgactccacccccaactcaaccacacggttgcgccacaagagcttcgagcaccacacacctcgctgctgcaaggactttgaaggcgctgacagagtggacggtcttccgatcttcaccaagcagaaccttccaaccaaacccgtgtctctctccttaacatggggcaccccacgactgaagtaggccagtctaagaggtgtagggtctccaatggacgggaggagggaacaacaaccagttgggaggaaccctcgccgtcgaccaggacactgaccacactgctgatcatcgtgtcccacggctttccaacaagcaaaactgcagcaaacgatcggcctctccaagtggcgactccacctaacggcacctgctgcgcctctccggccatcttctttttcagcctctccaccggccacctctactagcaccttctgccggcctcccccaactccactggcctcccccaactccttatggccagcctcctccctccgagcatggaggcgaccagattcggcataggccggattgaccgcctcctccacctgccggctaccagcttctcccaacagccagccaactccaccactgcgcctcctccaactccactcccgtcggccttccccttctggatccaaggtgaaggcagccagatccgaaaccggttgaccgcccctccatatccggccacacccacaccgccacatgccgattccaactcgccgctgcctcttctcaccgcctccaccccgctgctatcgctggagcagctcgccgccgggacgccgcagctgccgctaggacgtcgtccctcatcccctgcgcaggagaggactcgtcgcttcacggctgcctaccccgccgccgccgtccttgctcgccgagccatggctcggccccgcttgctctggcgggggcgaggtggaggatggagggggaaagcggcggtggctagggttttttccgcccgcccagtcgcccgcgatgggagcgacgcaagcaggaaagacaagttttttacaacgcatggggaaagcaatcaatctttataacagtccgcagtaacacatagggaattatctagttttatttatagctaggtttagcagcgaggcctctaaattatagatccggtctggtagggagggggtcaattgatcaatatggctgatgctccgattctctagtgccagtttcatatgaattcgtgtgatactcaagatgaagtgaagtgactgctgaaatagaaagaactcgatccgtccctagaaatcacaggaccatagagataagcacagggaacagtacgtcgagtgcagaactgtcgctgcttttactcgtagatggcttcttttgggctctatcgtatcggcgtatcgccatgacggtgcacacatgtaaaaataaataaataaataaattaaaatcaactaccaaatctaactatataaacgccattaattcggccattataagagcaagtttaatagtacagccaactactagctccaaatcatctatagccaatattataatcaattcatacaatagttgcttactatactattaatatctgatcctacctgtcatacacacagtacgtcttgaagtccgtgctgcagctggctacagatttgtagcccgctgcttatctctctctttctttatctctttaaaatatgtttgtagctggcttatagcctgctattgtacctactctaagcaatatattttctatctccacgctgaacacgagccacggtagagtcactgctcacagcttcactgtatttaaaccccagatgctcacacccatgctaatataacaaacagaccacagaccagagtgaggctagtacatctcatttcaatggcaggtcaggctcccaacatgttggcaccaccgaccgacgacgagctgctgcacgcgcaggccgacctgtggcgccacagcctctacttcgtcacgtccatggcgttccagtgcgccgtcaagctcggcatccccaccgccatccaccgcgctggtggcaccgcctcgctgcccgaccttgtcgccgccctgtccctcccgcccgccaagctcccattcctccgccgcctcatgcggctgctggtccactcgggcgtcttcgccgccgccgacgacaccaccgggtcggccgggacgtaccgcctcaccccgctgtcgtggctcctggtggaaggcgaaggcggggcgcccgtcgtcgacggccacccgtgccaggtgcccgtggtgctcgccgggacgtccaggcacttcgtcgaggcggcgatggggctcgcggagtggttcaggaaggacgtgccggcggccgcgccgccgtcgccgttcgaggaggtgcacggcgcggtgctgttcgacgagagcatggcgagcctccacccggaggtcgacacggtcttcaaccaagctctcgcggcgtacgaccactcgggcttcgccacggttctgagggagtgttccgaggtgttccagggggtgcagtcgctgaccgactgccgcggcggcgatggcgcagcggcgaaggccatcgtcgaggcgttcccacatatcaagtgcaccgtgctggactttccccgggtgattggcaataaacgcggtgatggtgtggtgaactatgtagcgggtgacatgttccgcgccatcccacctgctcaagctgtcatgctcaaggtaatttgtaaaattaatgcaaccgttatctttcacccacaaagaaacttgcacatattgtgagccagctagtgctccctccattccataatataatgcacaactattttttaaaaatgttttgtaatattagacatgcatccatacaattaactaataacttatatccactaaattattatttttaaatcatccaccctcaagatctataattttattgggtgcatgcattatatttattagggtaaaataaactaggatgtgataataaattatttcttgatgtttaggttaagtgtgtttatgccttatattttggaatggagtgagtactatgacctattacttcctcaattttcaaattaattataggcccatgcgttataacggtttttctatttagtttagtgataggattcgcactgggtgagttttttttatatactatggttggttcttttatagaaatacgatttttcacagttacatgagggaagaggtttttatgaggaagtggaggggaggacgattccctctttttaagtatagatatatgactatactgatttctagcatgatgtttgaccactttttttatttaaaaatttagtataaatataaaatataagtcatgcttataaagtacctttaatgagaaaaatcaagaaaatttataaatgatacaattttaaaatgagataaacagtcaaacattattttctaaagtcaacaatgttatacatataataacagaggtagtatattcacgatagacttgagaagtaaacaagtaatagttgaaaaataaaaggttcatcttttgttgctatgtatttcaattttatagttcctgcagaagttgtcaacaaaagtttgcgacttccccataaagaagaacggttaacgactacaactaaaaaaaagaactgtgtaatgcaaattataagtttgtttaacttttttgtggcttcatctatggtagcttgtgcttcaccactggagtgacgaggattgtgtgaaaatactaactcaatgtaagaaagctattccagcccgcaaagatggagggaaggtgatcatcattgacatagtgattggagctccttctggaccactactggaagcccaactccttatggatgtgggtatgatggtggcgaccaaaggccgacagcgagacgaaaatgactggcgtgatctcttcaagaaagcaggcttcaataactataagattgtgaaaaaattgagagctcgagctgtctttgaggtctatccgtagggtgctcctaaataccatggaggatgtgatctaagtaaataaatgaagggagtgcatactttatgaaataaagttttatatacgtgagcctatgtcaagcttggattgttaatatgtgtaaagcattctgtgttgaatgtttcatgtcagttatgtccagttgctttgtttcgtgtgagttaatatgtccagttgcttacgttaatgtgtaaaacttttgttcatatatctgtggatggatggaatactttcagcatgcaaacatgacaatttgacatcaccttcaaccaacttcgtccaccgaccatcagtatttgggacacaaatttgttcgataacactgtcttcaataaaattataccatgttggaacatatcatatatcattgcttgcttgcttactaacacgatgtaattcaaatggtaaaaaaacaaagctccgatatagtttcaattagtacatttttggtgacattttaccttatgtccgtggttgacggctgaccagaattatcctacttccaatattataagcagaggcggagctagagcgaaatgaagggtggtgccacttgtttaatttactctattttagatcaagtttaagctgatatgagtgcctaagtttgtattgagggggtacatatatacatgctaaaaacttttcttgaccgagttcataggcaccccctaatatacgctagctccgcccctaattataagctgaggtttctgtttgttgaatttaccatacaagattttgcatttatttcctctaatctattcctgtttcaaaattttacttattgtaatcagttcatcaaaacgacttgaaaatttttctagtccggacaaattttaagctttaaattaaatacattgatttagggcatgtttggttgacacgccgaaccccatgcctgagaaaaattgaagcctgaaggtggcctgagaattcatgggttcttcttgatcaggccatcttacgcttatgtgtttggttggaagcctgagcctcataagtcaaaaaatatggtttatgaacgagaaagcatataatactcaataaagaattgcgtttccttaacccatcttatatgaattatacgaagaacagagaggggcaccaagtgagctcgccggcagggaagttcggcctcagaagtaccaacaaccatcaaaatggaataaacagagcaattcgactctaatggtggttgtttgcacttcgtggagcagccgatgatgggcatgcttgtagtatcgaacaccgcaggtcttgtggtagcaataaacgtgtaaagttttgatgaaattagattgtgggttttgattagggatgttttggctgcaaggaattggtgctcggtggccggacttgagaggaagaaggtggtgctcggtagctgaaacccacaattaatgtggggaaaatgcttaggagatagggagcagtgcacacatagaaggaatttttgtttgttttcctgtcggcgacgaattgaaagggttttgcgagcaacttgaagctcattctagtgattttttatctgagtgaaactaacgatgcttgatgttggaatctcctgaaaatgaagatgaaaatagggttggtaataatatgtgactaattaagttttaattattacaaacttaaaaaatggattaatctgatattttaaagcaactttcatatataaatttttcgcacgaaacgcaccgtttagcagtttgaaaaacgtgtcacgagtatccaaaatttatgcttgcagaagaaacgaacagggccgtcacgcctgacgacctgagtcaggtgacgtttttcactcgcctgagtcgtggaggaacccatgatagcaactaaacaacccccaggccttagcctttagtgactacagaagaatttgctttcatttatactttagtcggatatacagtaccaaatatagatagaatatttttatgaggactcgggttagattctaaacttgtatgtcaagaaaataccagggatcctagtcggttacgattgtattttatctgtaatcccatattccgttaggatatggactgtactttgtaatacggatccctttccctatataaggaggggtcagggttcctctcgggacgattcttttttctcccaatcatacaatcaataacacactcggtggaatcatccccggacaggagtagggtattacttcttaaataagaaggcctgaacctgtataaaattccttgtctccaaacccatccactttcctagcttgatagccacccccttttattattgccgaaatcttgtttcgacagtggtgcgccaggtaggggtagcgtcaagttctcgccgactaagtgcgatgggtttcgtttctggcatcgacaacttcgccttccctcccgggcaggcgttccggttcggcagcctcaacttcatcaccaacgacttcggcaagatctctctccttgactcggattcaaaccagtcggggagagaccaggtccccgtgccattcggtattccgaactcggccgaggcctactccaagatcatctctcccgagtcggcttcaaaccactcggacgagatccaatctactcttccgcgaccagatcaagacgacgggttctatccctcaatcctgatgaagcttcctgatgacttggccgccgtcttcaccgccaagacatctcctactcgaagatctaggcgagctccggcttcggccctgatccaatctagatctagagaggttggcgttatactccaacctcttgggacagtctcgacggaagagttggatggttaccttagctcccccggcgtcaattctcgaccaaccgagatcctcgactacgacgacttcggctaccactacgaccacggtgacctcgacaacttcgacgacagctatgaggataactacacgcccctcttcttcggcgtattcacggctgacaacgaaacggagga

SEQ ID NO: 50963 - DNA, 1439 bp, Oryza sativa
cattcgccacgaggacctagtcagcaagttcggacgtaaaccccccaggatggtaagcagatgtcgaaaaagccaacgagtatgccaaagccgaagatgctattaccgcgtccaaacagtcgggcaccacttggaagccaaagaaggatacatcgaccgcaggagggagtggaagtaacaaccccaaggatcgcaagcgtaagcccgaagaacttgtggcgaccacctctccatcttcccgacaacgttcccgcgtcaacaccttcgacaagataatgaactcccaatgtccgcatcatccaaactccaaccacgtggccaaagattgcttcatctacaaacagttcgcggagcaatacgtcaagaacgcacgtaaaccttcagacggagatcaaggcacatcaaagaagaaagatgatgaagacgatgccccgactggtttccaagatcatcgcaaagaacttaatcacatcttcgacggacccctggcgtatgagtctaagagaaaacagaagctaacagaacgggagatcaatgcggttcagcctaacacgccccaatatcttcggtggtcagaaatagcaattaagttcgaccgctcggatcatcccgaccgagtggtccacccggggcggtaccccctggtactagacccagtggttcgcaatgtcaagctccgacggactctcatcgatagtggcagcgcactcaacatccttttcgctaagaccctggacgatatgcagattcctcgcacggaattaaagccgagtaatgcacccttccacggtgttatcccaggattgttagctacaccactcggccagatcactcttccagttaccttcggcactcgggagaattttcgcacagaaaatgtttgtttcgaagtcgctgatttcgagacagcatatcatgctatacttggacgaccggctttagctaaatttatggccgtcccacactacacctacatgatgatgaagatgcctggtcctcgaggagtcatatcactacggagcgacatcaagcaggccgtcacatgcgacaaagaaagttgcgagatggcccaaacccacgagactactctcgcccgcgaagagatccgactggctgcgaccacggcaagcgagggagaagtgcctacaaccaagctgacgaagaccgaagaaagtgatgccaagaccaaaaagattcccttagatcccttcgatcctgataagactgctgtaataggcgctgagttagattgtaaataggaaagcgcgctcatcacctttcttcagaataataaagacatttttgcgtggaaaccatccgatatgcctggtatccctagagaggtgattgagcactctttacatgttaaggaagacgccaaacccatcaagcaatgactccgccgttttgcataggacaggaaggatgcgatcaaggag

SEQ ID NO: 50964 - DNA, 861 bp, Oryza sativa
caataatctccaattcacgactcaggcccttaccaaactcaagctcaaggtgtacagtcttaaatgggggtgcatgcttgttcttgacaatcttgacctgaatttgtgtgcctacaacctgttggattgaaactggatcggggttatataatgaaacaagaactgaacatgaaacatctacgaaattacaaaacctattattactaaattcaatatttatttttgtgttacctttttggcaaaatgggacactacatagaaagcaaatattattgatacgattgtgttacctcttctgacttttttataagaccaatccttttggtgttcaagcggacagaagcatagaactttaaggcattccctccacaggttacttctgctggtgctccgaatccactaaatgtgcttaatttcgatcttacctgtacacatacccagaaatgatcactctgttacctctaaataaacatcaaaagttcttttgaactaagtgattaggcttggttagaattacaatactggacataatactaacccataatacaccctgcaaacgcacccaaaaaaacgtcatattgtacaaggaaacaactccactaaactatttcctgtcttagtttgcatacatggttggaggatagtttgagttccgtgtctttgttcttcattatagagttaatatatcctctcttactataaagttatagctcactaattcctaaagcttaacatacaaagatgccacatcatcatccactaataattgttacatttaaacctcatggaagcatgctatattatctataattcaataatctattaaattttagagatttaaaatgtaagggctgcaggaat

SEQ ID NO: 50965 - DNA, 1041 bp, Oryza sativa
attcctgcagcccccggtctcgactggtccatcaatgaccggaagcgagaatgtcgtggccataaccccggacgaccccatgtcgaaggatcctcccgcagtagcggagaacggaacgtcgacgacatccaagcccgaggaagatcctagtgtggccaaatcttgtccttccgacaagaatcacgagctgacaaggacaacttctgaggcgacaaggtcctggtgtcctattcacaaaactaggaaacacaccttgcaagcttgctgggtttttctcaacgcacaagctgacatccgtgcctgcaaagagagtggaatttagcgtacttctccaactcatgatgtctattgtcctatccacaagacaaagaatcacgacctctcaagctgcaagattcttctcaaagccatgaagacgtagcctcctaaggtccagcactcacaaatctctcctagagatgtgaacaaggaacgaggagcgacggtcatctcagaccgattcgttggggtgatcgacattgatccccacgagccatcagtcctacactcgctcgacgaccagggttcatcgtcgacaagcacaccacgcgatgtgtttgctatcggcgggaccagcgcgtctgcgcgcgccgatgcggaagcagagaatcaagtggttacaccggctcagcacatcgggggcatcaacgcaatactgagggaaaccccttatgatcctgttctaaatgatgatctcgcacggtggacagaacggctacgggaatcagtgaccaacctcagcaacgcgttcgaggaggccgctgccacagcacacccaaaatagccgccagctggcggtgccaatggcgaaccacctgagtagcgggcctcacctcaacaagccacccctccaccccgcggcaccagcgatctccgtgaccatttaaatggctgtcgagaagcatgacgcgcgcaagacaacgaaaaccgttccagacatcgtctctcttcacgacgtcgagagaacgaagagcgaggaggacacccgagcgagaaccgaga

SEQ ID NO: 50966 - DNA, 4310 bp, Oryza sativa
acaacttactataactgtgttaactatgcaactaatataatagctgtttcacacatcataggatggacaccacatgttttaactctacttgaaagctcttttaggccttaattttaactttaaaaagtatcacagattcaattatatttagaacttttttttgttttattacaaatacatgacaaatggctgtgttgtcctcagtctgtcttcatactatactagcaagagacacgcgctccgctgcgtgtggacatgcatagtataatccaaatgagctgagatgcatgttgaaggcatttatagttgtaaagtgtacatatacatggcataagaaaatcttacaatccaatattaaacacaacataaatcttttgatcatatatagacgaccaaacagcttgcagtgacacatgcattgacaattcggaaagaaaatagtgagatcttgatggaccacaaaactcgggttttcgtcaaatacacaaatgtattctcttgtagtcctaacaaaaaaacaacataatagtaaacttagtactgaatatatcaacttttaggacctgttcagattgtagccaaaataaaccttgcaaattttggtaagcaataccaaaattttggtaagttggcaatattgccaaaattttgacaggatttcttatgtatttactaaaatttggcaacaaactaaacatagccacatttttggcaactatgcccaaaaatggtatggttgaaaatgacatcaatctgaacaggcccttagataaagtgccacacattttcaaatagtaatgcaacctataaatctaaatagaactacttcaacgatttgtacaaatgtacaatcaatttatgactaaatatgacaatcagggaatgattgcactgaactaataaaacgttgacctgcaaacaatttaatcctctttaatctcttttcactggaccggcctgcaaacacaaaaataacaattaatccacaccatatattatttttctgtagttaactatattacacataaggttaacattttgttaactatattacacataaatatgatactagtagcagaaaaagaaaaaaaagcatggcaatatattggcttcaaacgtacgaacacggataaccatggaagatgtgggaggcctttaaatgtgaaaatatttcatgcggttaactgcactgaaatgagtgtgcttatacaggatatgtaagtaattgattttattgtgtgtacatgttgctgtggaaaaaaaatgatatacacaatccatacacaaccattagatgtcagagccaaattaatatagaccgatgacatgcactaatacatccttatgctaagggtacattaacaaatacaggcagaagaaaacgacaattccgaatccctttgtcatgttagaaaaaaaaatttaggaagaaaatgcccaaatttggctgttcatcctacatgtctagtatagcgttattgattcatggaaaaagctattcaagaataaaaattcgctgtggaggaaacttccaaattaacatcttaaagatgaatatgcgggactttgagccatagcctgcaactgcaagtttgaaattatttctagcttggtaaagtcttctcattctggttcttgttgataatgtagaaaatagagcaaatgttataaaacacttaatattaaattatgtagattggaagttgtaacctgaaaactggctccattacgtttattttgcaacagtgaatatgctagcggacatagctagaagcaaagcagaacttttatccaacctacctgatcacagcatcagtaagaaaattctaatgtgcatgccaccattaaaactcaacactgcgtaaatggcagcatgatgaaaacaggaacaaaataaattatttatgatgtccatgttagcaattaacattacctgaacagcattatctacataactttaatggacaccttgttcttgaccctcccaaccttatggtcatgctgtcatgaactgatccatggtgtttgcagatgaagcaccagtagatcaactaaacttgtatttttgcatgcctgatactgcattactttcagtcataaacatcatgtgaaacctgaaataggaaagcgacgaccattaccacccaataattagagcaagaatggtgcctcaaaatacaatttatgaaaaatgaaatagaaagatgctgcgggagaagcaaagcatccaccatagctcctttctaaattgaattgtttttaggcttaaatatgtgtcacatccttctttctatcaccatacaatgcatcatccactctttgttctgtagacaatttacagtgcacaacacacatttagagaacaaactatgggcagcaaaaacactgacacacacacagataaagagcagtaatacagttatacagcaagtggtaattcatgcagcaatcattcttatggtcttttacttggccaggttagttatttgctggcacctaaggaactataatagttaacataactatcatgagattaggtcggtcccaacagcaatcaaccaaggattttggaagaatgaagaaaataccaaaattttgtagcatgtgagtctcacggttgctttatgcagaccttggaagccttatcctaactgaatacagaagatgcatatccatctgtggcaagttaaaaaactgtcaattgtatgaggcatgaacaggacataagagaacacacagaaatcaaccaagattgtctatcatggatcgatcgaaggatcacctttgggatgtataaggaggtgggggctccggttgttgagcagatcaaggtgctgagtcagatctgtaaaaaaaacaggaaacgatgtgagtgtagagaatggagaagaaatgaggatttagcaccgtggaaacaggaagcccaacccagcttgcttgatccaatctttgcctcagaggtagaaggtggacaggcacacttgatatgtcggaggagttcccagtggagtccaatccagaggaaggaggctgcggccgtggtcggcgacactccacgttatagaaagcttgctggtggaagcaccaattgctacgaaggaaggaggggaactcgctgcgtgccttcctctccccatcccctctagctctcgccctctctctttccgtcttcatcgtcaatggaccgttggaggaggtgaaggcggcggcgcgtgacatgtcactgcacgagcgagagcgagggcgaggagcgcggcgcacggaggcgaggcatgagctggcggggagagaaagggccgcgagagcggcgagatcgacggcgcactagggttttggtggcgcttcaccactggagagatcaaggccgttcgttcgtccttccactgatccgagggctatggaagagccggcacagttgggctgggccaaacgaacgaccagcccaaagaaatggcacgctgaggaacgtggatggatggatttgctcctagccaagatcgaacggatcacagtagctgaaacccctgcacaattaaacagaagcacaggatgttttctgaaaaaatcgatgacgtggcaagctaatttttcaccgctcccacgacgtttagatagagtaatataacatttggatgtgatgacgtaataaattagttttttgttttgcactttgtgcatgcagatcgatatgtggaaattggtattgttgctggggttccagtctccataaatggaagaaatatctcagcagcattccttcttgtgtagctcaacaaaattggtgggaagcatgggattggacgcatcgatatggtggaaaaccgtcttgttggcatgaaatcgcacagtgtctatgagacccttggtgacaccataatggcagctgccattcgtgagctcgagtccctgacccttgatagggagatcatgcagtggaaagacattcttgccctcaaaatacgccaagttggtttatgttggccgctggttcgacccactccagcaatccatggatgccttcatggagaaggttaccgagacaacaactggttcggataccctcaagttgtacaagggttcactaaaattgcatcccggaagagcccctacagcctgtacggggaggacatttcctacagcatgggatcggacgcattgatatggtggaaaaccgtcttgtggcatgaaatcgcacggtgtctacaagacccccggtgacaccataatggcagctgccgttcgtgagctcgagtccctgacccttgatagggagatcatgcagtggaaagacattcttgccctcaagtaca

SEQ ID NO: 50967 - DNA, 8046 bp, Oryza sativa
gctgaaatcatttagtatttgaaaatgttgtttgaagttgtcataatttgaaattcaaattcaaactgtcgagacaaagtcatatagaaaaaatgaccaaaacaaaaaaagttgtagatcttgatgcgttttacaactttgttcttgacaatttttctcatttcaaatcatttattacccgacaaattatttgaagggcttccccgctcgaggacgacgacaatgacgaggagggagggctctcctcttcctactttcgcgaggcgacgaccaggcgggcgtggcgaggcggcggcagcgagcgggcgcggcggcgatggccaacggcaaccggcccccacgcgctcggatccagcagcggcggccgtcccccgcccagatccggcggcggcggccgtcccccgcggcggtgaggggcggcggctggttcgcttgccggcaggcgggcgggcggcgatttttctttttcttttttccttttggtttttttattccgtgcgggtggtatagtatgcccgcacgcgaaaataatgattttcacagacagcggtgtgcaggcgggccaaatgaccgcacggaaaaatagatatgcccgcccgggaaaataagttacgtagtagtgacggtgcttttatgcatggtacctctgctattgtagtactcctatgttagtaggatttgacatatgctcctagttccttctccgttttgttcccctgatatttttcccaaaaacatcacatcaaatctttggacacatgtatgaagcattaaatatagataaataaaaaaactaattgcacagttaggggggaatcacgaaacgaatcttttgagtctaattagtccatgattatccataagtgctacagtaacaaacatatgctaatgacagattaattaggctcaaaagattcgtctcgcggtttccatgtaagttatgaaattagttttttcattcgtgtccgaaaagcccttccgacatccggtcaaacatttaatgtgacaacaaaaaaattttcttttcccgaactaaatagggccacgtactccctccatacaaaatatgaagtgatcctaggaattttttagagattaagttcacagggaaaagactatgatgtgggtatgtggggagtaggaggatggttgggtaatattgagtgaaaattaaataagagatgtttagatgtgagaaatagtactctgaaatcctatattttaggaccaagggagtaatcctaagaaaatcagctcctattctccctttattatttggaaggcatgcctttcctttgactagttctatacatggatttaaaaactcactaggcaattgcagtttgaaaaagagggacgactaataatagtaacaatctatcaaccattggatccattgaatatttacctgtttcaaagtccacctattaaaggatcggaacaagtgattgcaaactattcaagtatggatatggatgcatcatgttgaaatgcaataattgatggaaggtactatgtagccagatagctattttggttgtgtatccaatctgttagcgtttaaatcttaaaatcatagatttgacagtgtccttttcgcccaacccaccggacctcaaatctttagacttgagctggtatccgtcaatcctagaagtacacataattgcatgtatagtgggtatgcatatgtctgtttattctgttattgactttgtgctaattgtgttgcaattaggggtgtaccgtagacacttaaaaaaacttcacgcaattttattggagttagttgagaaacgaacattaactgtactttactttgacatgtcttatttaaaaaaaaaataaaaaaaaatcattgttcaaagtccacttttgtaaaatcatgggtgacagtattttgtgatggtatgctgtcaccaaaattgtttatgacagccctctgacttttggtgatagcgaggggtagtcactaaatgcgtagagtaatactgacgcatttcagaatcgttctttttgtgtatatatattctaccccaagctcgcatagttcacacttttgtgtatgaggaaaatattttggaaacttttcactagtgtgaaatatatgaacgcctaggggaaattgatattaacctatgacgaaatgttttatttttttaaacttgttccatgatacaccacctatttccattttttgaaactgatacacctatttccattgatctgatctccaaaagaaagttttacagatctaggacgccaagcttgacacatctcatctcgctatttcagatcttacatgaaacttcatcacagaaaataatgaaggaccaaatttgtttattcatcgctttgatcacaccatgaacaaagaagggaaaccacagacgcatatatatcatatatgtatccaagggccacttctacggatagacctcaatgacacaccgaggtcccaatttcttcacaatcttgtagtccctgaagcctactttcatgaagagatctcgccaatcattctcgtcccgctgtcggcttttggtcaccaacatcacggccacatccataaggagttgggattccagcattggccctgaatcagaaccgactactatgtcgatgattatcactttccctctctcttcttggagcggaaccgctttcttgcattgggctaggatctttatgcagtcctcgtcgctccaatggtgcaacctaacctaaccatggataaaattgtgcaagtcaacaacacaaaaaaaaatagtgctcccttttataaatatatgatgatgttgatttttatttaacattcggttatttgtcttattaaaataatttgaataagctagcacagataaatttatgtaagtcttaatcttaatataaaatcaatcagaaaacatatatattacatattacataaatatgtgagaaaagtcaaaccttaatctaaagtcttcaaaccaaaccagccccgatctgctcttccctcagcgttttgcgctggcgtggacgctgccgcgtcgcgacacgtcagcgcgcgcgggaaaacggtggaatttcgcgagccctcgtgcctccgcgtcgtctttgaaaaatttgcagaaaagccctcgcgtttggtgatatttcgtgatagatgctaatcaaaagtttttttgtttaaaattattgcatttaagacctccaaaatattgaatattcaatacaaagaagagaaaatttggaaaataggactgcgctcggaaacatggaaactaatgggctatttagcaaaaacttttatccctaccaacccctcctccgaaaccctagccgccaccattcgctcctccctagccaacaccgacgccgctgcctcctcctcctcacgccctcctcacccccttacgccacgccgccgcatactctctcgcacctccctctcgccaccgcggggccggttccggtgtaggggaggccgtggccaccggatccggcatccacgacctccccgccggcggatctagccacccgaaggcgtgggctggtctagtataagaggctcatcggtagtgtcgatggtggtcctttctccatagcagcgagctccatggggaaagactttgctccttcattttcttcttccctcctaccccactccggcgcgtcacctactctcctcgcgccgctgccccctattctcctcacagtcacagcaccgccgatgcctcttctcgcacccaatcgcatcgccttacctccatgttgctaccgcggggccagatccgccggtgggaaggtcatgcccgccggatccgtcagccatgacctccctgccggcgtattcggtcgctcggaggcgagggctatcacgggaggcacatcggcaacatcgacgacggtcgtctctccatggcagcgcactccacagggaaaggctctgctctcccaccctcttctttattctcactctccctctcaccgtgatccagatccatagctgggtggggaagttgaatatgatctagagctggtggggaactcgtgcaacccccttcactgccggtccatcccatcccatgtgcggctgcgcgaggcgaagataagcgaagatgccgagatcgcggcattggccacggtccgtttgcagcttgatctatcttgattgattattttggttcatccggttgttgtctgcttgccaggatatggtggttgtctctttgtggatgggacatgatggatctagggattatggacaaggttgagtacaactacttcttggacatctctaaaatacaggcccgctcgtccctatgcaccacctactattgatctctgcaggtactttttcctccatccctctaccgcctactgcttactctgttgttgtttgtaacttatgtataccatgtactgactttaagttgcatcgattgaacctatccagcattaaaaatttttcatttttacactatgttgtcagattacaggatcccaatatctgaaaccacatattatatcatatctttcagtgtctgagtatctgagaccacctattatgctggatctttcagtgtatggaattctagccagtgtgcttttctctctttgttgcaattagcgatgacctgattgggagaagtaggtaaagctgtgctggctttgacatatagtagcgactcttgctgcatcaaacaagtgcatcatcataatatggatatccagggaggcctgctggacaatcaatgctgttgtggtggtgaaagtattatgcataacactccttattttgctatcaaaatgttaatcaggtacatcataatgtttttgctttatatttcccatgtgtgctctgatttgtggtggtttgccatgcaaatgctcttttcctcagtgtgatgctctgctcatccattacatggtatgctgattgctttgcttaacaactccatcgatgtggtagctaatttgtcatatgttcgcaatctcttgctttttatcttctttgatctaacaaagaaaatataaccttggtcattttagtaaaacaatctttttctactgagtacttacgagaactatacatctccacgctttagttaaatagaagaacataccttaattgacagtatatgcttatgagaactcgcattagtttttcccttaggatagctggcttcaaaatttatatgcttttttcccataacagcaagcttagatgcatttcatcctttcttgtgcagaattcaaagttcggtctccatcaaagtgatgtttaatatttatgacatatattacagatgcttgggcatgatgtgctgtaaatttagaggggtaagtccgtgctatcaaaacggaacatccaatagatttttggttccaaatactcagactgtatgtactttttcataatctgaacatattgagtgttttttttactttgtggccatctgtcctatcattttgttgtaggccgcaaaaatggagaacttctccttcacttgaatttctctattccaaacttgaatacttagtttaattgttcacttttgtttaataaatatcttgtcctttttggttagatcttagattacaccgtttaagatctaattcatttactagcagtgtacatactacattttattcattctgtgcttgtaatacagttcaaatataggactgaagttctggttttagtgctcctcttatccatttactagcagtgtacatgctacattttattcattctatgctggtaatacagttgaaatataggactgaagatatggttttagcgttttgtgtcaatcttttatgtttgactaatacggtgagtaactcattttttgaagcaattaagttggggctaaaatagttcttagatgcattagcacctaactgttgcctgtcagtttgatctaaagtgctcctcttatccatttactagcagtgtacatactacattttatttgttctatgctggtaatacagttgaaagataggactgaagttctggttttagtgttttgtgtaaatcttttatgttcgaataatacagtgagtgactaattttttgaagcaattaagttggggctaaaatagttcttagatgcattagcacctaactgttgtctgtcagtttgatctaaatgttttcactccacatcaacatggtggtatagctgcccactctggtcctgggaatggatggtgagttcatctaacagtacaattgcagaggtgcatgcagggccagccgacgagtggtccagctgcgtatgtttgatgcaaagtatttagcggtgttaaatctgattcttgaagttggcagaggcactaatcatgtttgccactcttccaaatgtgatactgcacttccatttaaaaatttaatcggacccttccatctagaaaaaaaaaatgatgctgcactcttgataaaaaaatctcttcaggtttgctttgtatatgtttagatccttcatgatttcagatcattgactgtttttggtgcaattaatacaattccttctaaatttgcatggaaatatagaaaagtaattggaacagaagttcacagctaaatttcttttggctaaacctggtgatgactgattattactattttgttagctcatcatgtagtgtgatatttgaaactgttcaataatttcctaggtagtctatctattttcatcctttgctgaacaatattttcattggtaccagctatgtgtttgtggaattgcttccttggcagcagctgtggaagagtaagaaaggagagggagttcagggcagagctgcctctatccaccgcagcggtacttccagcaaatcatggaccagcggttggtttcacgttgtgcctccacacttgcacgtccaccttcaaatccaagaaggcctccacaattgacaaggtgcatgtgctttcctcttgttgctttcttcatgcttgcttcattgtataaatttgaccaaaattttatttgtgaatgcataagaacaaaacactatagggttgtgttcattcaattgcaaatacgcccacctaaaatgttcttggaagtggtttggctctaaatctgtcatggactaatgtgcttttggtcagcaaaggatgagaacccatatttgtagacatcaggaaatttaaaacaacaaatggattttccaatgttcttttttcttaaatatgcccgttaatatatggagtgtttattgatggggttgtagagtctatttgtaataaaatctgttgctagcctgacagttatgcactcttctcccttctcttggcagtaaatcatttccctatcacttaccctgcactccacatgtttgttgtattgcatcttaggacaaagagcagcctgaagaaaagggaacaatggcaatctgcaaaagatttatagcccttcatctggaacctatgttcccccccccccccccaaactattgagtactattttttacctcggcctcccttaattcaaggtaaaattgaaaatatcattcgaaggtttgtaaagtactttgtatttggcgtttgaatcctacatggttgcacaatttctgtacactatctcttaattttgaggaaaagttagtaattatttttaagacaagctagctatatgaagtttttaagatataacctctattattagctgttggttctctctggtaaaacaagtatgcagttaatcaatctgcccgttgtgaccttaaagcaaaagctttgcttacctatccttgcttttctacaagttaagttgaaataatagcatgatgtagtttatatgatgactaggacagtggcacggttccttgcgagacattttttcctcttttgaaacaaactacacatttattttagagtaaagtccatcaccggtccctaaacttgtaccgctgtgtcatcccggtccctaaactcgcaaatcaaccgctcaggtcctcaaactagtttgactgtcatcccggtacctaaacttgcagatcactcgtttaggtcctccaacttgttcagttgtgtcaccccggtcccta

SEQ ID NO: 50968 - DNA, 9651 bp, Oryza sativa
tatagctgtaggaattggtggaagcacagttggtttgtttctgctcatcatcattttaggtgctcaacaataggcaaccaacttgcggtgttaccatgaagcttcagttgatgttgagtgttgtcctgcaggttgtaaccaaattatgactagcttgtaccttgtagtttcatcatattcctttaaacatactgatagtatctgctcacaaaaatattgtgcttgcaatgaattaagtgttaaaatcacatacctataatctatgtaaaagatgcacaacaccaatagtttaacgatagattgacatttacaatcctgtccatttcaactttatttgctgcataaatatgttgttggataaattatttggttcactttcatgattatgagaaaaatactaagagaacaatttagattgtttacatgtttgttgtgtttttagtatggataaatcattacttcggttttggcaatcctttttgtgtttccctgtcattgagatgtttgattgatttcctcacattggtctaagattggtacagtacctgctggtgctccttcggttaattcattcacagattacaccactactgcattcatccttacaatttaaacatacgccacaaaaataactccattaacttattttattcacattcagaaaaagaaaattaggaggggacgactaatattgttgagtagttcaacgccacaacattattggctctcaatattgacactaaaattgtatttttgcagcacttctcgagcaactatgcataagtggaagcaattcatcgtaccaaaaaatgtgccttctatttacacatcaacaagaaggcccttgcagtaaaccagcaatgcaatcctctgaattcatggggaaaaaggtcaattactgcaaaggcatccaaaccacattagaatttagccatctgtaatatagtcgtatgtgctcatctagcagaactgttgcaatgctactgctataaagctactatgtactgtatatcctgtcatcgtacacatggcaagttttgttatgtatttactgtcctcaatctgtatacatcatttagttatacttatacatgtccttcattgaacttacaaagaacattgtttcaactgcctacctcaacttatgtaatcactgattctcctaaatggcaccactggtgcagcgtgcgaagcacgcgttcgcctcaagttatattaaaaactttcatgtgttcagattaaattaaaggtttcaccgattcagaactagtgcaggtttcttttcgtgtaagatatatatacaaaatggattacgaattactcactcatgttgttaattaattaattaattaccttgcttgactcggtgggatgaagtcgaacatgtcacctgccacgtactcaacaacaccgtcggccgggacgtcgccgaccacacgggcgaggtccagcacttgacgtgcgggaaggcctcggcgatggccctcgccgccgtgccgtcgccgccgccgcagtcggtcagcgactcgacgccgtcgaacacgtcgcggcactcccggagaaccacggcgaacccggaggcgtcgtacaccctcaggccttcctggaacagcgccgcatcctccgggccaagcctcgctgtgctctcgagaggtgtcacgccgtggacgtgctcgaacggcgacggcggcgacggagccgggaagtcctccctgaaccagccggcgagccccgccacggtgtcgaggcagtgcctcgacgtcgaggcgagcacgtggggcacctggctgaggtggccgtcgacgacgggcacggcggcggcggcgccgtccacgaggaagaaggagaccggggtgagacggtacgtcgtccctgcatcgtcggaggcgaagatgccggagtggaccagcagccgcatgaggcggcggaggaaggggagcttggccgtggggagggacagcgcggtgacgaggtcgggcagcgaggcggcgccgccgtggcggtggatggcggtggggatgccgaggtggacggcgcaccggagagtcatggaggtgaggtaggagagggtgtggcgccacagctcggcctgcgtttgcagcatctcgtcgtcggtcgggaccaacatgcttggagcctgatcggatgctgccatttctgtctgctcgacttcttctctgagcttgaacgatggaaatgattgcattacttcctatcgatcgtctgtctgactctggcgcgattacgagggttataaatagtaatcctttcggtttttaataggggacgctattggctttaggatatacttatcatttatcatattataatttttatgcaaatataaaaataaaagtggttctaaattatctttattaatgacaaaaccaaataaaaataattataattataattttctttgaaaataagatgaatagtcaaatacaagcataagaatcaatgacaacgaccatctacttaacaattagaagtagggaacatatcctatacacacaaggtttccatacatactctatgcataccaatcagcaaatatcacgaaaaattctaaaaaagattggacttttcaataggcaaattcattatctatgaaatctcatcttcaaatttattatattttacttgtagaaaagacaaaattctgacagatttttactctgaaaactgtcagatctctcacttttttaaggctaaaatataatgaatttgcatataagactttgtaatactattaaaaatacatgtcagattctctttcgagaatttttcgtgatatttgttaattggtttgtacggagtgcatataaaaaacttgtatgcataggatatgttctatgagggaaagtattgtttctggtcatggaactaacgtctcttgcctggaaataaaataattggccatgacaccatcactgctgtaaagaattgagaattgactctacttaattaattttctacttgcattactatatgtagactctccaatgagggttgggatgcaagctaggggagtgggtagacataaaagtgttttgattattactgatgaaacttcaccctgttggcggtgtaccaatttctcattgtatggatcctctagtactgcgggaggatcaaaacttcttcgtgcaagcacaatactactacatcattgcgtgcgataatcttatttatacgggattacctattaattgttcgataaatttaaagcttcaaatctacagaattttcaactaatggatacaactagttttgaatgaaataagaaaaaaaggaacaggtcaaaaattgtaaatctagagacaaaaacagttataaaatttaatttcgtgctctgcaactgagtggaaattcattgtaactaagtgctccataaccaaatataagtgttctataattgggtgtaactaaaagttggatatggaaacatgaatcttaatgcagcttcatatggatgaaaaatcgaaagatagaagtgcaaaaatctatcatacgtgaaattgcaaatcttaaactgaaatacataaatgacaacatagtacgtcacagtgggtggtaggatctcatgatatttttaccgatgtcatccattttgcagataaatatcacaggtaagaattctctatcataatgtccctatgattatagcaactagtgtatgggttccacccttatattatctcacatgttagtatacttataatgatagtaccgttatgatacacagaggtcacatcatgtctgattctgctactcgctgtgttgctgtctctgacagcagggccccagatgcaaggcctcactacgtggccaatgcagcctgggctttgtcattgtaggattgttatttgttgccatacttgaaattgataacattcaaacgatagatttagtattttactcactgccaatatgttgattataaagttgcacgacttagttctgtttaggtgctcctgtcgatctataatggttggtagggccaatatctttgtaaattttggatacagagacgtataaggcttgtttgttagcagtactgtactatcgtaccgtggcttgtttgcagctcatagctggaccctgctttagggccctttgaatcgtaggaataaaaaaacagagaaatatgaaaaacacaggatactgacaagaatataattgtaaaacagaggattgcaaaacacagaaatggccgtttgattggaccacaggaaaaacgcaggaattagatgagagagatagacacagaagaaatgttccaagaggttagacctcttgctaattttcctccaaaatgtgcataggattacccattccataggaattttaaaggattggagccttcataggatttttttcctatagattgaaatcctctaaaatttctacatttttcctacaaatcaaaggggcccttaatcctggttttaatcctgcagacccaacggcctttactagagtaaaaaaagaaaaaaaaatactagtaagtaatacacgctacaacacaaatattaagagcaattagcaaagcaagctagagctgcgccaccctgcattgcatatttgcatatttctggaataaagccgcagtgtcatgcacatccattccccataaggccaaaaatccataatgatccaagagttccagaagtgagtgaaccctctattcaagacgcatatcatcaatcaataactctcctaaccccaccgtttttctcatttttttaattatttttgggctatctcattgttttacacgtggctgctacttctcctgctccttgcgcgcgcaggggcaaccgcccataagaggtgcgccggttaattaaaatttgggcgctgtggtggtgtgcatacgggttggggtggagggctgctccaggtgagagggctgggcatttttgtaaaaaactccttgtgtttgcacggaatatcgtatacgtcctcggaccgcctgacatcccgttgtatttcttgcgtataacccctcgtcttctaggaaaatacaatgcgaagaagagaaaattccgcttctaggggtagcgctgtaaacataaaaaccatagggggttttctacaaaacgtcctacactaaccccccaatcccgaaacccttcccccattctctccctctcctcccctcccacctctcctctctcggcgcgggttccggccagagctgccgccggagggcggtggcggcggcagcggcggctactgacggtggcagaggcggctcaaggcggtggctgcgcggagggtggagccagcggcggcttccctccctcctcccagatccggtgtaggcggaggtggatggtggaggcggcgcgtgccgtgtagggtggacgcggcggcggctccgccgggaggggggagggcggtggcggtggcggccctcccctctggatctggcgaggcggctacgccctcggctgtatccgccgccgccgctgtcggatctggcgaccggagaagacggcgcggcggaggaagatgaccgcgataggcgctggcgacggagcggcggaggccgacaggtgcggcaccatcttcgccttcatcgcctgccgcccttgcacgggacgtcacgtgtgcgtcggcgtcggtgcgcccctcccccttctccttctcctcgcggatccagtgttctctgtcctcgggaacggcctggcgggagcgggagcgccggcagcgcgcggatctggccgcctccgccctcgggagcggcggcggcgggcttaggcgggcgggagcgagcggccacggctgcggcagctacgacaacgacgacggcgacggtggctgcgacgacggcaatgatgctgacggcagctgcgacgaaaatgacgattgtctcctccaaccccggcaccgggccagccgtcggcgacgatttcacctgtctcgaccattccgccgcccccaaaagtatcctcccccacttgcgagaggacgagggactggctcagcatcgagccctccacgagtgtgcagcgcatcagatttaggctgccttctttcaaaggagattggggagattgtcactcgttttccgcacgcacgcttcccaaactattaaacggtgtattttttgtaaaaaatttctatatgaaagttgctttaaaaattcatattagtccatttttgaaatttaaaatagttaatactcaattaatcatgcgctaatggcttacctcgttttgtgtatcttcccaatcatctcgatcccctcaccctttgccttagaccatgtgtgtgtgtgcccgcgcgcatttcttggtagcgtttgtgatgctgtttcttggctatgctggattacatccccaccgtgttcgacaatttcagtgctaatgtttcagtggatgggaacatcatcaacttgggattatggggcactgctggtaaaactgattcttccattgttctactctcttctactgagattttatttttcctttttactcatgcaactgtccaatctctgaacatcgtgtgttcttttgtttgattcatccaggacaagaggattacagcaggctgaggattctgagctacagaggagcggatatatttgtgctagcattctcactgatcagcagagcgagccatgagaatgttctcaaggaggtaggtaccagtactccatttagttccgtttggactcaaaatgtctgaatatctgacagcatgaggatactgaccacagatactgtaccaaaaactttacctttcccttctctggtggcgacgttgggtcaggtggcggcgtcggagccggcgccggtgtcccccccccttctccctccgctcgcggcggtgtcgggcgggtggcgcgtggaactgatgccaccgggggaatccttagctcccacttgatgtttctcatgaggtatgcttcaattctgttgcaggaactcgaattcgatctatggccgcgttggggcgatggcggggctgattttattgggattttcctggtggatgggtgcaggatggagtaagaccgcgggttaaccattttctcactggacgggcgtctgttccaggtcgagtatgccattgaggtcatcaaggcgagttttctgcccttgtgtttttatttattgtatctgagtgagctggtgcttttaatcaaatctagaccggggtgaagctgagatattagattgtgtgataattgggggttcctctcttgggagaggttgagatgtttgattctgtgagaactaggggtttccaagggagaggttctagatttggcggatgagttggctttaaatttcaaatagggtgttgaattttttttaggatggactgaattgttaggtgcatgtactctgattttttggtgccaaaatctcaactgtagttctataaattttggatggtgttcgtcaggagttcttttttcatggttatcgagtgggctacgtctttagtgctattctgtttcatgtttcatttgtgacttgttacatgtaagtggtgctaatgttgctgatcctactgtagtttagttggggtcaactgcgatcatgttcaccacatataattgatgaccccttagatcataatgttggaggtatatgttaggttctacatccttctctttctagataagtattattgcaggtgtctaggtggaaaataaagtttgggaaaaaataatgatcaagagtcctccataacatatatagatatagatccatgaaacattatgatttgtgcaaaattatcaaactactgtgtatcatgatttcattaactctggtagttcagttcattgatgcacattgatacttgatagcttggatatgctgtataatgaacactggatggtgaattgaccaggaaagtgcaaaatcttgtgcttaattttcttcatttttgtaggctatctcaaaaggaaggcaaagcatagaagcacagaacattgttcgagtgagtgcatatctattccttcgttagtatgtacagcaggaaaattatgaaatcttggttcttcaaactgagttcttggattacctcttgcaactttacttggccaatatacgcctcaagaatgcagcaactgatgtagttattactgtatatgagccactgttgataaagtaagcccagtagatcactaattacgataaaggtgatggattaatatttaccttcattattcacatctgttatttcttttcagatggtcttatggaagcaacactatctcatgctcgttcacctaaacagcttaaggttattacattgattttggcattggctgcaccagttgtgtcatatgctggtttggttatttgcatggttgatgttgtaattgggagtattgtacgcattgatagatacatatattgagcttgcgacctccaagagggttctctgttttaagatatgctgtttttgtgataggactaaaaatactttgtaacttaactgctaatagattttataaggcaccatatcaattaatttaaatcaaccaaactgatgtgtaccttaaatttgcaggaaccctggtggcctaccaaattggcttggcaatgtagtagtctctgttgccattgctattgtcatatgttttacctgtgtgtatcttctttcttacgttcatatatcaggtaaaccatgacacactatatatatcatcatgctttgcttccctttgcagttacatcaatttctgtgatcatgtttattcgaaatctcaaaagtaggttctgcatcagattgttacacctgtcctgtccacgagattgcatccatccagaagggaatgaaaagagcatcaaggcatttttggcaaattattgattttgttcttgagcgtggcatttaccaatccattatatatatattggttttattacagtacaaagaaatcaagttcatgttactcggtgcattgttcatacagatgtataaaaatgttggtgtgatgtggcaatttgagcaatattggaccttgcttcttatggcattccagttggctgatgattgcagttacatgttgatggcatccttatatgtgtagttatgtggcaaagcttgtttaactgactattgtctttgtaacaaacaaccaattatccttactattgttactaaaaatgtatactctctccctttgtgatgctaactgaatcacatacttgattatatactggtatttctcatttagttactttcaactaactctatgtacacattgacgggcgtggcttgaagccgcgcttattcatctagtaccttcatcagtagcccacctattcctgttccgcgagggcacaacaaatagcttccagacgcatatcagtatcgctactcacattgacaaattaagctcaactttttaggtatagatcagcttacaacatgttcttacagagccagcctattttattggtcactgatctgacctgcggacagcttaacaatcacatgtttacatgacaaatgcacaaccttttgttcctatgaatgcttaatcctgtaacaatctaccacctaacagacatttttctgactaactcagctccttcacctgcgaaaacaagaatgctactcacttaatatttgaacaatacagcaaaaggtgaccgcattgttatgtcaatg

SEQ ID NO: 50969 - DNA, 7230 bp, Oryza sativa
acagttggtccctctatatttcccagtgatgatgatttcatggcaggttttttaacatgttccttctttcttgttctgttcacacccttatctttcttttttctgagactagacagtggttcctccacattaatcagaatgtcagcccaataatcatcctgcatatgatcagccaagggctgttccaaaggagtgggctcagtgccggcagctttctcaggaatatcctcatcaacatcagaaaatgaagcacaggatccagtgttagttgccttcccatatatctccttctcaacatcagacctagaagcatacgagtacttcctgaaatcagtaaagaagttcatgcctgcactggaaaatctctcctttttcttaagattaaatactgctagggagagctgtgacagcatttcagaacaagacagggaattttctgtcaaggtatcagtcttgccctttttcaccttcagagaatgtgcagacttgtctggagcatttacttgtctttctttagtgctacgagaattcttctgagatactgcgccattagctttgcgaacgggtcgtgtctgtgacatttgtccagcagctttgtgcatcaattctccaacctttgtagtgctcttgcgggagacaggctgtggctgggaagacaaatcccccaatgtgtcaagtttctttcttttcctagtcttcattgtatcctccaaatcacgatcaggatcctcaagtttctcagttgatgcatccatagaacgcttgcctcgagccttgcttttaccaccagaagaaggattaggcacatctgtcactgccataagttcagaaagtttcttcttcttcctaccctgctctgagattcgcgcttctgaagctaccgaggtttcaccacgcgttgacctcttgccagaagaaacagaaacattggcattgccatcttcaagtccgtccccatcccctgtggttttatacttcttgcgtgcagagccagctctacgccccaccttattctccttgagcaaagcagtattcttctcttccacctttaaggattcagcaccactatcctttcccctgcctttcaaggctaccggggtgcctcccttcatgcgtgttgatcttgttctgcgtgctgatttgctgtcactcaaggtttcatccacagccttcttggacagttttttgcttgcaccaactgtttcaagcccatctgcatcttttgaggtgtttttgttcttctttgctgatctgttcttgttctttgacttctttgttttaatcgatgtatcatcagttgcccctttccttggcacagaacctttgtcatccatatcaagcccatctgcatcttttgaggtgtttttgttcttctttgctgaattgttctggttctttgacttctttgttttactcgatgcatcatctgttgcccctttacttggcacagaaccttcgccatccatatcaagcccatctgcatcttttgaggtgtttttattcttatttactgcactgttctggttctttgacttctttatttgtctcgatgtatcaactgttgcccctttacttggcacagaacctttgtcatccatatcaagcccatctgcatcttttgaggtgtttctgttcttctttgctgcacagttctggttcttcgacttctttgttttacttaatgtatcttctgttgcccctatacttggcacagaaccttccccatccataatctccttctttccagcctccggcaaaacctttttcttgcgtgatgaactctcaccacgccttggcttcttctccatgtccatcacatcatccccaccacttttatccatccttttcctcttggtgtgtgggatcgccacagaaacatcctcaatcccctcaaaggtcacaaactcagggaggtgcctactaccccttgagcaattgaatgccctaagctgtgctttggcagttgtaagttcgagacggtcggcaccagccagtggattcattcccagagctaagatgtagtcaagaaatggtctaccatgatatgcgcccctcatgtacgcaccatctacaacagcaccataagccccttcacggatgccagaattctcaatctcttgcctcttgccaatgctactaccaaagcaggtgcatgagaggcctacctctacacggcgaccaacctcttgcagtgcagcatccacagcggatacaaaaccagacatggtgctctggctggccaggcgcgtgaagttgctgcagaatggcagaagtgaggaggcatcgctccaagcgaaggtcttgtcccagaaataggcgacaaggggagcgcctgccctggtatgcttcagcgcaagcttggaagcatctgcagcatcaaacacctggcccggccaccatgggtgactccgcaccttgccccagacaagctctggcggtgcaaaatcatggcctccctcatcctgaaaagtgcagtcatagcgcgcgcttccatggtttccctcttcctcctcctgcggtggcggtgatggttggttcttggggcggccagagcgagggcttttgagaagctgaaacaacccacaattaattagattctaattaaaaattgtatatcttaattcgatccatgcgattggttaaacaaaagaatggcaacttggttaaaaatttagaagctagaacttttttaacccaaattatatacaaaaaattaattagacatgatactattgtctaaattatacaaattgtggtaatacactaaatcttcaccatccataattagtacaaacatgagtataacaatattttgaggtataatacttaaaattacatcagtgcatacactttgtttagcatacaacaaactaagcagaatacaccgaagtataaatctagctttgccatgagttattatcatgtacagacaacaaaattacctacataaaagctctgttaggtgtcttaatctagcttaatatttcctctagcaatacccaaaacacttacaagtcaccagccatattatgtcatatagcagccacacatcaccaccatgggaaggagccacacttgaccttgtccaaacatcaacagccaacagtacaagcatgtatgcgcaaccatttctatacaacgataagattgcaggacgagcagaaacaagtagtagaggaggaagaacctgcgccactacatatccattcctaccctcttcatctctgcccccctacaagtatgattcctagaatccaaatcaacagcaaatcactatcactaactcaaatgtagcctaatcactctcctcgtagcagaaaaaaaaagagaaagagatgaaacactagatatattgaaattagggttccaaaaccccccacatcgaagcacacacaaggcctttgctcaaatttcacagctcaatacctgagaaagctcacaaagggtagcactagcacagaattcgaaccggagagaagagcataggcacctacctcaccgccggcagcgggtcggcgccgaccaccgcgctcgccagttacggcggcttgcttggagcgcctacggccggagctctccgttggtgtttccccacccgacgatgcgctgcgggttcgggctgcgcggcgcgcagagggggtgcgaacggcgtcagtacccatggcctatgcagcggcagcagcagagtttttagggtagggatttgggggaagaagcagccattagcaggagcaggatgtgggagatttgggggaaccgcctgctcccgagagccgagcagcagcaggacggttttgtctgtctcccgggcgaaagccgagctccggtgagaaggcggcggcggcggcgggtggggatgacgtcgacggcggatgctcgaggtcggggagagaggggcgtgctgtggatggggattgaccgcggagggacagctatacgttcccatcagtgggcttattgggctgttcttcaatggcttttcggcccatcataattttcttttttcacgcttaggtcctgtttggcacagttccacgtcacagttacataatagattatttgaaggttgtatgttaaattataaatgtttaagaattttagatttcatttaaaataaaaaaaatagtttattcatatgttaaattataaatgtttaagattttcaggttctatgtgatgtgatgtgtcatgtgtaaaatacccactttaaaagatcttggatctgaagctataccaaagaaatcattttagttgtttattgtctcagtgaaaaactatggtaatttcaatatgtttagaaaatcttttgtgccaataggttagggcaaggccaatgcttatggttccatcagccatatatgtgggacccgctatagtaagcattagttatgtccatatccacaatggctgtgcctatgggagaaaataagctgggtcccaatgggtcccaccgaaggataaaaaaaatcacttcttatcctcctgtgaaactctttgcacaatgaaaattccccaaaagtactagcgtgaacaacacatcacaaaagtattatattctatgttagagtttggatatattgcatgtacatttgataatactcccgtatggctgaggatagagtttgttgtgttagttagataagatatgatcaatctctgtagtttagctgtacacaacaaactctcaccgaagctatttatctcttgtaatcctgtcgcccgattgtggcattattatcaacacgtaacctcctcaccgtaggagttcctcgcttccacattctatagtcttgttgccacaccataaggctaatgcttatttttgatgtcagattcttatggtccactttcacaatacttaaggttactttcacaatgcttaaggtgatatactttatagtagtatgtatttgtaggaatcttcctgaattatttcacagccttcgtttcaaatttaaattggaacaaactctgtctagtttctccccattacctccttttagcccatgtccagagcatgaatatttcccggttttcgactcatcataatgttaatcaacaaatacaatatattacttaaactagttgataccttgcacggttgcttcagacattggtagaatgaaataagaatcaatttcttgcaaattaatttagaaaatgataagtttgagtgtggtagagcacaacgtttttttgttaaaagggatatgccaaaaggaaaaggatgctccgatggtagtaatctgtagaggaaattgtatttgttaccttaaatgatcaatgtcgaaacaagatttcggcaataataaaagggggtggctatcaagctagaaaagtggatgggtttggagacaaggaattttatacaggttcaggccttcttatttaagaagtaataccctactcctgtccggggatgattccgccgagtgtgttattgattgtatgattgggagaaaaaagaatcgtctcgagaggaacccggacccctccttatataagggaagggatctgtattacaaagtacagtccatatcctaacggaatatgggattacagataaaatacaatcgtaaccgactaggatcccgagtattttcttgacatacaagtttagaatctaacccgagtcctcataaagatattctatctatatttggtactgtatatccgactaaaatataactgtcatgcagatatggggtatccattatctccacagtagcccccgagaccttcgtagttgacgaaataaccttctcgaaacaaaaaccagtagtccgagtgcttcaattcaacttgctccagcttgccgagtagtaaaaatcagaaactgtgaagggcgaaaataaaacatggtgcatcgagtagatgcacctaattaggtgtagcccccgactatgtgaaaaactaaacatatagtcaagaaccgagtggttttatagcgaagcacgcatggtacttagtaagatacccagccgactgctcctcaactagaacatatcaaggacaaaaaatataaaaagggccgaatgataaacactcaaaaggtccaaaaatagatatatttggtaagaatccaagtaagaaactcttaaaatgatccaccaaatatgataaagatcatggtaattaataagttcattagcctaggctataacccttaccacaatcaaaataagcatataacatgctaggagaatgactactaataaaccagtcatctcaaattaacccaatagcttttgtagcctaaaaaggtttacaaaaatggtataacacctttctgtcgggcaccttttaatgtgcatcataataattccaaagaattattgaatcgcgttaaaaaggattttaacagcatcgggccgcatcatcgtgagcacatattgccaaagcaaaaagcgcctaagttcctagggatcacaacaggccacgctaattatagtattgggctgaagtactgtataggtccaggcccattagtactcccgataccctaataatgccgaagtgaaaaacggctcttcgtcttccccgccgagactctcgccattttcaacattccctgctacagtgcaaaactgcgccgggcaaactagggttcatcgatccgctccaatccaccctcaaaaacttcgcgaaatttctcctcgcatccaccgctccgattccccatccctttccagccgtatctcgaactaaatcagaccgtccagttcacattcatggcagaggaaagagaaagcttcgaaagtcagtgggcgccctccgatgtaacggaagacaatctgaaggagatggtggcgcacgtcgttcttccagcaaaagagatcatcgggtggcgaccggcatttggtgaggcattcccgaccccagatacacatgagatcgtggtattcgctcatttcttctatggcagattttctcttccaacctcaagatttttccggggaattctaaacttctacgggattagcttgcatcatctgaattcaaactccatagtgcatattgccaattttattcatgcctgcgaagcttttctgggcattaggcctcatttcgccttgttccaccgcatcttcttcctcaagccccagccaaataagagcaaaccatgcgtcgttgggggtgctggtttccaactcaggggaactctaagccaaaaatacttctccatgcccttcaagacctcaaataaaggctggcacgggctgcaggaat

SEQ ID NO: 50970 - DNA, 1306 bp, Oryza sativa
caattgactcatactgttatctttgcaatcttgattaaccgtaatcaatgtagtgcaagctgccaagatatctcagttggagaagcaaattcaaatcctggaaaatgacaaggcagaactggcaagacaaagaaacctggctttaaaagaagttgaaggtatcaacaatcaatacctcaaaaaccattatcctccatatgctgacttattaatgtgaatctgttgatgcagaccgcaagatcaaatctcaagctcaattcgacgtcctggttggcaagataaaaaaacttgaaggatcccgggatgaggttgctaacgctgctgccccaattgttcaagcgatgttcttcaataacaacggccaagcgcacttgatgcttctgaaattttcgacaagctaagagttgctccggatacatatttcaagaacatcaaagaagctagaagtatgggagcaagtctggcgttggcgatgaccaaatctctttatccgagggttgacgttgatgccattgatggctttgcagacgggacgagcgaagaagttgctcttgacctcatcagtgatgcgcagaaagccgctgacaagattgctgctgatgtagttgagagattttaggacaccgatcttcgaccgactggtcctgataattctgatgatgaaaagactgatactgattaatgtaccaatgattttgatgattaatgatgatggaggcacaatttatacaatactgatgaatttatgctatgcttgatatcttaactagttcctgatttcttaaaagtttttgtcaaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaaggaaaaaacttgaagttaacagtcaaagaggaaagatacaaacgaaatgcctaagcgtaaaatcgatgaaggtgttcaatattccaagaattgttgatgagagtaccgtcttcgcgcttgagtcgataagaacccggccgagtgacttcagcaattatgaacggtccttcccataagggagataatttatgccgatcttgtgttgtttgaattttcctcagaaccaggtcaccgactaaaaaggctcgcaatcgacatttcgacaatgataacggcgcaacgcttgcaaatatcgagtcgattgaattaaagctgcttctcgggcttcttctagtcggttgatgt

SEQ ID NO: 50971 - DNA, 790 bp, Oryza sativa
tatgtaaattttgtacaaatgttaccatcacttcgtcggatgaagaaatgaccaaaatagaagttatagatcttcatgagttatacaactttgttattgatgactttttcagctgaaatcatttagtatttgaaaatgttttttaaagttttgaaattcaaatttttaattgataaaataaagtcacaaaaaaatggccaaaataatagcagtaagaacataataacatgataaagcatgattttagaaacatttaggaaaaagaataatccaatttggagttcatatgagtgagatacactagttttaaatttttcaaatttatttttgcatacggctccttaagactcccgtatggaaaaatcgatttttccatacgggcgcttaagtgagccgcatgcaacctcttaagaggcttgtatgggaaaatcgattttttcatacaggcgtattaagcagccgtctgcgaaaatgccgctcgatttttgcatacgccactagttatggtccgtttgcaaaaatgaagaggtcttgtacagaaaaatcacttttgtagtagtgattgattttgtctaaatcttatagacccttgtccagcactgcccgcactcgtgtggggagaccatacaacctgatgaatccctcagcgtttttgcctggttatatatctttccattctcgaacgaggaaatgtcctccccgtacaggatgtaggggctcttccgggatgcaatgtttactgaacccttgtacaacttgagggtaaccgaaccagttgttgtctcggtaa

SEQ ID NO: 50972 - DNA, 4729 bp, Oryza sativa
  unsure (1)..(4729): unsure at all n locations
gtgggaaatgctagaatgacttacattgtaaaacggagggagtactagttagtatacacagtgaaaatggtaagtaagtaacaagtactaggtaatatgcttattacctagttataaggaataaataaataatttctctcatcttttctcatggctagtgactgtggggtctagcttaccgtccacttttattctttcactaactattatgattacaacaataactaatacctattgacatagagcttacccttattcataaaataggtagtaaatattggtgatttccttataaaaccatatattaacactatgattctgtgatctgaatgtgatcagaagattataggatggacctggtcgcgctagcgagtggacacgttcatctacggctatccattatgttaatctgttccccacgaagtaagaacaatatcaagcgccttgtttagagncatgtttaatagaataagccaactactaggctccgaattcattctataactaatgtaatagtcaatttcatacaataattacctactatactattaatatttggtcccacctgtcatatacacattacgtcttagagtccgtgctgcagctggctacacatctgtagcatgctgctcttctctctcttcttttatttttttaatatataagtttattgctggcttatagtctactattgtatctgctcttagttgggggaaatttttgggtttggtagtcacatcgaatatacagacacatatttgaaatattaaacgtagtttaataacaaaataaattcagattccgccagaaaactgcgagacgaatttattaagcctaattaatctgtcattagtaaatatttactgtcgcactacattgtcgaatcatgtcgcaattaggcttaaaagattcatctcgcaatttacatgcaatctgtgcaataagtttaatgactacatttaatactccatacatgtgtccaaacattcgatgtgacagcgtgaaaatttttgttttggaactaaacagggcctaactagatttttttttgaaaggagggcaaaagctttgcctcgtatattaatagaggagcaggaaaacaagagaaaatatgtacagggtcagccaaaagccaacccgcaaacggaaaaagttgtctcccaaaattccaaactcctgtagctttgttgctctggctttaacccaggctctcccttcctcttttatttttgctataactgaggcaggggtggaggctgtgctccgaaagattcttgcattacgctccccccaaatctcccaggacacaagcatcagcagagttcgcagaggggctcgtggagtattaggggattcagcaataaggttccaccaaagtttgacggaggggcagtcattccatttactcaattggaggtcagtttgtgtccattgttggatttcggcccagattctcttagtgactctacatttggccagtaggtgcagggctgactcatccgttacacagcacagggggtagatcttttgattttgccagcctcttttccccaatctatccgccgtccaaagtctgttctgggtagcaagccaagagaagaatttgcattttggcggcgcccatgctttccagattgattggtagaagcagatcttgccgctcccatgaattgcagcctatatgccgatcttgttgagtatttcccattcgccgttagattccaacgaatgctatcttgttcttcattcaacggggcattcttctaaccatggaccatagatggacaaactggcgtaagtgctccgcttctgtaatgcggaggatgtcgatatcttggatccaattattattctatatggcgtcatgcaccgttctattcttccgtttagaggctaagaaaatgttgggtgcaattttctggggcatctgattttccagccatctcgaatcccagaatcgcgccgttttgccgttgccaactgttatggttgttgccgccgagaagagttctttatcttgaaggctacaaggaactgacatccccacccacggtttgtcaggggctacccattcgttccaaagccatcttaggcgtaaggcggacgtgaaacgctgtagatccattactcccaggccacctagatcttttggccgacatacccttttccagttgactttgcatttgccgtcggaaatactttcacccccagcccagaggaacttcctcctgattttgtcaatgtccttgagggtatcatcgggtagtttcagagatgttaagtggtagattggttgtgccgtgaggactgacttcgttaagcagatcctagcagcagatgacattagcctcccttgccagggggctagtctggactggcacttgtctatcagcggctgaatgtggacctttttcaatctacctaccactaggggtagcccgaggtatttcattgggaagttgtcaaagctgccgggaagatgctcgtgacatcagtaaggtcaatgttcccacaacgaatgggggcaatctggcttttgctcatgtttgttcgaagacctgaaactcctccgaaagctcgcaatatttctgttagattcgtcatatcttgtacactagggtttacaaagatggccgcatcatcagcataaagggaggttctgaatcttggtgctctgccgcgcaaagtagaaagtagcccaaggtttgttgctttctccagtaggtgatggaaagggtcaatggccagaataaagagcaagggcgacagaggatctccttgtctgagtcctctaccatgctttattggaattcctgggcaaccattaagaagagcccttgacgttgaggagattagcagatttgtgatccagtttgtccatctggttgtgaatcctcttcgttgaagaaggtcaatgaggtagtcccatctaaccgaatcaaaagccttggagatgtctaatttgagcagcaacgctggtgttcttgtttggtggaattttcttgccagattccgaacgtacataaagttatcgtgaatgctcctttttttaatgaaagcactctgagcctggcttatcaaggagcccatgtggggttggaggcgaagagcaagaacttttgagattagctttccgatgccatgaatgaggctgattggcctgaagtcgcctatgccttcagctccttccttttttgggacaagcaccacattagccgagttcagaatctgaaggttgttgcttcgcaattggtcgaaggagtgaattactaacatgatgtcctctttgatcgtgccccatcaagctttatagaaggctcctgtgaaatcatccggcccaggtgctttatccccaggcaattgttttaaggcagcaagcacctcctcttcggtgatgggcccgttaatcattgccaagtctacaggtggcaactgcagggcatcccaatcgaagtctaccaggcatggtggcgggcgcgctagaaaagcttcgaagtgatctttaatgatggcgctttttcctcatgcttgaatttccaaatattccccacgcggagccgttgaataaatttttttctccttcgccattcattttaaggtggaaatatttcgtgtttgcatcgccttctttgagattggtgatccttgaagcttgccttttgcgagctctttcaattatagacagtcccatgactctgtccttgaggccccgtcttaggttgagctcagcttgactgagttgtcttgactcttgtgctatatctaactgaaggatgacctcgagggccatgtggaggtgcatctttccttgggagatgagatttctgctccaagctttcagtctaccagctgttgcgcccagcttgtggtagagtctgtgatgaacttcatgatatggagggctcacagcccatgcttgagcaacgatctcctggaaacctggaaggtgaatccagtagttctgaaaacggaaggttctagcgcgcggcgcgtctccttgtcccgataataagagggggcgtgatctgagagcgaagtcgagagcacatggaggaggtgcttctcaaaggcggtatcctaatttgggctacaaaagaaacgatcaagtttgaccagagtcgggttatcttgctcattgctccaggtatatcgacgattttgtagtgtgatctccttgagctcgcaagcgttgagggtttctttaaatattctcaattgtcgcaggttaaggttggcattgtttttatctgaggccttgtaaattatattgaagtcccccactaggagccacttggagtcgtttctaggcttggtgtctcgcaattcttgtaaaaaggcttgtttcgctctatctcttgtgggcccgtataccacggtaaggaggaaagtggtttgacactcttttaggagaacagtggcagtgagggagaaggtgcctaggacgaagttagagaggtcgacggtgtcttcattccagagtaccagtatacctccacgtgttccaaaaggccttgtagctggcttataattgtaagaccgtaggtagctcccaccgagagatccaacaatagctacatcaatattactcatttttgtctcttgcaagtaggcgatgtggggcttccccgtttgcagcgtttctctaaccgttgctcttctacccggtctatttaacccatgaacattccatgtcatgatgtcaactataggggtatgacataattagcaa

SEQ ID NO: 50973 - DNA, 2145 bp, Oryza sativa
cagccccgcagcaaccgttcttcggcagcacatcagagaatcagctttgtcgcacgagtgggaagagggcacgaagaaggtgcggaaatgcggcaccgaagaatcgctagtgggggtagagccacggaattgctgcggaatagggatgtttccccgaatcgaagtgccgtcgctcaggacattcacgcgtgtccattcgtcacgccactacaaagctagcaaatatgaaagatacatggagatatcaatctcctggacatggagcgcagctcccagatcatgtcgccgccgccagttcctccctatagcaggcgtccgtcggccccaggtacttcgcgagcaccgcgtccgccgcctttgcatcctccctattcagaccgaacagctgctcgagggcatcgatggtgtcttgcggcagtggtgcgttgaacatggctttgaagtcagccactactttgtcggtgagagttccttcctccggcgtcaaccccattcggcggcacaggttcagctgtgccttcaaccccgacggcaggccgaccgttggttgctgggctagtcttgaactcctgtgcctgtcctgtcgtggcatgggtggaggcggcgtctgcaggttcacgtcggcacactgcaacggtggcgagggaaggattgaggggtgtggagatttgaagaggacacatggcatcgccggaggtacctgagggaagtcgactgccgaggtagagagcatcggcgtgtgtatcgccgcctcaggttgcacagtgggccccagtgttgcttgcagatcgtcgaccgggtcatttgcagcagcctgtcgcgctggttcagcttgctcggcatttgcaggatcatcaagagcgagggtgtccgtcggcgccacggggctggcagcagcaaaaggagtgacgacaccccctggcgcaacaatggttgctggcgctgacagcttgtcaatggcaatcgcaacccagccgccaggacgagctggcatagggccccttccgcagaggccactgagatggcctcttgtatgcgcgagaagaccctcgccgcgggattgtagctccccaaccagcggaccgggcttcattcccgaacccacggagcagaggcagaggggagagcgatcttggtggctggaattcccccgccatggcaaggccaggagagatgtcgttgtcgcggtcgccacccccgagatgccaggctcctcgcagatgtcgtcctgtctacggcgcccatcacgccgatcattgccgccacggtcacgagctcttggcgaacgcgtgcgctcccgtcggaagtgaacatcaggctcccgcagcccgccgcgtccttgcgcaacgtcacggccatggccgcgctcctcatcgtcatcatcatctcgccgccacccagggccgtgaccggcgccggggtggtcattgttgtatcttcccctgcgttcccggcgtctgtcagcgttgcgccgcacatcccggtcatcacggcgtccatcatggtcctctcgacgcctatcacgatccccgtcgtgctgacgccatccgccatccctggcggcagcttcccttgccgtcctgcttccttggtcgtgtggctccctcgcgagaccggcattgtcctctacgccctccgcccgcccctggcggaaagcataggtcgtcggcgttggggggtggtgagggaagttctcgaagaggcacggcggagcccgttgtccatcaagaacgcccagatgccacggagggagcgtacgtgtcgctagcctgcatgacttcggattgcggaggtccaccgccgccgccgtgtagtcgtgaatctcttcaatatggaacaacaccgggtgcttgacgccttgctgccagtgctccggtggcgtctccgagatggtgactgactcaagtagggggtcacgggtttgacgcgtgattgtcacccacacgcgcttgtcgatgcggctcgggtttggcatccaagcccatagggagatcaccctcgtgtcgccagcgtccacagggtggacgaggtccgtctccactgactccagagtgcaggtcctgctgatgatgcgctcggcgatgtccggcgcccacaggtgcattggcacgccatcgagacagagcttcactctgtacatgaggg

SEQ ID NO: 50974 - DNA, 1421 bp, Oryza sativa
agtgccaaatataaacgaaaaaataattaattatacggattgcgtgtaaattgcgagacgaatcttttaaacctaattgcgccatgatttgataatatggtgctacagtaaacatttgctaatgatagtttaattaggcttaataaattcgtctcgcggtttacatgcgaattctataattatttttgttattagactacgtttaatactccaaatgtgtgtccatatatctgatgtgacttgccaaaattttacacccctagaactaaacacagcctaaagcattgtcacgaggaaagctaacaaggcgcatacaaaatcatctcaaagcacctacagctcatcatatatcaggcatcagcttgaacgaattttcctcagatgaaggcaatagaaatcaactacatatcagaacaaacgctacatccaacatacactagaaaattagcacgccaagtggcgcgctcattatagctcgtgtctactttctaattagtttccaaaattcaggtctataaaaggttggcaaatgaaagattcaatggtgttattaacttatgcaacaagtttagctaaattagcttccatggcacttctgctaaaaaaaacccttgaagaacgatcatcgaaaactggatagaactatagataaatatattttcatgaattcactaagataaaaaaaaagcctgatactaccatagttgttccggtctagcttctagctatggcacaatgaataaacacaacaatgtagttacacggaaaacaaaaataaagtttagaaccacagtctttcacacattttaaatgccagaggtcatgatttcgagcaccttgtaggcggtagcaatttccatcttcaatatcttacatatccctagaaatgtcaggaggtgaacacaaattagttggacctagactgactgatagaaggagatcaagagcaagagacataagttaagccagattgtcctggtgggctagtggcacaacagcaaaagcttgaaacaacattccttagtttttaaggaaaattgttgtttctcaattgttagttcttattatgggtgcattcaaatgataatggaacaacccgttgatagacccatcaaagtgataacatccacccaacagaacaaataggatgagggagcgatattcagaaaaaaatatctcctcagaaaatattatattctttatatatttgtcagataattgcaaaaatgcatattcagatacagagaatgtggaaagaaatatacagagaatgtggaaagaaatataacaagctcatgatgtattaacttaagaatgtggtcattatgaacagttgcaatcgatcgcaacttcagaatttctcaagtaatactcaggacattcccttgaatagaacacttgcaattagggcactaaccaat

SEQ ID NO: 50975 - DNA, 3369 bp, Oryza sativa
atcaaagcaaaaggtttgaacatgagaaacttgaaaaaagaggaactctcccactcaccgcgagaagaaataacctttgctgcgccagtagaactagggatgatgttctgactagcaccccgtcctcccctccaatctttcattgaaggaccgtcgacagtcttttgggtggctgaacaaataaaatcatttgattcaataacaatgctacttttataagcttttagatgagaagagcagtaaatcctgtgtgtgcaaatcgaaaagtataaaagaggagaaaacctgttgtagcatggacagttgtcatgaggccctcagctatgccaaattcctcgtggacaatctgaaaagtacaaaccatgatacaaaccagtatggtggcatggtgctacattttgtaacagcgaaatgtacttatcatctgaagtcaagaaccgatcaaagtagacacaacatactccatgtgtatccttaacaaagaaaggatacaacagaacagaaaaataccttggcaaggggcgcaagacagttggtagtacaacttgcattagagacaacattcatgctggggttgtaattcttctcatttactccgactacaaacataggagcatctgcggatggagcagatatcactactttccttgcaccaccctatataagccagatggaatctcagcattttttgcatgtgaatggcttagtttattttctgattggccagaggggttgtgtaaatgcagaggcaaacctttaagtgtgctgatgctttctcagttgttgtaaaaacaccagatgattcaacaacatattcagctccaaagtttccccaaggaatatctgagggatctctgaaatggaaaggagaagcaccaacaaataattttagcaaaactaaagcacgtgggagaattattacaacccaaaactatataacaagaatataaggagtcaagtatgtcaaaagtacaatttttaaacaaaaccgtggattcaaccagacctgaagaattcatgttcttaccttttgcttgtaactgaaattttcttcccattaatctccaaggttgactcatccacaacctttatggtgcctttaaatggaccatgtgtcgaatcatacttgaacatataagcctagaacaagaagaatatcacgatcaaagaacttgaaatagtctaaatgaaacatatgaagttgtagcactcaatacagttatgttcaaaaacagtttagtaaaggtgaacctgtcaattttctcattaagaataattatggttatctgaaattaacaaaatagtaaaaaaaaaaaagtgaatagcatgggttgggttcgtgttctcatgcaagacacacctccagcatgtaaaggaccttatataggaatgccttttctctttaagatcttatgtcagataatgataaacaaagcatgtttactaagttaagaagagctaaagagtacttaggcatattatcatattagagtaacaagcatttctactcaacatgtttacactgttatttgtagaaataatataaagatacattgaacatcatcggttccactgcaacaggacgtaatacatactgtgcttttccaaaatctatcaacagaacttaccatgtacttagcatcgataaaaggatcattaacagccacaacttcaatgtcatctctattagttgcaattcgtagaaccaacctcccaatccgtccaaatcctgcaataacaagaataaagagttcctttacaaccaaagactaaataaagatcaaaagtaatttaaggtcacctacagaagcaatgaagttgaacaagggttcacttcaacgttccaagttgagttagcatagcgcaacttccaaatagtaatcatacattacaacaacttgataatgtcattatttttccaatctacaggaggaactcaccattgatgccaacctttgtcttctccgtgctagaagattctacataaagaagaaaaaaaaataatcataacaccactgcagtcctcataaaccccttttagtgtttgatggatggagcaacttacgatgggtggcaaggggtgcttgtgtagcagttgctctcaccggctcaacgctgctagcactgcagtagaaaagcagttattgaaaatgcaatgtgctacagctaatactgatcaaccgtatccatgatatgcacagagcaaaaaccacaaaaacacaagttgagaaaacgaggggtcaagtccgttttgctctcagaaattttccgctctaaccaacagctgtgctctcggttgtcaaattttgttattcaaggaattcgaataatctggatgatggaggcactcacagtgaagacgaagccccaacggaaggaaaaccgcaggtaaccttgctcctaacgcacgacacctgcaacacagcagcaacatcgatcaatttggtggaaatttagcaagtttcaatctgcgaaatcatggctaaacaaacgcgaacgaatctcaactgaactcggaaaatcaagcgaaatacaagcaattaaagtgggaaacagctgagtgttcactacaatactccattactcctacacatagaaacaaaaacatcgccatacgaacaacagtttcatgcgcatgagttggcagctgtcagtcacacgaaacaggaacaggttctcaccgaagagaccaaaaaaaatcagagagggagagagatcgggatggcgaatggggaccttgacggggtcggcggcgcgtgatccgccgccgctgccggtgccggcgatggccggggtggcggaagcgcggagggggacggcgagcgacgccatgcaggtgcggcggcgctggaaacttggcttcctctaaggaaggcggcggaatggaggcgggggcggaggagacggcgagcggagttgtgcggcggcgggggtcgtcgtcggcggcgtggttccgtgatgcgtctcccggtatctcggcctcgggcggagttgtttatggctttattattacttgtaggttttttttctttctgtgcctcttttgttttatcgcctcatcttttaacttatacttatacttataaacataagctacaattaaaatttttaatcttaaatttaaatttaaagttgattttagaattttttttaatttccatcctagtttatttttcagcttaaacttttaatcttttagatttttagattgttaataacatgtatataaaaattttatttacaaactattttctatttgtaaatatgttatttcacaaaactatggagtccttagtttgttctctctttacatttgaaaaacgtgtgaaaatatttttattgaggattgactccgataatcatttacag

SEQ ID NO: 50976 - DNA, 865 bp, Oryza sativa
atacatataattttggtggatactacctccaccatttcaagttataaaacgttttgactttgatcaaagtcaaaatgtcttataatctgaaacggagggagtacaaagataaaaaaatacacttacacgtataaacataaactttatacgtatacatataaagggtctcatctttttgcttatgcttatgcttatcagctaaaatttgaattttcatccttaaatttggagttgattttgaggttttttttatcgaagtttattttttagcctttgtttttagatcgctaagaacacatatataaaaattctattcacaaattacttttcattttgcaaatataccgtttctcttatttcgcgatggctccgaaagtttgtacacataactacgtaagggccggactgatcgtgcattaaggatttctcattccgtgctctcacgtattatctcctttgatttctagtgtaatgaaccatccatttctacatgtcatgcatatgcttaggaaaaagctatacatatggattttatttcttacaaaatttttgctaacgctaatgttacatattgtagtaaatcaatctagatctactatgacatcgacctagttaaatcaaacgggtgagaactttgttaacctttgttaagagtttaatttgtaagattttcttttaatacatatagcgttgttcatattttcaacaacgtttgcttcctactcttaatttcttttttaattactacaatgtgacgtgtctgaagttcacatggtgtacaacgtggtcgccatcccggtcgccgccggcgcgctgttccccttcacgaggctgcagatgccgccgtggctcgccggcgcctgca

SEQ ID NO: 50977 - DNA, 2192 bp, Oryza sativa
cccttggacctcaccgccggtgacaaaatggtaagtgcaatgcatggttaattagccagccatgagctagcaaattctacgcaacaaatcacctgctgcatatatatacactccaaaaccatcaccaatatacagacgacaggccggttcaggttcaggccatatatatatatgctctctaacctgaactcgatcaatgcaagagtagcattggtagctaaaacaatacaacatctcgatcaaaatgtcattatctgaaaataaaacaaattgcaaatgcaaatgcaaatgcagcacatgttgtaatggatagctactaccactagtggcatgtactagtgctaccccggcctgcatgtacttgctacatgtgatggatggatcaaagtaggggcaataagtgcgagaggaggggttagccgtcttgacgacggcccttgtcgtcgagcccgttttcggcacgcctacacgagccctaggggtgtccatttccggcctcgcatgtgccttttaactcttgctccagtaacctgatcatattatgaattcagggtgtgcaagtcaagagaggaggagagaaattcaattcaatagctgatcctggcccatgtacatgcattgcattgcatatatatgactctgtgctagctgctgccattcgatcggtttatcttatccatcaagtgtgtttgtgtgtgtgtgtgcaagcaatattatggaaaccctgtgccatgtgaacggtttctttctctctcacctgcaaagctaagagcatgccatgatagattggtggttgaagaaggcatggaattttatccatgtgcgtgcgttcgcggttggactatccgcttggttcaaggtagcttttagcagctgcagggtttatcttttcgtttttgaaataaaaaccgcttcgtattggtttactgaaaacataaaactggtgaccttcggtaagcgatgtacgaaaaccagctaaaacggatcggttttcacaaacagacaattaatgtttttacagaagatgtatgaacggttttgcgaaaaaaaaagatcggttttgtgaactctaactttatttctaatctccaactctctccaaacaattcatatttttcattcaaattcttaaaatctgtagttataaatcctaaaaaaaaataaatcaaagttggttattactacctttgaaaaaaataaatctgtagttattgctttatgaatttgatttttatgcttcttcttctctctttctttttaaatattcagctttgatgaggtttagcaggattgcagctaactgatgtctatgcatatgacaagagcaataactctgttcttgtcaaatcaggatatatagtataggtgggtgaaatagcatgtgtgcatgtgttgcatttagaagaaggaaatgcatcgagagaaattaaagagcatgcattgcattgcatgctgcctttgtcgttgtccctagccaagttttgatgaggatcacagaggggcccaaagtgcatttaggggactgtttccaatacacgcctacaggcatatatatccacggctcacatataaccaattttttgttagtaatagaagatttgactgaaactgttaccctatcataacccaagatctctgtcctactactactactatttactaaaaaaaatagggtgcaacaaaaaattaattaattaatttattaacatgcatgtcacgttttcgcaccgctgatgaagcccaaacttaatttgcagcaaaggacatatatatatgtgtccagtgatgaagcccacaggtaaaggccttcttaatcttgagattacgccaagaacggcccatgtatcatatcgtcggctgtgttgctaagatgcttgcgtgctcactttcagcttggaaaaacgcaatgaacagttgccggggcctagcttcgtccatccaccatggaatcacctacgtgagagcagtattgcagtaggttataccacacaacgaatttctgattaaataggttacataattaacataatcgttcaattaagatgcacattctatctcgattttcattagcatgtttttcaaatcaataaacagcttttttttaaaaaaaaaacttagtagcaccctatatcacccgttggttcccttagtcgacatgtatgaatcgacctatggtgggcgggacctcatgt

SEQ ID NO: 50978 - DNA, 1718 bp, Oryza sativa
ttgatatttctgaaccttctggttgttttttatcatgctgaattcagtacattgcacctcttgtttatttagcacaacttgtatagtctgcatgtctaatatcagaatcaacgcaaacattctgttgggatgcagcaacccactaattttgttgggatagacgtgaaggaattctgggcctgtcagtccatccattgtttttctgggcctttgtcatagttcaaccattccagtgttgggctacaagtcccccagaattttttctcgccatcggcacaagttaatcatgaacctacgatgtttggcgtctcgaaagtgaaaaaaaataaattaaatgcttgagtttcacctgaatttctgagcaatctggtgcgttgcaccgtatactgtgatcgtgctctacccactaggccactatccagactatccatactccaaaggtcaaaacggccacgcacggacagatgcaggggttcttgaacaggtgaaaaaaaatagatggacataaagaaaacctgaccaatcaaaacggccacgcacggacagatgcgaggcggcaggaacgaaaatatgccattgccgaattagcactccagattcaaaggcctccttcgaaactgcaggcaatttgaaggagctttgtgcgaactgaactaccactaaggctgtgtttagttcacgctaaaattgaaagtgcttgaaatggaacgatgtgatgtaaaagttgaaagtttatgtgtgtagaaaaaattttgatgtgataaaaaagttagaagtttgaataaatattttggaactaaacacggagtaaaactctgtaaggaactttgtgggaactgaactaccatgagaactcagtaaaaatgttatgttctttttttattaagatacatattttatcttaggtttttattagcatgttttttaaatatgtttcatatgaaaattttctatataaaaattactttaaaatgaaataaatttatttttaatgtaataattaaatcttaattaatcatacgtcaattgttttttttcgtttgtccaactttattctccatccaccataatactacctccgtatcatattaagttattttttactcctacttatctcaaaataagtttatttctaagtaattaaattattgcatcagagtttgagtttatgaaagtatggaataattacattggaagtagataaagtaaaaaataataacttccggatttgataaagtaagagcattctaatgtttatattggtatgtgggggatgaataaaaaaaacaagctttagggtccctttgaatcgcaggaatggaaaaacacaggattctaacaggaatagaaatgcaaaacagaggattacaaaacacaggaaaaacacaagaatgacggtttgattgaaccgtggaaaaaacgcaagagtcggatgagagagatagactcaaagaaaagtttccaagagatcgatttgggcttttactaaatttcctccaaaatctctataggattgtccattctatagaaatttgaaaggataggattcaaagggcttcataggaaattttcatatagaattataatcttccaaaattactatgtttttcctctaaatcaaagaggtcctttaacggataagggtgtgttcgctggttgtacttggttcccaaccgaacccttcacacggaaaacagagcaatccattagcgcgtgat

SEQ ID NO: 50979 - DNA, 4330 bp, Oryza sativa
  unsure (1)..(4330): unsure at all n locations
atatatatatatatatatatatatatatatatatatatatatatatatatatatatagtttttgggaagtgtacacataggtagcgagcaaacctaattaacccccattacagcaagtacaaaattggtagccaatcttttggggtccctgcacaggggcccccacaaagtccgtgcctacctagtcttgtaacagggaggagtttgcaagcttagctggttctctcctctctcaaatctcgtcaaaacactgcttgccctaaagatggtgaccctagccagccaaaggccacaccatcatccatcaccacaaccacacacacactctctttctctctctacaatgctactaataatcataaggggattacaattaagataggtaatgagagcaactaattatataatagtagggggaggtgttcatgattatctgtactagcgatcgaaacacggtttacgcgtacgtgacgatctgatgatgatcacgcgagaggcgacctgtgtggggcgcccttcctcctgttgttcagtgacagcacgatctgggggaagaacccgccgccgccgccgctcttcttcttcctcgggacatcggccgtcgttggcgccggcgacgtgctccggccgttgttgctggagccgccgccgccgtagtactggtggtggtggtggtggagggggtcttcgaggatggagttgggtgtggtcacctggtggtcgtcgtcgtcgtcggagaggccgncgccgccgccgccgccgccgtcgacgcggaggttctcgaagcgcgggaagccggcggcgaggtctggctcgccggaggagccgccggacatgtaaaggatgttggagaggtcgccgccctgcatcatcacgtgatccacctgcatgccaatgcatgcacaatttatttaacgacacacagtggttgtagttagtagctcactctcacatctctcgtgacaaaatttttcaccggtcacattgaactcaaatgtgttgatacatacacagagtattaaatatagaaaaaaaaactaattacacagattacgtgaaaattatgagacaaatcttttaatactaattgctccatgatccaacaatgtggtactacaataaacatttgctaataacaaattaattaggcttaataaattcgtctcgcagtttacatgcacaatttataatttgttttgttattagtctacgtttgatacttcagatacatgtccgtacatctacgatgtgacacgctaaaactagtcatcctagatctaaacccaaccttattatcattagagttgtgtgtcgttaattaatatttctcaatcgatcgccaattcgccatgacagtaaaaaaattttctggaagatgtgtacagtggctatactacactactgtaccttgcaagagaggcagcagaaatggaagggctcctgcaggatcctgtcacatgtcaagcagatgttgccagagcccttgaacggcctcgactgaggccttggcttcagaaatatcacctttgcgctgttgatcgtgtatggctgaaatcaaattagaaccaacattaataattagctctacataatagtaaaactgaacagattagtttcagagtttttattgccgttcaatttacctgaacaaaggagcagtcgatgagcttgtcgagatcatccaggcgaacaacgtcgttgtacacatacctcctaacctatatacacgtataagcacttcaatgcacagtatacttatacgtacggtaccgtttaattctagtgctagtaaaagaatcttcggacccatcgtttgcaaacaaaaagtaatttgtgaatataacttttatatacgtgttttagacaatataaaagtaaagtttgaaaaataaacttcgatgaaaaaactctcaaaatcagctctaaatttaaggttaaaaatttaaattttagctgataagcataggccattattccattattccatccaaattcaaattttagatgagacccttctagaagttgtaattgttgatgaggtaaaaaaaaattccattattccatccggacgctgagccaggcagggaaaggatagactcccccggtaataattgcgagcctttgaccggcggctcgtcgtcatccacatcgtgggagggagaaacaaaccctaatttaccataccacccctacaccttccacttctctcggtcacacaacccgaggtcacaaatgtaaaaaaaaaaacacctccaaattaaccccatgacactgtaaaaaacagatagagagtgtgtgttactgcctgaacgaatgaacagtatcgtcacggcgaccttggattatacagagccggagcaacagtattggggccttgtttggtaggaggacagggtcttttaccaagcacacatatggtaaaaaaaaaaacagagacactgctacttttttttttactgcatctcgccatggcttctctgtggtctgtagcctgtagtttctgtcactgtgactactgcagctgcgatcttaacagctctggctttgctgagacgatggatggatcgtagctagtatggctagatagacacaggattgcccatccatttatcaaccaaccggcaccgtctatctttgcagggatagagatcaagatcggcatgctttgctattcatggctaaacaatccggataacccaacccatttttgtgctaatagatcaatcttgctcactgctgcagtttggatgtatttaagaattagagcttttgtagttgcaccagactctctctggaaacacacaaattttataaaagtttgacaaaaagaagtggttcattttatgtggtgatcagaagtttttactggttaattataatggagagcaggacacaagggctattgtttgtttaccgctgtcaaaaagagagatggccttttttcatcagaggtgatgactgtgtgtgctggcctttgctgctgctgctgctgctgcaaaatgtaacttttgcaggtggtgaggtgaacagaagagaagagagagcaatgcattgcatatgctttgcacaccggaatggggaagatgtaagatgggactaggcttaattataagactatggttatttcaggcgtatgggactgaggctcgcagtaacttcttgccagagagagactcatttttcacccttcttcccaatttttaaccactccacatttttacttactcatggccccccacccagcagccaaggacagaaaaaaaattagtttggccaaaaaaaatacgccaaaaatttaggggggtttacaccagtgtaaaagaataatggtgtgatttaggtgactaatcagggtgattaaccgaggggtcactttgcaaggagcacaaaacgaaggccggaaaacgacaaggggaagacgaaagatgggcacagggttctaaaagggtcgagagctatagctgcaagtggttaagtgagacaccccatgcgatgcagcttaagcccaagcaccgccgcaattaagcccaaccaaatctaaccaaattatgctagaaatactactgctactagtactcctagtggcacactagcatggtcgctgatgagaggcaattagcaatctttcctctgaaaatgacacaattagcatgtcatggcacatggaagaatcaacaagatcctctagctgcccacatctactggtactagtagaagcaaatcttggaataagccaagacggaaaggctagtgaattaggccaaagctagtgcttttttgttaagtacaagctagtagctgctatacatgcaaaagctaaaatcctagcccacacccccacaaatccactcaattcagcacactgtagcacacccccaacgatttcaaagcagataaataaacttgtaattgaagaatttcaacagactaacacactctcacatcacatgcataatctgaaattctgaatacagttaagatactgcaattaattaacgaagaagatagacatgcatcatatgatgcatgtagctagagatatatgcagtgtatcgaggacatgcatggcatggcaattgggtcgccggcgccggcgccggcgacgaagacggcggattgattacctggaggagagggtggtggcggtgggagggggcgcagtgggggcagatgctggcgcagcagccgaggcagaagatgttcttctcgttcttcttgcggctctcgtgggcgggacacccaacgaagaagctctcctccacgagcccccctacccatccaggcctcatccccatcaaccccttcgtcttcctccaatcctcctcccaat

SEQ ID NO: 50980 - DNA, 1900 bp, Oryza sativa
gtcgtttagtttgaaactttttaaattttggtcatgtttttgtgagagattttctagaacttccaaattctaataaggtagatatggtaagaatgtgtttattttgctatcctaccaaaattggtaatataaaaaaatagcagggttaaaaatgataatgaagtgaacttaagctgttgtttgcactgatgaagtgatgagcattatacccctccttttattttattttttttgaggacgacccctttttttctgtcatcataaaattgacgaagatactgataatttcacatatctgctgctaatcttgatggacatcggtgccataaataaccatcttaattatccaaaaactgccatttgttcttccacctttgaccacataaaacaggagcaggcattcccacatgcaacagccgcacggctgcctgaagactgatatgattagtgcctgatcgaatgcacacaaatctttttcatcagctaccatagcattagcgtggtcctgatctatgctactaactttttaatgtgttcttgaacacagtagtacagcacagacaagaagaaaataaacctcctaggttgctgaattccagtcatctcaaaatataataacttttagctattaatttgaacacatagttgtctagattcataactaaaaatgcttatattttgggatggagggagtaacaaaaactgcaataccactcgttacaatctgaaatccccattcttgtcaagccttaatttcaattttttttcccttcaacacatacacagcttctggcattattcttccctgcctcttcacaacctgatcgagcacttactgctgctaccggagtagtacaagtttggtaacgagagaagaaattcgagctgttgctggtgttcgtcgctgctcacacagcatctctgcctttccggttagcccagtacaaacagtggtacgtactgtgccttttggtttcttgttttatgtggcccgaattcttttttaccctcgcagcaatttcaaagctcctttttacaattttttcacagtttcttggccggtagcgaacgcttctagcttttttttcatctcaatggcgcagtacactctgtaccatctgctatctcctacccaaaaatataaaaaccttgaatcagatgaaacgttttctagtgcaatatatttgaataaagatatattatactagaaaacatcgagtccatccaaatacattgtactatagaaatgtagcatccggttttaagtttttatatttttgagatggagagagtagtactacggcagtgtttagttcctcccaattcccaacttttcatcacatcacatcacatcgaaaactttcctacgcacataaactactaactttttctccaaactactattttctcccacttttcaacttttacaccatctaaacacagcctacgtaggagtacgttgtgttgcttcaaattttacagctgtatcccatttcatatttcttggcatgctagtgaacttctctagggagcatatttggttcattggttgttgagtagtagtactaccactataatttggattgctagctactccctccgttttaaaatatttgacaccgttgactttttagcacatgtttgaccgttcgtcttattaaaaaaatttgtgaaatatgtaaaactatatgtgtacatgaaagtatatttaacgataaatcaaatgatatgaaaagaataaataattacttaaatttttttgaataagacgaatggtcaaacacgtactaaaaagtcaacggtgtcaaacattttaaaatagagggaatacattatttatagaatttcttgccaagttttgtggagcttgtagtggatgattgtgttagctacactaaaa

SEQ ID NO: 50981 - DNA, 1424 bp, Oryza sativa
ttccgtgtggccggaatgtaaacgcgatccccgaggtggatactgacagcgacgtccgccttcttcaaaccgggcacgtgccacgacgacgccctatccaccacactatccacacacacaaaaccgcattactactcgatcgccggcgtcgcggcgccatccgccgcatgcatgcacacgccgccgcagcttcaccggaagcttcgcctcgaccaccaccaccaccaccaccggcccagctcccccgccgccgccgccttcacatgccgcgcgatggcgacatgcgcgcgcgttgcgtacgtgcgggctcgcgccacgaagtcgacggcgagcgcccgatatttcctcgcggaattaatcatcccgcgccgtgcgcgccgtgacccaacgccaacgccgccgccgccccgccgtaccggagcacggtggctgtccacgtggcaccccgcgcggggcccacccaccacctcctctccgcgacgtttcgaggaaggtgaggggtgaggaggcggcggccgctgtcacgggatcggggacgtattcgagacggcgacggtgtcaacgatcctcagccgttgatgtcatgatcggacggctgagatcgtctcccggttcggttggccgtttgaccggtcgccgcgtcgctataaataccgtttcgtttccaccgtttttactccgatattttgcaattcgcgacgcgatccgtctctcgctcgatcgccatggcggccatgagtgacactggctcgagcttggcgcagtgggccgagctgtaccacgacgcgtcggctgctcacggcggcgtggtggcgaacggtgcggcggcggcggcgacgagcccggcgtcgccggcgggatcgacaggcgggagcccgacgcgggcgccgggggtggaggggccgcgcgtggggaagccggcgaggaggcggtccagggcgtcgcggcgcgcgcccgtgacgctgctcaacacggacaccaccaacttccgcgccatggtgcagcagttcaccggcatcccggcgccgcccgcgggcgcgttcgcggggcccggcggcgttccggtcatcaacttcggctccgactacggcttcaccggcgccgtccttcccttctccgaccacctccaaccgcgccggccgacgttccaggaccaccaacagctcctccgaccgcagcagcagtacaccggcgcaccgttcggttacggcaacctgcagcaagccggcggcgccggcaccggcgccggcgacatgttcagccacgcgctgagctcggccgaggacaggttgctcctgcagagcctccagtcagctcagatgcctacttccgccgctaaccacagcgctaatggttacttcgcctaattaaccaacggttaatcgaagacacatcacaagcaaagaagattcatggaccagttg

SEQ ID NO: 50982 - DNA, 5168 bp, Oryza sativa
tgtaaatgcgatgtttgtggcgcgacgtgtactagcgtggggttttttgtcgacggatttgattggtcggcgggggctgacgggtgggtcccacgacatttcggggtgtgcgtgtgacgtgggcgtgaagtcatggtggtgacgaggcagggtcaaagtcagagttgtcatgctgctttatttagctactgttctgcttttggggagcgaggctcagaaaactaatttctgaagcttctactaatcgtcaagatgagcacgggtagtttggacgattagtgagacacccatggtataccgccatgtaccattcctctatacttctgtatatgtctagatttattaatatctatataaatatagacaatgctagaaagttttataatatgaaacagaggaagtataacaaaaaaaatttccacacaatattttactacctccgccccaaaataaacgcagtcgtggatatccgtgtccaacgtttgactgtccgttttatttaaaaaatttataaaaagttaaaaaaatagttacgtataaagtattatttatattttatcatctaatgacaaaaaaatactaatcacaaaatattttcaaataagacgaacggtcaaacgttggagatgaacagtgtaaaactgtacttattttaggatggagggattagtaaatttgtagtttagtgcctaactatcaccgagtcaaaggctcatagcattgtggtggttggcggcggcacatgtggatccacagtggttggaggcgcctcgtcgtgatgaaggataacgaggaatgggatcgagcggcgaaagcacctaaagttgttccactgtacgctaagaatttacaggttacttattactagcaggatatattacgagtgtattttactgtaaaagttctcttgaaaatgctgaagcttttactaatcatcaagatgagcacggctaactaggtattaagttttaataaaattatgacagggctttataaagatgacctggaactggaatccttgatgcggctatgtgtttctacttaggaaaatattcagaaccatgatttgtacagccaccggttggaagttcaaaactgcatgtgagctattatgctgaaaatatacaaacatatatgggctggtgttagtgagctgctagtgaagcctgtgaagtgaatttgtgattctgcaattcccaagttcttgttgtcttgttgatctacttctatggtgctaatttaattctcatacaacttgtggagtcatttcggtcatcactcatctgtcaaaaactgataaactgtttgtgaccagcaccaacttgttctaccagcaaagtttggtgaagagccatatagcagataggaaaccaacccctaatattcagaaatttagaatgcctgagccggccgtgtgccgtgaggcatctaccggggtaattcagtgcgaaattaagatcttggtgtcagatgttttggatgcataaatctggatacgtttaaacttgggcagattagtgttcaatgagtttctgtctgctggctggcctgacaagttttaacaatgctataggtcaattgtagttactcctgccttagatcgatacgatattggagttgccaatactcccagttgtttaccaaacaagcagtgtaatcttcacgcagaggtgcaaccagagagttgatcaagcatattgacaaagcacacttcagtgaacggaaaccctgtgaatttactgcaaattcagtcaacagcttaaacctctctctctaaaaaaagttttaaagctctgaaagtctgaattactgatcacgtgatcatgtgagatcatgtgaaaatatatttgtttcagaaatgaaggttgaaaaaccaactctcttttccgtgcctgtacaaaaacattttcagatttcaggaccctctcttcctcctttgttaaagcatgtattgtttatgtagttacaccatttatcttggaagtgatgtttacagcggccaaatatattccagttttgcatatgcttagattttaaagattcaaattgaaggaattattctcacaattgtgtcgattatatgttgatctcgggcaagtgaatactagtgtgatctccttatcagtcaattcgcctcctttttcaagaaaggtaagaacagattcttctcgtgcaagttgtgctgttgctttggttccaatacttgtatagctatgaccagtattcataccttttcgtacttgatacgtcctgctgatgaaacaccggtgtcactctatcagaacagtattcaggttatagaatttttttgatgtgtccaattgtccatcatgaatctaaagctccattcaaaacagactattggacggatcgttgctatgaattatctactcaattataagaataaattaaataatttaaaacatgtggtctaaataatatagttaaaggaatatattttttagaaaatgtgtttttcaaattatggagcaataatttgtttcaacaatcagatggataatctgaaaataagatgcatatgtacttaggggtgtgtttcccatttcctacttctcgtttttttacgcccatatgtttcccaactgataaatggtgtgtgcttttttaaaaaaaaatctataggaaagttgttttaaaaattatattaatctattttaaggttttttttctaatatttaattaatatgcgtaaatacatgtttcgttttgtgtacctgaaaggaggatttccaacccttactctcaaacacagccttaaaagcctacaaatgtatgagcatattggcactaaaatttgtttcgatcactttgcttactgctatagctctagctcttcagttgtcaccttttgttttctccttgtctttctctgcgatgtcgtggttgctccactctcttctcctcttctccttgcctgtctgatcgatcgcctcgccaccgccgccgccaccgccgccgtcgtcgtcgtcgtcgtcgtatcggcatggaggtgtcccacatggccaactgcagcaacgtctcctcaccggagcagcagccgatgccgccgtcttcggcagcggcgtcgtcgccgtcgccgccgcagcttgactacgacgtggtggtgatcctggcggcgatgctgtgcgcgctggtgtgcgcgctggggctcaactcgatgctccagtgcgtggtgcggtgcacccggcgcgccgtggcggaccccgtcggctgggtggagcaccgccgcgccggcgcggggctcaagcgcgaggacgtcgtggcgctgcccgtcgccacgtacgtcgcctcgccggcgccctccgtcgccggctgcgccatctgcctgtcggacttcgccgacggggagagggtccggctgctcccggcgtgcggccaccggttccacgtcgtgtgcatcgacaggtggctcctggcgcactgctcctgcccgacgtgccgccgccgcccctcgccagaggccgacggccacggcgccgtcgtcggagaagaccaccaccatcgcctgcaagttttgactgctgcttaattgatcggctaaactttttttactatagattatgagcgtgacctatatatgctcattatccggtaaataacttgtataatggctgatgattttacttcgccatcttgagtgagtagttattattttcgtctatccaggaaaatcatcctgaatgacagttgcttttatgtatgagcatcccttgttagttgttactgcataataatgcaaagctaatcattaaaactggcaatgggtctacagtatttgcccttttttttaaaggaaacaactcagaacgcatactcacacaccacaatcacatcacaacacacgaacacacacgtgtgcgtatccctaacacacgctaggattgagaatggaggcactaggcctcaatgcacgggaaacgtgcagtcccactgaacgcacatgcgtgtgtaccctattttctagttgagactgccccgaaggacagtcccgaagaaaatacgggaaaaacccgtcgaggtgaggccccgcgagtcgaattcacgaccgactattcgcaccacagcgaacatgccaaccgagctaagctcgatccttagtattcaaaattttcaaaagacctaaaaaaatacacaatcgactgcactaccactccctattttctagtcgagactgccctgaaggacagtcccaaagaaaagactggaaaaacccgtcgaggtgaggccccgcgagtcgaattcacgaccagccgttcgcaccacagcgaacttgccaaccgagctaagctcggtcctcagtatttgtagtttttttttggcgaggaacagtatttatagttaactactccctctgttttaggttataagacattttgactttaatcaaagtcaaactgctttaagtttgactaagttttaacattttcaacccaagacaaatttattataaaaatatattcaatgattgatttaatgaaactaatttggtattataaatattattatatttgtctataaagttagtcaaacttgaagtaatttgacttttactgaagtcaaaacgtcttataacctaaaactctaagagatgtactgttcacttacttcatcaatcaaaatttccaaaataccataaaaaagcacaatcgacggcattaccactccatccctaaaagaataaacatcttactataaatatttttatgagctatgggaactcaagatttttttttcgataatgaaaatcgatctagcctcataggaccgggagatatgaacagactggcgatgttcgtttcactaaaaatggaaatgaagttagggcacgataaatgataaagtcattagaatgtgattaattgagtttcatattgtcaattgttacaaacttgaaaaataaatttatcagatattttaaaataacttttatatagaaagcttttacacaaaatataccgtttatcaatttgaatagcgtgttaacaaaaactaagataaaatctttatcttaaccagcaaagaacagggccattgtacagttaggaaaaatacaacaggcaggtctcacgactctcgtcattgcatagagacgacacaaaaaaaaggagggggaaaaatgaagtgattcccacggtttatctggaggg

SEQ ID NO: 50983 - DNA, 829 bp, Oryza sativa
ccttctcttcctacatactagggcatctgctgttatcaatggcatcagggcttagcgttgacgagagccatgtgcccgatcaaatccaagacccggttgctggagcaaagaaacaaaatcttcaggtcagataaagatagatggaaaaaatacatgcaaggcaccatttggaacacacgagttgcgtatgaaacattcagtttctgcagtaatcaggaaaacgaataggttctgaaaagggctggctaaggcgttatgccattaagtggatgctcacctgtagccccactcgttgtcgtaccaagagacgagcttcatgaaagaagaacttaagccaattccagccttggcatcaaatatgctagacctggaaaatatagataggctttagcaatttttgctcctatgttcaagaaaaacattgcgaagacgaaaatacttacctggtgtcaccaatgaaatcattcgaaacgacgtcctcatctgtgtagcctaaaatacctttcaaagaaccttctgaggcttccctgggaacaaggaccaggacatggttaagtactatgttggattaacaactctccagtccaatcattcgaacaattgcagacaaatgatgacccaaatactaacaaaaaattgagaagttaagccagaaatgattagaaagcatagagcgagaaactgaacagaatataaacaccaacgaaaaaatgagtgcattaagcaatgaagcagcaactaaatgtgctaggacatgacaagaagattgaaggcatacttgatagctgctttcacatcctcataagaagcacttttctcaagacggcat

SEQ ID NO: 50984 - DNA, 1159 bp, Oryza sativa
taaagagctaatgttgttgtgagaatagtcccctatgtaacaccccttaacacttgcacaaaactaaaccttcttctttgttaatgaaaggagactgtccttctaccctcttattcaaaagaaaaaaaaaacagactttttcaaaagtaacagttcttggtacaaagagcggacttttcttccctaaaaacttttaggccccgtttagttcacgagacgaaaagtttcaaagagtcagatcggatatacaaacacacattcaaagtattaaacgtagactaataacagaacaatttacagattccgtctgtaaactgcgagatgaatttattaagcctaattaatccgtcattagcaaatctttactgtagcaccacattatcaaatcatggagcaattaggcttaaaatatttgtctcgtaatttacacacaatctgtgtaattagttttttttctatacttaatactctatacatatgtcaaacattagatgtgacagggtgaaattttttttatttacgaactaaacaggtctttacatagtttgaacacgggtagggctgtatttagttcacaccgagattggaatttttgttgaaattggaacgatgtgatgaaaaagttggaagtttatgtgtgtatgaaagttttgatataatataaaagttggaagtttaaaaaaatattttgaaactaaccacggcgtaggtcgaggtcgatatggatcgtatcaatcgatcatggcggcaggcacgagctaaggtacggtggcccatgcaaggcaaccactggcaacaggcaagcaaagcacggccgccgctagctccagctccatccaactccaagcagcctaggggcaacattttctccaacgcgacacacaacacacaagtggcgagctcgatcgtcggctgtccatgccggtcaaaggacatgcacaagctgccattggtggatgcatggcccgggaccgacaggcgacagctacatgcgtgcaagtaccatggccatttgcagattaattcaatgcccaaaccctctctcgctaccatcgtttcacactatttccaatgatcatttatccagttaattgtccttgatcgcaacaaaatatagttcctccctccaggttgtaatacccgttgtttcggataaaga

SEQ ID NO: 50985 - DNA, 1786 bp, Oryza sativa
ggcaccactgcatcatatgtatactctgtttgtgcactcctatacggagcattcactgggtttcaccctcccatatattttgagacaagtgcaatgataattacatttgtgttgtttgggaagtatcttgaggtgcttgcaaaagggaaaacttctgatgctatcaagaagcttgtagaattggtccctgctactgctcttttgcttctgaaagacaaaggtatatggtaaaattttgtccttcaaaacatatacaattaagtcacagtgccacactcatcacattagttttagaagttatttctgacttgttttaggcaaccgcctgtgttttttttttcatttcatactatcaagttacacaaactcacattgttcttttcaaatgcagaaggaaaatatactgaggagagagaaattgatgcgctattagtccaacctggagacatcttaaaagtgcttcctggttcaaaggttcctgctgatggtgttgttgtgtggggaacaagccatgtcaatgaaagtatgataactggtgaatctgcaccaattcccaaagaagtatctagtgcagtaatcggagggacaatgaacttgcatggtgtccttcatatacaagcaaacaaagtaggatccgagacagttctgagtcagatcatatctctggttgaaactgctcagatgtccaaagcccccattcagaaatttgctgattatgtgagtaacctcccatattcttttctgtgatgtccttcatttgctttgtctgtacttattttaagtgtttaccgtgtactttacatattaactttaaaagcgtcagagcattttttgtgatctatttactatttccgatacttgagaatgttgcaggcaaatgttgtttgtttatgagaatttgattgttcatatgccctcttttaacatcatcattcttatgttgctttctacttctgatgtaaaaagttgtaacttgtttaatctcaaaacattttggctgcttaggagtaccttccagtccaaagtttttccctgtgttaactttagtctttgaccttctatgctttcttaatacaaacatacatgtcttttgtatattcgtgaaaaatttaacagaactcttggaagaatagactagtttcttttatctgtgaaaagctcttgtgtctcctaaatgtgcggtaatgattatagaggcctgttatggggaatgctgacactgcctacattttgctttcaggttgctagcatttttgttccaattgtcatcaccttgtccatgattacattccttgtatggtaattcaacatatactaacacaatttttgagtgatactatgtttgaaacttcaatttttctgacatgtacattggctgctttgtaggtttttatgtggatgggtgggagcatacccaaattcatggatttctggaactagcaactgctttgttttctctctcatgtttgcaatagctgtagttgtgattgcttgcccttgcgcccttggtctggcaacacctactgctgtgatggtggcaactggagttggagctaatcatggagtacttgtgaaggggggagatgcattagagagggctcaaaatgtaaattacgtgatttttgacaaaacaggcacactaacacaaggaaaagcagttgtgacaacagcgaaggttttctcaggatggatcttggggatttcctcacattagtagcatctgcagaggtgaggttgaacttaagttgcttgtatggttcatatcaagctgtagtaaatgtgtttc

SEQ ID NO: 50986 - DNA, 1864 bp, Oryza sativa
ttttacggtctacaaaacacatttataataagagtctgctgcattaaagagaggaaagttcaaattgtcagttggcagtaccttcaacctccttcaaggctgagtccctttgcgcagctagttctactttgtctcttttcaaggcttcaatctgtttctccatttgagccatcctggtagcttgcgctgtttgaaatccaaatgtttgaggatacagctatgacagcataaattaatgggacagatctagaagattaccttttgatgaaccacttagctcgaagtttgaatcctggagctgggcaattcggtcccttaactccttctctgtctttttggcgtactccttggcctcatgcagctggtccctaactgcttcaagagttcccaaatgaggaaccagcttttccaaagttgtagtcttggcctcattgcgaagatggattctctgcatgatggatcatggttcagttctgctaaagagagaacaaagttattaaaggcagtcacccggaagatttacattcacaatgcgagtggcttctccaagtgctttcttcagctggcacacttcctcatcttctttttgacgatttatgacgatgccggcaacttgcgaattctcgtcccaccatttgagtaagataggaggacgggaatcatcagccgcctttatgcgaggaattgtttcttcgtcgtcgcctagtgttcctgatgtatttccaagacattagacgagtaagctgaagttatttaaatcggcatcacttgagaagatgtgttacctgaggatgttcctggctgaacatgagggatttcttcatcgggacctacatccgactggtttccagtcgggggctcttgtgttgttgcggtttcagctgttgccgactggtctccagttggcggctggtcactcggatcggctttgtcatccgaagcatgggcgccagtcggctgactttcggcagtcggctggctttcggcagtcggctggttttcggcagacggctcagcgtctttggataaatttggctctgtcacagccggatcaggatcttttccagttggatctatgtcggatggtttcctgcaaagtgtcctttcgatattcagcgtaatttctatgagagaagcatatcaaagggagatggtaccgagaagtttatacctggaagatgttctaatctttggcatttgacggccagccagttttttcctgggcatggtatgctttgggagtttgttgggcgtgcccttgtccccagatttgttgctgtcatcgccctcgtcgtcattaagcaccagctttctcttgcgaggacctgtctgcccagccggtttggaggtctgaggttgtgggtctgacctgattgtcggccctccacttccctgaatggtgtgctggcgaggagatcggcgctgagcaattgggggatcagatttcatcaatacatattcctgaataagatgcctccatggttagttaactcaacatgaagacaagatactattttggtcataagttgaagatttcagatacatacctgcggaggcggattgaatgcattatatggtacaactggcagctgatgtgagtagctgacgacaatagcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagcctcgttctttgagttttaacatgcgatccaacaattccaaggcttgggcagcttcatctccgattggaagagagt

SEQ ID NO: 50987 - DNA, 3421 bp, Oryza sativa
cctaataggtgcatctattcgatgcaccatattctttatcttttcgccctttacagtcttcgtcttcgctactcggtaggccttggcatgaaaagtttgaagcactcggattattatctttgggaaggctacgatggttgactgcaaaggtctcgggggctactgtggagattatggatatcccatatctacaaggcgacaatatttgggctgaatataggataccgaatatagatagaatatcttacttgtatctcgggtttgtttcttaacttgtacatcaaggaaacaccttgagacttagtcggtcacgactgtatttgatctgtatctatgtattccgttagggatatagattatcttttgtaacccggactccttcccatatataaggagggtctgggcgcctctaggggcggatgttgattttctctaaatcatacaatcaataatacactcggcggattcatccccggacaggagtagggtattacttcttttataagaaggcctgaacctgtataaatcctttgtctccaaacccatacacttttccagcttgatagccaccccctatcttgactgtcaacatcaagtttgactgtcaacactaactttttctttaaacaaacatctaattttgactgccaaacccatacacttttattattgccgaaatctagtttcgacaccggccatccatccatcatccagatccatggcgcctgcgcctgcgcacaccagcagacaacagtcactcaccagatcgacgagacggctgtcccccggtgaggttggcaacgccggtgcgtgtctcccgcccatgtggcagcctgcctcgctgcctctcctctcctcgcagctcagctcgatcgcgcgccggtggcggtggcgggggccgcgcttcacatggccgccgatgccgatgccgatgccgatgccgatggatcgtggacggatgcggcgcggcgctgtgtgtcgcctgaaaagcggagcctttttttagaggaaaggattggtggaaagtttcagtgatgagatgatagctagctacagtgtgagtgtgtggtggcgacacgacggacgacggtcgtccagacactcgagtgtggccgactggccggtgagggtgacgagtactctctctgccttgttggcagaatggcagtcctcttcttttgccagtctctcctctctcatctcacatcgccgagttcaggcttcagaggttcgctgcggccaaagtggccgtggccggatgggcaattcgggtggatgacgaccccgcagttatcttatgcattagcccttgtttagttactaactttttctttaaactttcaactttttttatcatattaaaacttttctacacacatatcgttttaatttcaaacaaacatctaattttggcgtgaactaaacacacccttagtttggttgaatgttgggatggatcaggctgaatctattttttatcgaaattgctatacgtccgacctataagtccgacccatccatccgactagtgtatgtataagcatatatgctatttgtttgggcccacatggtagtaaacaagttcagtgattggttgtatgactcggtcggacacaaatcgtatggctcagtcgtacgtatagcaagatttatttttaatagcgtttgattcgagaataactggaataggatgatcctgagaggaaatatttcccttcagatggtctggtccctaaaaaattgacggacgaatccaagaaatggaaatgagtctaacccatcccacctcatccccaaaccaaatatagaggacatgtttaatgagttactacttctattctaaaatataacaggttttagagtggtagtaggtgaaattaaatgagaaatgactgtgattggttgaaaaagcaagatatgtggagaatttgatggtcgaagattatgattggttgagaactcaataaaagtgaagaaatcgttatattttgaaacgaattttaaatgctgctaattttgtcccggaatattattttttggacacgattattaagaaaatatatagaattaaatggaatgagattgtgattggttgagaaatggaggtagttgaaaaaattgaatggtagaggggttatggttggttggaaagagaatctatgtttttggaaaaaaattaaagcccataagttattatattttaggacggaggagtagaagttgtagtatattttaggctctcatcggatggcctaatcagccaaagaaaaagccaaattttaaattttcaaacttaatttggagattgattttgagatattttcagcgtagtttcttttttatattggcttttaagtcaccaagaacacatatataaaagttttacctacaaatttatttttattccctaataagccgttttggcttgttagggaaaaagccaaccgatgaagaccttagaatggagggagtacctatcttcacttcttatatctcatttatattactttcataattttaaatttatcttatattaacataataataaacacaaagtaataaagaactcactaaatgtaagtagtttagatgtaattaaaatgctaagtaagcacaaagtatataaagatacgttggtatcttatactaacaaggtagctcgcgatctaactcgttaagcttactagttaaaacttaaaagcctaatttggctcgaacttactatatcgctacgactttacctttaaaccaatccgagctgattcgagtcatgagctttgagctctccttttcccactccttctatctcgaaagacctcatcttttccaatcttgtgttgttttgagtgaagtggcagccattattatcttcatcctaaattataaaaacctatataacaaaatgagatgtatatttgtactatgaatcggcttagattcacagtaatagaatatgttgctttcattcctttatttttatattttaggactgcgtacgcatggatctctaatctatgtgagctgtagtatgtaaaggtgtcacatgccactatgtagtctcatctcatgctacttgtggcatcgtctcatcctacttgcctaacgagataattctgttttggcctttccggtgcgaagatacaacaatgacagtcgtacatgagcactgcaaaatttagcttatgaaaaattttaaactgtttttacaaaagtaactttagataactaaattttacactaaaattttaatgccacaagataattccgtcccaaaatataaaaacttagaaccggatgtcccatccaggatgtcccatccagttctaaattattatattttaggacggatggagcagtaaatattaacttttatattttgggatggatgctaatattttagcttatatgtttcggcacatct

SEQ ID NO: 50988 - DNA, 1091 bp, Oryza sativa
ccgctacagcagcagcactgcacaaccactgtgggcctgtttagttaaaaaaaacttttcccaaaaacatcgcatcaaatctttagacacatatatggagcattaaatatagataaaaggaaaaactaattgtatagtttgcatataaatcgcgagacaaatcttttgagcctaattaggccatgattagccacaagtgctacaataacccacatgtgctaatgacggattaattaggctcaaaaaattcgtttcgcggttttcaggcgagttatgaaattagtttttcattcgtgtccgaaaacctcttccaacatcctaccaaacgtctgatatgatacccaaaactttttatttcaccaactaaacagccacagtaattgagctgccgaacacaccctaagctgtaacactgcacgtcacaatccatctcgatggtaagagtcggtggttccgtacgcaatacagccagtcaacaactttgactaggcacaacgccctgtcactgacaccgtgggccccacaaactgtcctaacatgcgggagcgacgtcctcctcttggacctcttccatgagaccatctgacggcccaggaacaactccaaagaggtcggccgggccgggccccacttggcatgttcccccacttcaggccacggtggggcccatcgtacggacgataagggggcacgcgtcacatcctggatcgtcgcacaggtgcagcgcccgcgcctcacatggcggccacacggtgtccactgctgccacacatgggattgtttcgtaggcatgcaagccggacgggcatgtaggttttttttagcccgcttatctcatttttaatttattttttcttttaaattttatattattgtgtgagaaataaactagcaagcgagtttttatacaggtagtgagactacccacttgcatctctattgtttcatgaaatggatttcaaaaacaccaaccacactgaaattcttatgggtgaatagctaatttagtccctccagtttcagctaaggctcaatttggttcttcacgtttcattttgtccacataggtccttcaaatatttgttttgact

SEQ ID NO: 50989 - DNA, 2516 bp, Oryza sativa
acacaattagcacatgtcattcgtcctattctaaattgtgctgacagagtcttttgtgcctttggctgagagatagcagtatctgggataatttctgcgtcaaatccggcatcttctatagcttctattatatcctcaacctgtataaacaagtacccaaataaaaattgcaggtagctaattgacccatataatctaaaaatgtgtgtcaacaatgaatagtaggtggccattaaaacaaactaaatgaatgcctattatgaacaggaggtagcagatagaacttgctggtaaatgtctacttaatagtcaggaaagccatccttaatagttccaacaaaagcaaaaggatgaaacacaacattccccgtctgcactacaataggctcatcaaaaagttgctagcgctacaactcaactaatattcacattaacagtcattaaaaccagaaactgtagagtacttcacaacataataaccataagcattaataaatttcaattgtgaagtacactgttattactatgataagactaaattttatcactgctgaaagtttatacacttgcatggtaattactgggcctagaataatgagattatatgcttgtcccaaaattagcatgtaacatcattttgcattcaattttgctcaaaggaaacttcaatgagtacttagaagccacataaattgggatccttaacttagcaccctttccccccgaaaacatgactcggctgctccctgcctcaccagccaatcaaacctatcgtagtacagcagttaccccatttctgccggtagcaacaaccaatcgcagcaaactgcagcctttttgagctcccaaatcccacaatccagagagtccagccacaatcacgagcttgcaacaaggttacagctcatcaaccgccaaagcaaaaggagcacaaaaactctggcctctgggcactgtgggctaaccacatttcacgaatcaactcatgaaaagtcgtcatcgcaaggtgaagtcaaaaagaaaaaaaaaatcatctccagctaaaacccaaaattgcaatatcatacacgattgactcggtctcacactcacacacatagtaattagtaaactcaacttattattagacaagagtaaattccgattcaccaacttctaaccgctcgagaaaaaccacgagcaagcagcgcgatccagcttcctagaatcctgttctaccgcaccaaccatcacctacgcaataattccagcgcaagaaaaaacttcaaaaaatttaccaccgcgtgagcgtcaacgagctcacgaatcccagtttgctcccggagacgcgcaaaactcggctcgacaaacgggctcagccacgcaaaaggatcacatcacaattgcaatcgcaatcgcgcggaaatcaccttgaggagcgccgggtcgaaacgacgtgggcgcggttctggagcagggacacggcgacgcgccgcacgccgcggcgggccgagacggcgccctcgacggcgctcgtgcacgccgagcacgtcattccggtgacccgcacgtgcgcctcctcctcctcccccgccgccgccgcggcggcgccgccccccatctcctcgtcgtacgagtccagcagccggacgtcctccatctcgtcccctcccccacccgccgccgccggccggccgccgccggcgaccgccgagagctgcaggtgggccatgcctgtcagagagagagagagtagccgcgcgaggtgggaatatttggtggaagagagagaggagacgaaacgatggagaatggggcgaggcggattatataaacggagagggaaaaaaaagttaaagcgcagggggcaaagtggaattattttgcattttttaggaggttatttgtaaattatggattagtcaaatgctcgaaattgttatctgtgcgtttagctgggagaggcaaatttcgccatatgaactttcccgtttttgacttcttctcagatggttcgaagaaaatctctctgaccgggttttcgaattctgaactttttggtagtactagtattactacctccgtcccaaattaagtacagccataagtttccgtgcccaactttaatcgtccgtcttatttaaaatttttttataattagcatttttgttgttataagatgataaaacctgaatagtactttactcgtgactaatttttttaattttttttaaaattttttaaataagacgaatgattaaagttgagcgcgaaaaactatggttgcagttattttaggacagagagagtacatgatatcaccgtgttggggaagccaatgttacggtctactatagcgtaactgctttcgtaattgtagtaagttaatgcttggttatatgtgagcttttgttgtgattattttgttctgacatttttggcttagaatatagtaggggctttgtttggttgaaattagcatgatttgggataagttgagctaaaccaacatgccctttacaaagtccaaaacaggg

SEQ ID NO: 50990 - DNA, 2187 bp, Oryza sativa
aaatgtaacccccatcataaatttcataaacccatcgcaaaatgcacccaaatcatatcgaaattcaaaatgcaatcgaagcaaaaaaaaaaaatcaaacaaattcagagcgaccgcgcgaggagagaaggagacgagcggtttcgccgcgggaatccgcgtgccggtggccaggttccggagcacgtgttccgcgcggctaatcacggagtagtatgttacgactttaatcgggtgattagcgccttactaatcctatcttactataaagttatcccccaccaactccttaaacttaacatgcatgcaaagatgccacatcatcatccactaatccattaattaacaagatgccacatcatcatctactaacaatcatcacatttaaacatcatacaaacatgctatatctttatagtttttataatttaagagcttttcaatataaacatgttaaattatcatccaatataattcacataatgtttcaatgtatatttttattatgttttatgatatatcctatatatttatatagttcatcctcacttaattagtgcttaaatgattaatctatggtccaaattatctttctccttttttcctctcattaaggcatatcacatcaattgtttttagcctttagatgattaatctacggtccaaactatctccctacttttcttattctataaagtcataccaccttacttttacgtttgaatcatcattctacatactatttaaatttaaattatcataaaccacattaatttatttaatctgatattattagctatcttacacgttatttttttattgttatcatactaaattcccgcagcaatgcgcgggatttcacctagtcacctaataatcaaagatccccgtgggggcccacctgctgatcgataacggtcgctgtgacggtgggcccggggtggcctgggtcgtgattgggtgaggccgtccgtcggaggggtaggtgtgtgtaggtaggcttggctctgagtgtggggcccatccgacgtggcgtggtgtgtaagccaagacgacacgcatgcacaaatccggttcgtcgaggttgacccatcgcgttagacacatacaagcgggggcggctaacaccccccatcctttctttctcctcatcttcttctcttcctactacaccataaatttttaaaaaataaaaaacataagcttgaaaaaaattatatatagaaatactatatataaaaaaattaaatttaaatttaaatttaaaacaggtatgtaaacttttgacttataaactttgggtctataaactaatatttgaatttaaattcaaattttaatcgggtatataaacttttgacataaactttgggtctataaactttagatgtacaaaatactatatataaaaaatatttgaattcaaattcaaatttgaattggatataattcaaattcaaatttgaattgggtatgtaaacttttgacttataaattttgggtctataaattttaggtgtataaactttagatgtatagaaatattatatataaaaaatatttgaattcaaattcaaatttgaatcagatgtataaactttaggtctctaaactttagatgtgtaaacttaaggtgtacaaactttaggtgcgtaaatttactaaaataagaaagtaatgtggtgccaaaaaatgaaaccatatggaggaaaggggagcgcccaggggcgatcgatcgccccttagcatttccgcatacaagctggtgtgtgttagagcaaggctaataatacaatcgatatgttgtttataagtttttttttagccttctctatagggtccacttgtctctcttatagaatttttttggttcttgtgtccaagccggttgtaagtttacagtccgcttcttttctctctctcatctcttctatcatttgcctcggcatttagctggtttatagcctactattattatacttgctcttagtactgtatgctttttttttcgtttctataattttcaatttcaactttcgatgcaatgaatgatgatgaatcttggtgatgatgatgatgatgaacgagctgaagttaggcaaagattcaggtactaggagtagtaataacaaaacaaagttcgcatttgattggttttaacttccgtgtttgagatcgacactgctt

SEQ ID NO: 50991 - DNA, 1320 bp, Oryza sativa
attgaaaatcgctgcaacttgcagccgttttgaactaccataggcgtatctgctaccaaaaaatctctttcaaacacactatttatattttgggatggagtaagtaagattagaagttctacgtacagtggtctggacacttggttaagtgagaaaccatgtgcataaatgtgaacacgctgagtatttcctcgaacgatcgacatttgaacattttagttaactgaacgagctaatctaactttgtatatatacccaatttggtaagcgtatattaatcgatgtttggcttgcggtgcaagtaaaaaatgggcgccctgatcgactactgtgcatgccgtacgttgaatcactctacggtcttgatcagaaaattaactaagagctagacataacattgtagttaccactaattcatcaggtccattagtgcttgacttgtagtgttggccatgcttacgagctaggagacgtgctcgtggaagcaatcacgcaaatgaaggtgaaagtgtaacatataatgtgcaacctttacaagatcgtgctttaatttgtcacagcttcagcttaaaacctaagctaattttgaagctcttgttaaagcttcatgaaaagaaagccaggcaacacagagtgacaaaaagggtccttaacactctaatcatctacacgtggacttatatataagcgattttgatttgttttcactataaatttatagtatgttattttaatcttggctttcaaattacgaataatacagattcaaaagttttgtctggttcattattttttctacgacttatcaacaaatcgatcggtcgaaagtaaattagaaacaggaagattcaacttttaaactcaagtgacatcagcaagcatgctccaagtctggtgaccatgctatagcaaaccatttttcatagatcattttaagcacatgataaatttcaaaaatagaaactgagcacatgataaacaatctttgtgccacccaattttatgatggtttttctcaacagttgcagtccgaagaggcgtactccattgtactacgatccaatagtggtcgtcgaatatatgcttgatataaccaaaacaggcatcccccataacttgattcgactgagggaattgctaaagatactgattttatatcatttttgttagcatttttttaaagtggtaaacgtcctactttgtacgggaactttttatataaaagttcttttaaatatcttataaagtcatttctaaatttaaaataatttaaacccaattaattagtaatatgagctaataatattctcgttttacgtg

SEQ ID NO: 50992 - DNA, 20518 bp, Oryza sativa
ggtcgatgacccagtacggcggggtgtcggggtggccgcggcgcaccccgtcgcactcgatggcgagctcccggacgcccttgctcgccagggcggggaaccaggtgggcaggtggtggaagtggcgggcgtggacgcaggcgcggaagccgacgacgggcgccgcgcaccgccacaggtcgcgggcggagggcgcgccgcggcagccccagccgaggcggatgtcgaggtagcgcacggactcccaccggcgccgccacgcgtgggagaggcagcacgtgcggaccagcaggtcgaaggggatccgcgcgaggatgatgtcgaggacgtccgtggggagcgacatcagctcgtcctccctcgccgccgccgccatattccggcggttcggattcgccgttgcttcttcgcctcgtgttatgaaaatagatgcacaacggagaaacgaattttacgtagaaaacccttgcggaaaaaaactatgggcgccgaccggcaatgatcactatagagtagatgattacaaacgtaggggaataacaatgagaacgtcaacccttcccgtacagcttacaagagtatatatagaggataatagaaagacacctaataggatagacatgactagaaaactaatccgaatatattgtgggcccaaaattcggatcacatatttaacaatctccaccttgagacgaatttcctcttgtagcataaaaacatcaatcaccaaaaaatacctcatgtaggtaaaatcaccgcgcgccaaatagtctctaggactatgctgtcacacccaccaagcttgagcaaagcttaaacttagtagcaggaactggctttgtcatcatacttatcttgcataccttgacatcaccttcagcaatcacacctcgaataaagtgatatctcacatcaatgtgctttgttctctcatggaacatttgatcctttgtaaggcatattgcaccttgactatcacaaaatatattaatgcaagacgtaactccacaaagctcagtgtacaaacctctaagccaaatagcttctttacaagcttcagaaatagccatatactctgcttcagtagtagacaaggcaacagttgcttgcaaacttgccttccaactaacagcacatcctccaatagtgaaaacataacctgtgagcgatcttctcctatccaaatctccagcaaaatctgaatccacataaccaacaagtccatctttagatctcccaaactgcaaacaagcactagatgtaccacgtaggtatctgaaaatctattgaacagctttacaatgctctttgccaggattagccatgtatctactgacatcacttaatgcatgtgataagtcaggacgagaacataccatggcatacataagtgaaccaactgcacttgaataaggaactctagacatgtactcaatatcataatctgactgtggacataaatctgaagataatctgaaatgtgcagctaaaggaatactcactggttttgcatcatgcatattgaaacgatgaagaactttttcaatataacctttctgactaagatataacttgccagaatgtctttctctagaatttccataacgagaattttcttcgctgcacccaaatccttcatctcaaattcactactcaattgtgccttcaactttgctatctctgatttatcttttacagcaatcaacatatcatcgacataaagaagcaaatatatagttggaccatcaacaactttgagataaacacagccatcataattggatcttctaaacttctgagaaagcatgaaagagtcaaatctcttataccactgtctaggtgactgcttcaacccataaagagatttcttcaacctacagactaggttctcttttccaggaacaacaaaaccttcaggttgctccatacaaatgtcctcttctaactccccatgtaaaaatgcagtcttaacatctatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacataccttcctttcttttgaagatccacttgcaacggataggtttcttctcctttggcaacttcaccaattcccaagtataattcttttcaagtgattccatttcatcatgcatagcagttatccatgtattgcaatcatcagaaacaatagcctcagaatatgtagaaggttcggcattaccttcaatttcttctgtcacactcaaagcataagcaactatgttcgcttcttcaatatatcttcgaggaggtttaatatttcttttgggcttatcttttgcaatagaatgttttggagactgctgaacaatagaagaatctgaatcttcaataacaggtgcatcttggttaatagcaacatcttctttttctggtgcatgccctgaactgatcaagtgctccacctgcacacttgctttctcatgattctcaacaggaacattagtagaaggtttgtcatgtaacataactgattcatggaagacaacatttctactaatcacaacctttttggtttcaggacaccataactgatagcctttcacaccagacggataaccaagaaaaatgcacttaatagctctaggctccaatttaccattatcaacatgagcataagcagtacaaccaaatacttttaagtctgaataatttgctggggaaccagaccatacctcaattggagtcttcttatcaatggcataactgggtgatcgattgataacaagcagtggaaacggcttccgcccaaaactatttaggcaaacctgcattagacaacatacaacgggcctttgatataattgtcctgttcatacgctcagctacgccgtttttgttgaggtgtgtgaggaacggtgtagtgacgcacaatgccttcagacttgcaatatgatttaaatatcttagaacagaactccatcccattgtcagtacggaggattttcaccttcctttcagtttgtctttcaaccatagttttccactctttaaacacattaaaagcttgatatttgtgcttcaagaaataaggccaaacttttcacgaataatcatcaacgatagtcatcatgtaacgagcacctctaaaagatgtcttacgagcaggcccccataaatcagaatgcacataatcaagaataccttcagtagtatgtgtagatgtattgaacttcaccctcttatgcttgccaaagatgcaatgctcacaaaatttgagcttcctgatgctttgtccatctagcaatcctcgcttgctcaattttgccaaaccaatttcactcatatgcccaagacgcatatgccaaagattagtagcatcggaattagataatgaatcagaaactgtagcaacattacctaatatagttgtacctcgcagatggtacaggttggcagatttaatatcagctttcatcacaacaagagagcctttaattaccttcaaaattccgtctccaccggaatatttgtaccctttgcaatcaagagtacataaagagatgagacttctcttcaaatttggaatatgtcgcacatctgacaatgttctgatacagccatcaaacatcttgatctgaactgttccaatacctgcaacctcacatggtgtatcatcacccatcaaaacagtaccaccttgaacaacttcataagtggcaaaccaatccctattcgggcacatgtgataggtgcatgcagtatcaagaatccactggtcactagtttgtgcacaaccagcataagcaacaagtaattctacatcagacttctcatcagtaacaactgcggctttaccttcctcttctttcttaccttctggtacatattttccggttctcttgtctttgtcctgcagcttccaacactcagagatatcatgtccatctctcttgcagtatttgcatgacttatacctgtctctggattttgatctcccacggtagctacttgagcttttatctcttgattggttctttgtgttcttctcctgttgcatgccccgaacaaccaagccttctgcttgtgaatttgaaccttcagagggtaccatcttcttcatcttttctttggcatgcagagcatcataaacttctttcaaagttagagtatcacggctataaagaatagtatccctgaagtttgcatatgagctaggcaatgaacacaatagaataaggcctaaatcctcttcatcatactttacctcatagactcaaggtcaacaacaatttctttgaaagcggagagatagtccatcatagacccatcatcttgtaacttgtgcaaaaataatttttgcttcaggtgcatcttactggtcagatccttagtcatgcatatctgttccagcttcaaccacagcccagcggctgtctcctccttaagcacctcctgcaaaatattgttagatagatgaagatgaatatatgacatagccttacgatcccttttcttctcatcgttggaccaatcctgtgtcctcttgtcaaatccagaaagcgcatcatcgaggtcttgttgtgcaagaacggctcgcatcttcacttgccaaagtgagaatcttgtgtctcgatccaggagcggtagatcatacttcaaactcgccatgggaattaatcctgaaatttgctagaaagaaattagggtaaacctagcaaaaacgcgaaacctgggtgcacttcctgtgtgcacttcctgtgtgcacaaagcgaagtatgtagatttcctggtacacaagctttggtgcgcttagcaaaaaaaaatcgccaagaaattccttctcaacaggaacgatgtagtccctgacttcctcgggtcgcgtgccctacagttgcagtaggccggccctttttcctcctcacggctgtgcggttgctgcagcttctgcttttctcgcgcgggtgtgtgaggacggcgcgactcggactcgacggggtactgcaccgaacagattgattcggcgacgacgaaagcgaaacaggcggcggcggcggtgtggtgtagattgatctccaatgctctgataccacttgttatgaaaatagatgtataacggagacacgaattttacgtggaaaacccttgcggaaaaaaaccacgggcgctgaccggcaatgatcactgtagagtaaatgattacaaacatagggaaataacaatgggaacgtcaccccttcccgtacggcttacaagagtatatatagaggataatagaaagacacctaataggatatacatgaagtcttactaggaaactaatccgaatatattgtgggcccaaaattcggatcacatatttaacacctcgcgtggtggcgatggcttcctgaggagtgaggacgctacgcgacagtggccaccttcttctggaagctttggaccgcgggataaatgggctgaatttcactatgtgggctgctacgtcaccggtagattcaacatctgacccattcattttttgtattgtgcagccaacacaaacagtaagttgagtctacagttgcagcagcaacggctgcatacagtggctgtaccagccagccgaacaggtccattatcgattggaaatcaggacagaattcccatagcatatatactacgaggtgtctaggtgtataactaattttttgcgtgggtttgaaagtcaaattcgtgagaatcacgtagaatctctatattccaaaagatcccttcatgggtgacgaaatgccaatttactcccttcccttaatattacaagtcattttgtcttttcttaagtcaaaattgttgaaaatttgatcaagtttacataaacatataacgacacttataacactaaattactaaatcagtttataccccgcacatgattagtttaggccacgctgcccaaccacccaaaaaaaacatgattcagcttgagcttaaaaaaaagaagatttggagagagagacaatatatttaaaaaaaatgatatcgcgttggggattgaagacgggtcctcgggcttaaaataacacaccccttaccacttcaaatgctaatacagtctccgatcaaatatacattggtgccaaccgtgcacaaatcatttgaacgaagccttttgattcatacataagaatctgaaccttgaggtgccccgtaagctgatctaaaatagcaccctggcatctgttgcaacacgattttcagaaaaacctcagaaaattttgaaccctgattgtcgacaacattcagttatgtcacttcaaatgctgttttatactcgttccgtttctaaatatttgatgccgttgatttttttaaatatgtttgaccgttcgtcttatgcaaaaaaaatttaagtaattattaattttttttcctatcatttgattcattgttaaatatacttatatgtatacatatagttttacatattttacaaaagtttttgaataagatgaaaatatcaaacgtgctaaaaagtcaacggtgtcaaatatttagaaacggagcgagtatatattttgaaccaaatcgtcaaacgtgaaaagtgctcctgctagtacccagtattaattgcaacatccttcaaaactctaggatacattgacagcatttgaagatcaaggaaaaaaagagacgcaaacatttctagcaaggcatattcacagctctctttcatcatgctaaatcagcctgtcattcaaaaataccaaaatgctaaatcagtgtcagcctgtcaccaaattatagtgttcaactcaaaaaaccgtccactgatacagtgaaattctatgcattctgccaacagaaggaaaagtagcagctgtatgtacaacagccacatctagaatgtaacagatcaaagttcaaaagctatgcttccataacagaaaggtggacatggcaaggacaagaggtacaacactctgtaattcctcaagaaggaaaacaagcagctggttgcacaagaacagcctcatctagaatctaaacagtagcaagttccgaagtatttcttccataatgcgaaggcagcatcaaaaaggacaggatgtctaacttacgatccgtcttgtgtcacttttgctgtcaacaaaagttggggtgaagccttttggcactcgattaactctttgcatttattttcaaaccattcgctctttccatcatcatcaaacataaaagtgacagcaaatgtttgaagagagcctgctttggacagtaaaaacttcataaagcacatttgattttcgcggtgcttggcaccagtcagggacacatgtttgaggcttgcaaacaagtcactgcttatctctgaatttagggagtcttcatcaatcttttctttatccaattctgtatcaagagtctacaaaacaaggccaagtttcaattaactcaattgaccaagagatgtctttaaattgaacatagcagttgaaggtgtgaatctaacattacctgaatttcaaggtgctcaatatgcggagcaaacttcagtaaagaatctattgatagaacacttgagagttggccaaaatctatgttcaggctggcttccctcagattctcaaacttgcatgtaattccctccagcatattaatgctgaactgaaagtcataagaacattgttaggcctgacatatgtccatgacgcaagtttacattgagccactaaccaaagaaatatgcaaatattaggacaccatgatcttgtagttacgaaggttcttcttggaccttcattttcagaacctaagaagccatattgtcataaatgttggcatttgcatcagagtacatgtgtttaaatcacatctgccaaaacacgacataccatctctacaagctaactagtttcacattcatcaattcagtcaaattgtaattaagttgctcgcaatgaccaatctattatctatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgtttagtactttttttttcgtttgttcctttcttttctttttccaatcctaattaaaattgaacctatctttatagaaaagaatacccccacaaatagacatcaaatgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttttacgctttattagttagaaagaaaaatcttctattatatactaaaagttcattaaacttcctacgaacgctcctaaattaccatgtggcatcctacaaaacgtttctaaaccgctacgtggcgttctaataaatcggtggatccgctatttgtttaataaattgctagactcactattttcaactattatatttatctttataaaaaaaatatcccacaacccaccccttctctcctcagtacgtatgtatgtacataatacaatgccatgctttctcccctcttccaatccttctcttcctatttctagatgaaaattttaacatgaaaaaatattataataaaacatctaacctttgcttttcacttaaatcgatcagtgaaccaactattttaaccattgtccctaaaaaaatattttaacgattatttaaaccggtgaacccattaatctatatataaaagaaacacttccctaaattttaccatagaacattgtgctttgcatgaaaaccaaatataaacaaacattaaaaccattagatttaggtatatagatggtttaaaccggtgaacctatcaaatctatatataagaaaaacgctttcctaactttgaatatatactatttttctttgcaatgcaaccaaataaaaacaaaatattaaaaatggaaatatatattatggagtaaatttcacaaacccacgtagatatatctatctattatataaaagtccattaaacatcctaaaaagctcctaaactgccacgtgagattccaagaaacagtgcaaagatgacacctaacgctctaattaattcctagaaaatctatggaaaaaggagaacatctaaccattggttttatttaatctgatggacctaatattttttttaccatcagataccattagatttatctttagtaaaaaacttaagatcaatctggcggtacgagtccgcccaacacatatacatgcttccatccatacgcatgataagagtctgtgtgattttttccttgctcgcctcccttttttcgatggtaattaagttaaggcttaagggtatataatatcttctatattagtaagttaattttatcatactttcaaagattgcatacacttgcaaatataggtatagataatatatctcatacatattgatcttggtatgttttataaataaataaagaatcttcaatagctgtaaatcttaaattatatattcaatttatgatctgtttgaaccattgtgtttttttaattaaatcaatagtttaatatctataccaaccatatttaattccattgtgtttttttaattaaatcaatagtttaatatctataccaaccatatttaattgctaataaaattattatattttggacccacatccatacgcaaaaaatcctaaaagttctcattacaaatcaaaatatccaacttagttttttaataaaatcaaaataacttataaaccgctaaccttaaccttaattatagcatcaatggacctattgactcacaaccaacttaattatatctctcgacatatatgtggatgctatttacttaattccaatgccctgataaaatatatgatcttcttttaaggataaatgtacgatcttatgctgtgttcggtgctgagggttgggaaaccttaatcctttggaagttggacattaacttatatcccaaaatacctatatcacgttgcttaaatccaactaatacaccaagaaaagaagaagaacagagggtgtctacagatcagtccttatggatattttactaataaaaattgatttcaaatacttatttgtacttattaaattatctaatcactagaacaaaggaacataccgtccatggagtgaacaaattggagggctaaccggtgcatcccggtgtgcgtgcatgggtatagaactttttttctttaatgaaaagaggggcatgaggtagttacatgtatatacatgaagggcacttttttttcttctaagtatgatgatgtgagcatgctgccggagacacgaattaacatgtctaccatccatggtgagggaagacgaataatttgcttagttggactctacacaatatgttagatcttctacatatccaatggttacaaataatggtctaaactcgagggtcatatattatgtttaataaattaattaccaatttttctatataaatcagtagagccattaattatatatggtttgtgtatgtaatgtcttttataacttaagttttttctctttcactatggaatcacaatttcctatgaggaattatccatagctatgaccaatcaatgtttgccgtcaaataataaattaattatcattttttttctaaaaaatgggtagagccattaattatatatggttgtatatgtaatgtcttttataacttaagttttctctctttccctgtggaacctcaagagtcatatgtcttaggtaccattttttataccgtaagataccaatcctaatctccaatagataattttataaataacaattaaattcgtcatgcaattctaacgaagaaaattcatgggaaaaaacataattttaaaacattgcagatattaattcgctggtataccgcctttataagtttctcaaatttatcctacgtacggtgcatgcccgcgcgtatgcgcgggctaccttcctagtttagttaaatagtgtgaagcttgcaagggcagtaaaaattacttcgaatcgaaacacaagttaggtcattccaacagccttaatctgagcatagaaataccagttgttcttccaattaagggaacttagcagtaaaagaatagtcctctgacaactatcacaaccaaattttaggagagagatcgatcactcctcagaacatgatgacgtatgtatctttatacaagttctgaaaataatcagttcagggaaatgactcatgaacttagtatagcagttgcagtgttagtgattgaaactcagaggaaatgcagaaaataagacataaattgatcagcagtaaataatgtaactaaaaaaattcataactgtggatgagcatgtacatgtgattcaagacaatgtaatggtgattggaattcaacgaggtattcaaatgatcttattctgacgtacctcagcgaccatgaaacagagcttattgacagtagaaatattttggaaagcgtcaaggaattcttgggttccgaagacgcaatcgaatgagatgtacgcatcctcgagcttggggagcgcctctgtgattcggcagccgaagtcgacacccatcggcatggtgacactgagctcccggaggttgggcgctctgatggcccacgggtccaccacgaccgcgccatccatggtacccaggtttgacaactcgagcacggcgaggttctctgacgcgaggatgaggtgttcgagctgcgtgccggcacgggcgtacggaagggtgacacccacgaggtagaggcgctcgaggttggggaagcccggaaagcccggcggcatgtcgcatttctcgaggcggaggctgacgagttcggcgcaggagaagagggcgggtccgggaaggtgcggcagatcgtcaaacgagaacttcaggctgagatcctggacgcccttccgcgccatggcgggcgggcggcgcggtagacgttgcgcgtggcgacgcgggcgcggaagccgcggatgggcgccgcgcaccgccacagggcgcgggaggaggagaccgaagcggggaactcgatgcggaggttggcgacggactcccaccggcggcgccacgcgcgggagaggcaggaggtgcggaccagcttgtcgaaggggagcagcacgaggatgcggtcgttgaggatgtccgacgggagcgccatcagcatgtccgtgcgcgtccccgtcgtcgccggcggcggcggcggaggcggcgcctcggccgctactcgctggcgcttggggggcgacgagtaggcgaagcccgaggtcgccattgttttggcgtggaggtggaggtggaggtggcggtgcgggcggtggcttgctgacgacgatatgacccaacggccttcttctagaacctattccaagatatttatttggttgttgagcacaggagaaagtttatttttgaatcctgaacaattgggttcgcatttataatccgtcaatgtttcatgttcgatagttacatgttttaacgtgatgttttaacgtgtgtctttactgtgtttacctgtcttttctttactatatatagcgtaatatttcaccggtggacaactgaaacatttaaccacccaattattttggaggagatcgggcgtggatttgtagtttctattttatttcagcctctgcttgtttgtgttttagtcattcaattagttctatttatgctttggtagaaaattatgtatccagcaaccttagaaaatacactgaatccccatcatggctgtatcgagcactaccgcaagtgcctggcctctcccctcttccccgcctaagtggcaagcaccgccaccactagcttctcacaacttcctcgctacggcgaggcgacgagtgccaccaccgccgttggctgagagccgcaaggcagagaaagccgagctcggtgttgggcggagcagccccgacgcggtgtcatcgagcttgtctcggagtagagcaatggccggacggggcaacgcagagtggcgacggtgacgacatcctctcacctctccttctcccctcccgcggccacaagaatcgaggcatgaactcggcgccaccatcaatgcctctttcctctagggtgtttaggacaagcaaacggatactaagctcgagctcgaggatgccacaagatctggcaagcgtatttatacttttggagcaaatgaagtatcgaactgaaaactatagattgtaaggatttaaatctccggctatagctgcctctatagctggagatagatgctagaaaaggcagcagctaacaaatgccacttttgccgctacataatatatgacgctaataaccggacttagcgggagatagccagtaatttagccttcagttagctgcagctaagccttggttttgggctgaaattagctacgggccaaggcccatctacttctcatgttaagctgtaaccctaaccctacatcgtctctcttcctcgatctcagtccctcactccctctccttctcctctacaggtgacggcggctgctgcgacctgtagcgtcgacggagatggttgcggctgcgctcagagacggaggcggcggctacagcttcgcccggcggtggcggctgcggctacggcctcgcccggaggcagcggctgcgaccaaaggcgacggttgcgcccggaggctgcgacagtagaatcaataccacaagcacaatcttaaggaaaaagaaagaggcgtatgcgccctaggaagaagaaaatcaggagcatgcagtctttcatgcgtgatatttcagcacagcctggaccttcatcatcagatacagaagatggcgatgatgatgctacaatgcgatcctccgattctgtctcatactgcctctaactgatcaatagaatgcactattctgaatttctgataagtctactgaacttgatgttttgtagttttgttaagtaatggactgttagtcatgttcctatgatgaactgatgatcgatgaactattaagtgtttatgtggacttgtcaagaacttcctatgatgaactgatgattgatgaactttttatgtcaaaaactcatgtgtcatgcactcatgttcatctatgaactatgaagtatatgtatttataatgtcccctgtgatgaaatgtgatgtcaataaaattcagtacaattatcatgtgatgaactatttgctatgatgacctatttatcctgtgaagtcgtgactcatgtcaaattttcgcaaaacagctaaatggcttagctgcagctatagcctgctatagcttatcttagttattgaaagcccaagcagctaaaggccttagctagttatttatattattgataaatcggctataaatgggaacaccttcaaataattttggaattttattgaaaaagattactactcctcttttcaggctataagatgttttgactttggtcaaaatcaaactactttaagtttgaccaagtttataggaaaaagtagtaacattttcaacccaagacaattttattatgaaaatatattcaattattgatttgatgaaactaatttagtattataaatattactatatttgtatataaacttagtaaaacttaaaacagtttgactttgaccaaagtcaaaacgtcttctaacctgaaacagacggagtaatgaattaaccaccacctttaattctaattaaattaactgaacaaataaaactacatacatacttataataatatagtaaagtactcaagtatacccgcgtcgttgcacgtgttagccgtgacttgtggtctggtgcaccaacacaacaatataaaagttgctcaagattccactttccttttcttagaaacacggtataaaacacatacatacccactcctaagcaaacattcaattttcagcgagatattttctcaaaattacacttttgcttgggagaagaatgtttcccaaggacatttgatttacataaactggacaaaagttttatttatattatactacctccgtaccaaaacatataaacttttgtctatattcatagctaaaaatgtttatattttaagacggaaggaatagttggttttctagccaagcaaagttaaatgatatagggagtcaagtgacccaaataatccaataaaattattttcaaatatttatcattcattgaaagataaaaaaaatcctaacggcaaaccaaattttgcaaaagggtttttctatttttcaaaaataatccgaaaatctaatattttaaaattcaattccagtaactcttattctagcacataactgagtccagtgatgctacaatctccaattcaaagtccaatagtgcacacaacagtgccaaacatgcttaaatcttactctctttgctttctaatatttgatatgttgaccttttttagatgttcgaccattcaccttatttttaaaattacataaatatcatttattttatagtgatttgtttaatcattaaatacgtgttaagcatgtcttacatttttgcactaaattttaaataagacaaatgatatgttgaaaaatcaacggcctaacattagaaacaggagggagctcaattttattgagccttttgatttctatatatcaacccatagacgtcctctgttgccggttgccacacgatttcaaaaaagctcaccatatttgtaaactccggttagcgacatgaaaagtgctcctgttagcatctagcatcagaatacattgacaacagatatatccattgataagactctaagagctaggttaacatgtgataaggtaaaaggggagaaatttctagcctgcatatccacagctcccttgattgagtatcatactaaatcagtctgtcattcaataataccgccacatgctatatcagtgtatacatctcgagtaatcgtagtgtttcacaaacaagcctgatactccatcgactagcttctctatgtacaactctctgccttctcaagaaggaaaacaagcagctggttgcccaagaacagcctcatctagaatctgaacagtagcaagttccgaagtatttctcccataatacgaaggcaacatcaacaaggacaggatgtctgtcttacatgccgtgtgttgtcacttttgctgtcaacacaacttggggtgaagccttttggcactccgttaattctctgcatgcatttccatagcgtccattgctttcataactgtagacgaaagtgacgtcaaatgtttgaagagatctcgctttggacagtaaaagcttcataaagcacatttgatttgagttgtacttcatattaatcagggtcacatatttgaggcttgcaagcaagtcgctgcttatctcagaattcagggagtcttcatcaatctcatcttgagaattcagggagtcttcatcaaactcatcttcagaattcagggagtcttcatccatctcatcttcagaactcacggggtccaatatggaatgatcagtctacaaaacaaggccgaaatttcaattaatacaattgaccaagagatgcctttaaactgtaacatatcacttgaaggtgtgaatctaatattaccctaatataaaggtgttcaatgtgcggggcaaacttcagtaaagaaactaacgatagaacacttgagcgctggccaaaatctatgatcaggccgccctccctcagattctcaaacttgcatgtaattccctccagcatattaatgttgaactgaaaatcataagaacatagttaggcctgacatatgtccatgattcaagtttacatagacctactaacctaagcaaatattcaaatattaggacaccatgatcttgtagttagaaaggttcttgaagcttccttttgagaaaagataagagccatattgttaggaaagttagcgtttgtatcagagtacatctctttgaggccgaaacatgacaggttcgcatcatctgcctttgaggccaaaggcagagtttgccattgctttaatccacacccttcatccttcgatcaaccattacatggtttaggcccattccgtgagtaaactactatatagctatttaattgactaaacatgacataccatcggtacaagctcctagtctcacattgaacaattcagtcaaattgtaattaagtttctcacaaggaccaattcagtaaaaaaaaactactatcgatcgaaacacaagtttgatcattccaacagctttaatctgaggaatcaagggaaactagaagcagtaaaagaattatcctccaacaactatcacaaccaaattttaggagagagatcaccctgagtcagatcatgatgaatatctctcttaacaagttctggaaataatcagttcaggttaatgactcttgagttacaatagcagttgcagtcttagtgattgaaactcagcaaaaatgcagaagatgacacatatatagcagacataaatggatcagcagtactcccaatcaaatctgcaaattatttgtccaaatgagctaactaaaattcataaatgtggatgaacatgctacatgggattcacaagcagacaatgaggcaagcaagataggcatgtaatgaaaattgggatccaacgaggtattcaaatggtttgacgtcgtaccttatcactcttgaaaaagagcttattgacagtagaaatattctggaaagcatcgaggaagtcttgggttccgaagaggcgatcgaatgagatggtcacctcctccagcatggggagcggcattggtattcggcagccgttgtcgtcacccatctccatggtgatgtagagcttccggagtttgggcgctctgatggcccacgtgtccacgccgccgccgttgatggtgatcacgggtgacaaatttagcacggcgagtttctccgccgcgacgatgaggtgttcgagctgcgtgccggcaccggcgaacgggagggtgacatacacgaggtcgaggcgctcaaggttggggaagcccagaaagcccggcggcgccgccggcatgtcgcattgctcgaggtcgagttggacgagtgcggcgcaggagaagagggcgggtccgggaagggggcgctgcttaccggctaacgagaactccaggctgagatcctggacgcccttccgcgccatggcgcggagccagcgggcggctcggaagacgtcgcggcgggcgacgcgggcgcggaagccgcggacgggccgcgcgcaccgccacagggcgcggccgccgccggagtaggcacggggcagctcgatctcgaggttcttgatcgactcccagcggcggcgctacgcgcgggagaggcaggaggtgcggaccagcttgtggaaggggagcagcacgaggatgcggtcgtcgaggatgtccgacgggagcgccatcagcatgtccgtcctgggcggcggcggcgcggtggcgcctgggccggcagtcgctggcgcttgggggaggacggggaggaggaggagcccgaggtcgccattgttttggaggtggaggtggaggtggaggtggcttgctgacgacgctatgatccaacggccttcttctggaaccttctgcaagatatttatagggttgtttggaaagcgaaggagccataccacgccgcctcggcctcgtggggtgcgggtgagcggcggctgcgacgccgtcagtatttctccaccgcgaccggcgtcagctaacgagttggggggtgaaagctgtgcctgtgctgtgttttgttatgtttcttggttcctaatttctgaggatggatagacatagcgactttggaagggaaagacacttttattttttatttcagctgtttttcaacacccaaattttatatggtttttttaatcgaaattgcgatatggcattcgacagaaatttgggatgaaatcttacaaatttattatcacatcggatatacggacacacataaataacaaaataaattacagaattcgctgggaaactgtgagacgaatttattaagtttaattaatccgtcattagcaaatgtttactgtagcaccacattgttaaatcatggcacaattaggcttaaaatattcgtctcgcaatttacacgcaatctatgtaatttttttttcctatatttaatactctatacatatatccaaacatttgatatgataacgtgaaaatttttgtgttgggaactaaacagggcctaagtgttggccgtgtgcttgtcagcagaagccacgaaaaaaagctctgcagcttgcagctagctgtgtttaactgttggtttcagtatcagtattctgagttgactgctaatgcaaatgtttaacattactcctgctgccggtttctagctcatctggaaactaagaaatgggatagtatgcaggagttttgccattttggattatactgtttcagaatcaagccacatcaagtataaattatcgaggcttgactgctgatgcaaatgattttacagggttcgtgcagaggtttgggcttctctgaaaaccggggaatgacaaatatgcaggcgttttggaggtcgatggttcagaatcaaagactgaacaatatggatgcttatgttggtctgctgatgcaaaatttgaagagcctgcttggcactgacagactgaagatacaacaaagcttccagtcttccaggaatcaaggttgtatcaattgaactaaggcagaaaggttgataaattttatgcaatgtgaaatcctgctgctgtgattaacatcatgatacaaggtaaatccactatgtctgatgcaatttacatccaagaccaacagaaactctgttactcctgttcatatcagagcaatatcgaacaaagaacagagcaaagttcataccaagattcacaacgttctcagatttctattgcatttgatatagacatatagttacagcc

SEQ ID NO: 50993 - DNA, 1841 bp, Oryza sativa
cgccgatgaggagaaagaatccgcggcggcggagcaggacgcgcaggaggacgccgccatcgccatcgccatcagagcacgagatcgcgggggagaagaagaagaagaagcggatcggaggcggtagatcgagcgaggcgcggcggggtgggaaatgggagaggggatcgagaggggcgcggccttttatgtagggcgaggcggtgcgatgcgaccagatcgaaaccaaaaatcgggagtcggagtgcaatgacggtaacttggcgcgccgggaagttctcgcgtggggagtggggacaacgcgaagatttgggacattagtaggaggaaaaagtacaccaaacatccctcaatttatcaaaatcgtatctgggcatctcttaactaatcaaaaccgatcataataggttttttggtggttttgacatgggttttgtccgacgtggcggctgagttagcataggatccacgtagacccaacatatcaggatgccacgtcatctctcttccttcctctctctttcagtcttctctgccgtaggccgatcaacggggcgaggcgggagaggaggagggtggcgccgcgaaagcaggcagcagcggctgtagcggggaagcacggcggcagccccgcggcggccaaagatgggcaacgccgtggcgaggctggaaacgcaaatatttccgcggatttttgccacggcggtgcgcggccgcaaccacgacccatataagctaagccgcccatgccgttgtctctgccgtgtctggttctccgctacctcccaataaactaagctctggcgcattgctagctcccgcctcgcgcgatgtctctgaggaagaggagctcgagctcgctggccggccatttctttatccgcggacgcttctgcattcgtgcgagtgggcgggatggggctcgtcggtggcctcctgtcacaccctgaaagttcttttcccaagcctaaattagatttataaatcaactaaaaaaatatcggtgtaaaagcatgagagaaatcctaataaattaatacaaataataatcggaattggcatatggaatttttcgtgagttctacatgtcgaaatatgctaacaagatttttagtggaattttcagagctctagaaataattttaaccaattaaaattgagcacaagcaatatttaatccctgaaaattcatttcccttttctttttcctttttccctcctttttcctaattggccgccagcccattttcctcccctccccactgggccagccgaaggccacggctgtcacgcccagaagtttcccctttttcttgctttaaaaattggataaataaattgcccgaagaaattatcttaattaacctagagctaaatccctagttaataaatgcaattaataatcggaaatagcgtggtggaatttttcttgagttccccatgctctaatgcattaacaagatttttagtggaattatcagagccttggaaataattttaaccaattaaaaatcaccaaagtgcaattttaaatcccaggaaaaatcctttcttctttttctttttcttttccttcctttttctctagatgggccgtcggcccatctctcttcccgcgctcggcctccttcctctgggccggcccgttcccctttcccctccccgaagtcctccctccctcccctctctccgggacgctgacaggtggggcccacctgtcaggtcttccccttcctccagccgcccgccccacgacggcaaccgccgccgaaaccgtccgcgccgccgccttcttcgctcctcccgcgcccacgccgcgccgctcccgcgtcctccccacg

SEQ ID NO: 50994 - DNA, 12587 bp, Oryza sativa
tggctgctccctgcaccgtccgatcggcttgggccgatccagacccttggtcccgtggaccggccgccttgagccgctgacatgcgggccccgcttgccggcacccccttcctctcccctttgagccgctgacccgtgggccccgcctgtcggcgccgccccccccccttcgctgacgtcagtcctgggtattattgcgcaataattaattaaggactttttctttattagtaaaaacacagtttatcttctaaaattcataagtaattcatccgagctccgtttaagtccatccaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagaggaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacgtagactctgactattggcatagcttaagattggtgccaccgcaagggtgtcagttaattaaaatattctgaatggcgggctgtgagtgcatggttttgctggtcgcacccatggcagttaaggaccggttcacgggaaaccctgggagacttaccgtgctcaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcatgtcttgtgggtacagttgtacacctctggccagagtaaaactattcgaatagccgtgcccgcggttatgggcgatcaaccagattcaccgtgattagtctcatccctagtttagcttaatgaactagtgtagttcaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatatctcctcttccgatatgacttgctaagtacagtgggtagtactcagtcttgctctcttttcccccaccccagagttgaagttcttctcagttggagccgtctcagagaggttggtgtcgttgctgccgtcaaggtttgcctgtggagtgtagtcgcccgctgctgaagtcaagcttcccggtttagctcgctttaatctttcccgctgcatttgtaatcttttatttttttttgtaagacgtgggtcggtatgtcaacaattgtcgtttgtgtaccctggctggtcctggacagggatttaatgcacattcagcttagaaattctggttcgagaatttctgggcgggacaacggcccagccggccgcccgagccccccctcctctctcccgaggtcgccgacaggtggggcccacctgtcgggtcctcccccaacctccagccgttgccgcgcgtcccgcaaccgccgccgccccctcgctcccgtgccttccgggccacgttgcccacgtcgtcgcccacgtcgccacctgcgcccgccttccctgcgcccactccctctcttccccggccgcgcccgcgccgaaacggccgggaattcaattttaatcccgccggccatgccctctcaccccctccccactactccgacgaaatcgggccgctcccgggcacgggcgagccccctctcccctatttaagcatccccgctctcccctctctctttttctccatttcgccgagctctctcgtgccttctatcgccctagcgccttcgccctcctctccgccgctgccaccgccgccgctccggtagccgctagccaccgcgccgagccgcgccgacaccgccatcgggttcgcaagcccgagggccacgccgtccgcctttccgccgccgctttcagccgcgggaaccccgttcacaccgcgcgccggtgagctccgccctggccaccacctttggccggcgtcctcgccctcttccatcttcctctctctctaacccctttcttcgtgttcgctaggtgattccggagctcgtcccgctaccgtcgtcgcgctccgtcgctcgccgtcgtcaatcgccgtcggtgagccacctcctccccttcctccctctctcccgcgccgcttagcagccactgtcgccgtccgcgccaccgctgccctccgccgccggccggtcgccgccggtcgctgccttgcgccgccgctgcgttgagccgcgccgccgtgcgccatggctgccgggccggcttgagccgcccgtgcgcgccggccacgcgctcctgccgccgtccgatctacccgcctgatctacccgagggtagatcgaggccgtccaaccccgccgcccgcgtggctgccacgtggccgccacgtatgcaccacgtggtgcgccgctccttccccagtccgtggacccgttccaccgcagacccccccccccccgagtcactgccatgtggggcccgcatgtcggcgccgccctatctctccccgggattttaattattgcgcaataaatcaattaaggatttttctgtttatagtaaaaacacaatgaatcttctaaaattcatatctaattcatccgagctccgtttgagcccattcaagtctcagtaaatcaagaaaaatgcatagaatccattaaaaatggttttgttatctgtttcagtagtcttatagcctgtttgtattgttttctttatatgtcacttagattccggctctcccaacgctctggtgtactttgaaatagtcgccgaggttcctccagcagcagagcaaggcaagtcatgcttgtcacttgaacatgttgatcctatattacaaatgctctaccgttttcccttaaatactgcattgctttataatgatactatgggatgtttacctactgttacagccatgctacttttgtaccatgctcctttgttagcctaggatataacatgactagagattggactagggattgcttggccatgcttagttcaactagcgcaccatgggggaaatcacattaatgcatagacttcaggttctagtgttggtgttggattaaagccaccgttctggtgttagtcaattaaaatataccatatggtgggatatgggtgcatggttgtgatggtcgcgcccatggcacttaaggaccggttcgcgggaaaccctggaagaattcctcgtacttaccacaagccagcgtgggcaacggctgggcttgtagtgtagttttcctctagttgacgcatccaggcaagggtgggcgtgatgaagtggggcgggccctttgacggcctctgtcgcttccggattcacctaggcacgagaggggactgcccgttgcccgctggggacgggggtgaaacctgaggtgtggtgtgcttggctagaggtggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtacccgcggttatgggcggtcaaccagattcactgtgattagtctcaccctagtctagtctaatggaattgattagttcaggtggatggttgggcctgttacaacgtggtgtagcgctggacagtggatggttaatattgagtaattattacaactgttttactgctttcaactaccgtctttaaatgctcgctttatgcaaatgaaccgctctagctattctttgattataccctacatcataccctctattccggtatgacttgctgagtacggtagttgtactcagtcttactctattttccccaaaacccccagagtttgagtacgtgtcagatggtgggttctccgaggagtaggcttcgtccgtgccatcgaggattcctgtggagtggtgttcccactgcagtccaagtcaaggcttagctccagttatcttttaattttccgctgcatttatgtaagacttttatgatgtttgtaagacgtggatctgtatgtcaactttgtcgtttgtgtaccctggccggtcctggacgggggttttaatgcacattctgcttggaattctattcgggaatttctgggcgtgaaacctcctcggcttcgtcgtcggccttcccctcgatatcatcgtcgcctacctcgtctacctccgcttcttcgcccctcaccgtcgtctccagatcagtccatcgatcgcctcctttattctcgatccttcccgtgatgtacttaatcctaaccaactaatcaagtcctccatttttttaacgaatcaatgaggcccccaatttcattggatagaggagacgaaaactgtaagaaaggataatgtacgaaaaaaaaacaaaaaccaattataggtagttacgttgtcaactaagtggtgagattttctgtgcccaccaaccccatgtttttgcttcctcctttatcttggctagcagagttggcgccggcaactctttatgctggaaagtcctccagttcctttcgttccatatctcccaattaacaagcaaggttaacgtgcgtagtgccttcttaggtgtttcccgtatgcttacggtggcctcccaccactcatgtaccgtcaaagatatttgccagctagaaggtcttagatggtcattgcctgtccattgcacgatttcattctggattcttcttgtgtatctacattccgctagcaggtggagagctgtctcttgagtctggcgacataaaaggcatgtggatccgttgggccagcctctggttgctagtctgtctaatgtccacactatgttttggagtttcagccaggcaaaggtcttgcacttgcgcggtgcccaaggcctccatatcaatgtgtcaaaattcgacgatgttgttgtacctaggagctgcgccttataggctgaggtggccgtgtattcgccatggttgttgagcttccaggtgatctggtcttcatgttccatgaagtgtacattccgaacggcactccaaacggtgatgagctggtcaatcagatccattgtccatccttcgtttgttggtagagcaaggtcgtgcagccattgatctgctaaagcggcatgtttgagggtcctgctctttttcctagaggtcgcgtggactagtggtgcgacatccttcaatcttctcccttgaagccaagccaactcctagaacttcactttcgctccatctccaatttgtattgttgttgccactgcaaacagtagcttgtcagtttcattacaaggtgtttctgaccccaccaaagccttttccggcgacttctattcgtgcaagagccatcgcaatcaaatagcccttgcgaacttttcaagattcaggataccaagacctcccgaggcagtagggaggcaagtccgaaatggtgatttgtgtgcagccgtgcgcggtctctttgtgctctacgacagcgcccacatcaccgtctcgctccgccgccacagcgtcgacgtcggcaagcaagcaccacgccgtgcgctcgatctgcccgtaatcatcacagacacctcataaagaatattagccataaatgtgagctagcacccgtgtcatatcgtctaccaccaaaagaatattagccataatgtgagcacccgtgtaaagtataggacttgaacttgggtgggttgattccaccacaagtattctaatcagttgagctacactcacatcgcaaatagctacacttacataatcaaaggaaaagaagagaaccatttcagcggggtacattcacatttcgtagcttcctttcgtgggaagtaaaacgcaatagtaaaacacaacatagggcctatttagttggtgaaatgaaaatttcttgtgtcacatcggacgtttgaccagatgtcggaaggggttttcgaacacgaatgaaaaaaactaatttcataactcgcttggaaactgcgagacgaatcttttaagcctaattaagctgtcattagcacatgtaggttactgtagcacttatagctaattatggactaattagactcaaaagatttgtagactgtgcaattagtttctcgttttatctatatttaatactttatatatgtgtttaaagattcgatgtgatatttttgtgaaaagtttttggtaactaaacatggctagctcgattttatcctccaactcgttggctgaccctataaaatatcttggggaaggttcaagaagaaggccgttggatcatagcgtcgtcagcaagccacctccacctccacctccacctccaaaacaatggcgacctcgggctcctcctcctccccgtcctcccccaagcgccagcgactgccggcccaggcgccaccgccgccgccgccgcccaggacggacatgctgatggcgctcccgtcggacatcctcgacgaccgcatcctcgtgctgctccccttccacaagctggtccgcacctcctgcctctcccgcgcgtagcgccgccgctgggagtcgatcaagaacctcgagatcgagctgccccgtgcctactccggcggcggccgcgccctgtggcggtgcgcgcggcccgtccgcggcttccgcgcccgcgtcgcccgccgcgacgtcttccgagccgcccgctggctccgcgccatggcgcggaagggcgtccaggatctcagcctggagttctcgttaggccgtaagccgtgccgccttcccggacccgccctcttctcctgcgccgcactcgtccgcctcgacctcgagcaatgcgacatgccggcggcgccgccgggctttccgggcttccccaacctcgagcgcctcgacctcgtgtatgtcaccctcccgttcgccggtgccggcacgcagctcgaacacctcatcgtcgcggcggagaaactcgccgtgctcaagttgtcactcgtgatcaccaccaccggcggcggcgtggacacgtgggccatcagagcgcccaaactccgggaactcttcatcaccatggcgatgggtgacgacaacggctgccgaataccaatgccgctccccatgctggaggaggcgaccatctcattcgatcgcctcttcggaacccaagacttcctcgatgctttccagaatatttctactgtcaataagctctgtttcatcagtgataagttacgacgtcaaaccatttgaatacctcgttggatcccaattttcattacacgcctatctttgcttgcctcattgtctgcttgtgaatcccatgtacatgttcatccacatttatgaattttagttacctcatttacacaggtaatttgcagacttgattgggggcactgctgatctcatttatgtcttgtatatatgtagtatgttctgcatttccactgagtttcactcactaacacagtaacactgcaactgctatcaggggcggatccaacgtgggtgcaggggggactcgtgtgccccctacacccacaagactcatgaataccccctggagcaccccttcaattttttcaccatgaatgataaactaaagatctctagattgctgtaggttgaagaaattgtgtaattgagcccccctaattttttgttcttggatccgcacctgactgctatagtagctcacgagtcatttccctgaactgactattttcagactggcgtgaagtaccttgcgtcatggccttgatgatgatgaatactccttctcagaacaaaaggtgtattcatcatcattttctgagaaggactgatctctctcctaaattttggttgtgatagttgtcggaggacaattcttttactgcttctagttcaccttgattgctcagagtaaggctgttgggatgatctaacttgtttttggatagaaagtagtattttgacaacttaattacagtttgactgaattggtcaatgtgaaactcggagattgtagagatggtatgtcgtgttttggcaaatgtgaattgaagacatgtactcctatacaaatcccaacattgctgacaatatggctcttaggttctgaaaatgaagcttcaagaacctttctaactacaggatcatggtgtaatatttgaatgtttgcttagattagtaggtcgatgcaaacttgcaccatggacatatgtcaggcctaactatgttcttatgattttcagttcaacattaatatgctggagggaattacttgcaagtttgagaacataagggaagcccgcctgaccatagattttggccaacgctcaaatgttctatcgttagcttctttactgaagtttgctccgcacattgaacacctttgcatttcggtaatattagattcacaccttcaactgatatgttacaatttaaagacatctcttggtcaagtgagttaattaaaattttacccttgttttgtagattgcttattcagaatgggatgaagatgagattgatgaagaccctctgaattccgaagatgagattgacgaagaccccctgaattcagaagatgagattgatgaagactccctgagttctgaagatgagatttatgaatacttcctgaattctgagataagcagctacttgtttgcaagcctcaaatatgtttccctgactgaagtcaaggtgaaggacaactcaaatcaaatgtgctttatgaagcatttactatccaaagcaagatctcttcaaacatttgatgtcactttcgtctgtgacgatgaaagcaacgaatggtatggaaatgcatggggagaattaatggagtgccaaaaggcttcactcccaagttgtgttgacatcaaaactgataatagactactgataagtcagacacatcctgctgttgatgctgccttcgtattatggaagaaatacttcggaacttgctatactgtctagattctagatgaggctgttcttgtgcaaccagctgcttgttttccttctcgagaaggcagagagttgtacataaagaagctagtcgatggagtatcagactttgtttgtgggacactacgattttctagatgtttacactgatatagcatgtggtggtatttttgaatggcaggctgatttggtacgatactcgatcaagggagttgtggatatgcaggctacaaatttctctctttttaccttgtcatgttaacctagctatagagtcttattaatggatatatctgttgtcaatgttctagagtataaaagatgctgcgatgctagatgctaacaggagcactactggaaaaagtgtttttccaggcgggccaatcaccatttcgcaggcgggcaagcggcctgcaacttaacgactgtaaaaatatttgattttcgcagacgtgtaactgatccgcctgcaaaaatagcttccaacgctaaaaaaatatgggcagctattgccgtttctggtggtagcttcccgttcctaatacagttcccacccattccctatccgttcctaatacagttcctacccattccccatctaatccagtgaatccaaatccaacagagaagcaacagagaagtcaccagttcatccaaaattcagtttcacatgcaccagccatatttcagtttcacaagaatcaattcaagcaaagaaagaaaacaaaatcacatgtaaaatcattcctaaaatcactttatacatatagctcatccatcttcatcagcaaaaactctcacatcaacgggagggagggaggggccgggagccatcgtccgccaccgtcgcctcacggccgcgccccgccgtcgtccgccccatcgccgccaggagggagagaggggctggggccttcgcccgctgccgcgccctgccgtcatccgccgctgccgccgccgcacctcaaccctcctcgccgccgccgccgccatgtctgacgatagagggaggggagctccgccggctaccgccctctcccgcccccctccggccagatttgggagggaggggccggcccgccggccactgctctccccccgccctcctccggccagatctgggagggaggggccgggagccgcgccgcctcaaccctccttgccgctgccgccctccaccgccaccgcccgcagccgctgccactgggagcacacgccgccaccgccggtagccgccgccgcctccggccggcggccggggagagcaggagaggtgaggggaggggagaggccggtgagaggagaggtgtggaggggaggccgggaggagaagtgttgagggagatagagaaatgagtgatggggagagggtgggaggaggagataaggagtaaagattttttttttttgctaggtacgatttttgtaggctgaccacataagattcgtctcgcaggcggagagcgaacttcaccctgatttatatttttgtagatggttatttggttctaagggtcatgtccacctgcgaaaaaagacccctacgccgggaaaaatactttttctagtagtatatactaacaggagcatttttcatgttgtcaccgtccgtagtttacaaatatggtgagcttttttgagatcgtgtggcaacaggaaacgtctatgggttgagatatatatatgctcaaggttcatacttctatgtagatatcaaaagccacaataaaatatgctccctcctgattctaacgtttgacgccattgatttttcttattcaaaatttaaagcaaaaatataagtcatgctcataatatatttaatgattaaacaagtcactataaaataaaaggtaattgtgtaatttttaaataaggtgaatggtcaaacacctgaaaaaaatcaacatatcaaatattaaaaaaaaatatgtctcgttgaaagttgaatatttgcttattgatgtagggtgtatgttaataggactgactgtgtacgcattttgtaaagagagagcagactcttgagctatttttgcattattgcgttggtgcgccgcaccacaggccgcggctaacatgcgtaacgacgcaagtatactttatgacgaggaattaggtcctaatcttacaataggtattggattggtcgattttggagactgatgttgataatccaaaggctccaaccagattgatcaaacctctcccaatcactacaccacttatccgttatcaaccaagccaaaacgcgattgacctccccaataaagctatctgttgcaaacaaattaagtacacaagcaaacgagtagaagatgcaatctaaatatattgtgaatacaagatgaatatctctaacaccttgaacatttttgatttaaaatatggaaacaaaaatttggaataataaaaaaatttgaaagtccatagtgctggtattctttggatttttttttcatgttatgccaatgccaaattgaatcaaataagaaattaaatttcaaattctaaatctatttatggaattcaaataatatttttttaaagagccagattataaattaataccatttaagaaagtattttgcaaataaaagcaaatattaattactttactaagagccatttctatgaattaatatcatttaaggaattattttacaaataaatgaacatattaatttaaacctttgtaaactaaaattatttgagaaaatcaatttcacgtttttaaagctaaagtctaactttgctccctagtgggcctagcctagcagttttcttaaggcaaatttagttacaggacatcacgacttcgtggttttagctgtagcataccacgtgaggtgacttttgggggaagacactctcaaatgtttgatatttgctggtggacaccgcactcattaaaattataatttttggttgaaaaggagagagaaatcgcgtgaaatatcaaaaatacccatgggcctactctcatatctctcttcttttctctctctatcttcctccgtccagtgtcgcactgcgaggcgaggcggggcacgatggctcgcggcgacgctgtgcggagtgtgttcggctacgactctcgtcgcacctccggcgcgggcgacgcaaagcctgtggaagcccgcgagggagaagcggtggatgtcgtggaggcgtgcgagtcgtggaggcgtgcgcgacgctggaaggaggaatatagaga

SEQ ID NO: 50995 - DNA, 14334 bp, Oryza sativa
ccgaagccctgacgctatcgctcgctactgtcgccgtaccagatggagcccattgccatcatatcgccagcgagctcgccgctagagtccgccccatccactgcacctcgacaccgtcagaaaatgccgagccgcgccctaaacgtagccgtatcgccgagccgtcactacccctagctccgcgcgccgtgcccctcccttgttctccccgcatgtcgtgccatatgacataggcctgcgcacaacagtgccgtgacgcgatggacgtacgaggctcggttgccaacgcatcacgcaccgcctcccatgtgttgcgcgctagacgacaaagagccgacgcagtggtcaatctcgttcaacacaccgcacccgccctcatctccgagtcgttctcgcacgggattcgtgcgaccagtggacaccgaccatcacgtcgcctgtcccaacctcccgtacccacgctcatagtggaaaaacccggaccggtagatgacccggtcacccctcctggttcaccgatctgacggtccgaatgtgaaccggccagttgaaccgcggttcattaagtacatgtaacataagtatttccatattgactcatacattcggctgatagaatggctatgggagttgccttccaaccaatcgaccaggggtaaaatcaagcctaagcttgcagatgttggcatttattacgatcacagataaaatccgcaagcgcacggatataccgatgtagcacttccaagggtatcgaatccaagggaacgtgtgtggtcagatcttcctccggttcatctaaggacaccaagcaaatgataggccaggatagagataattttctagtgagaaacagtgtctagggaaatcttaactgtaatcctaatgcaatactttaggcactagcaaccccctgttcccagatgtcgctctactacgtaccggacaggaaggacttaagtgatcttgagggctgtcaccacctctacacctacctcaaacgtactgtgggatacgcaacaattactggataacaattacctaaacaccacgtctaagcaattaatatctactttagtgtttataactcaccaaagcaatcactatattttagttaattatagtgaacaataatcccatatgctacttaggaactaaccaagagataattctcacaagataaatctaaattactcaggtagaatgttatattgaattcagagtaataaacagaataaaagaaacagaagaagattaccaacaactccggaattcttccgacttcttctactctactctcttcctattctagtaaacaatatagtacaatagagtgtcacgcccagaaattcactagtaatttccgaacttatttgtgcattaaatcctcgtccaggaatcagccgaggtacacaaactgacaatttaatatacagattcatcaatataatacgttacatacttacaaaagaaaagaaaactgcaacggaattacggtctagcgaagctccggctccactctcacaggcagctcaactgggctataagccaaacgccttctccttcgcaacttgtcttcaactgagatttgattgattattgcaaggtgagcatatgacatactcagcaagccatacagcaaatatgcaagtgcacaagaataccaaaggatggcataatatagggctcatttgcaaaagcagcatttagcaaacaatttgagaattctaaaacgatagagtaattaatcatcaatattaatcaatcatttaaaagcacactcatgctgcacaggcccaaccatcctgaacaaccgtacccggctgcacagatctatctccaaaccaggaatgtaccattccaaaccaggagctaaattaattaccatcaattaccacattattattaatgagtagtgtgggactaatcacgaaagacattgttcgacccgcccataaccgcgggcacggctattcgaatagttttactctggccagaggtgtaccactgtacccacaagacacaacccaccgtcatgtcaccatgtccgtgcagacacgtcaccatggcgagtgattgtgacaagacccctcgcataactcaactcaaagcagtgcaccgttcctggatcataatcacccccttataaaacaaggcatggattccccagcgatcaccgtgggcttatttccgccacttctcagtctggtgctccgcaatgagccttgttatacaaagtgtccagccgttgtccattctggcttgtggttggcatggttaatgtttcacaaccgaaactcgtgaaccggtccttaattgtcatgagcacgaccatcaaaaccatgtgctcacaacccacctttatcaagttttagttggcaaattaattaattaaccaatcacgattagccatcgtgagctatcattaaatatccatcattaagtaatagtaaaacattagttatcctaattgtgtgctaatgtttctaagcatggctaagcaattatatctaatatatctagttgaaccaatatataaatccaactagtcaaattataataacccaaggtatcaaggaatagagtaatcaatgcaaattggccatactaaggaataattcacaccacccggtgacattcgaaaataaatgcacagttgaaataaatagagaatttaaatataggatcaacatgctcaaaggaattgtgtttgggatctgtgtgacttgccttgcaatattcggtcttcaattaatcttcttgaacacttccggcgcactcgcgaaccttcgaaacgacggaaacgacaagctaacacgcaaaatgaggaaaaagactaaaataaaccagataaacaatacatataaagtaaacaaacatgcagatcataattttagatgaattatgagacttgaacggcctcattctgacttcatatgaattaattatgaatttttaaagattaaaccggattaaagcatttatatggattttaattgaattatgacgcaataaggaattatttttgaaaaggaaaagagatttattgcgtcatcaaagacgatccacggtaaaccgggttcacagagacggtctacgaaaccaacggccgagatctaatctaagccaaacggacagccgagatcgatccggtccaccacgggtctacggctgacgaagcgctgacgtcgacgatgacgtcatcaccggcggcggcttcggcaccccatgctcgacagcgaacggcggcgaggcggcgcaaacggagggcaccaacgcgtagagctcggctcggcgaacttaccagcggcttggacgacggcaaacgacgacggatgacgacggcggtgaggttgaagcggcggcggtcttcggggcggcggtgacggcggtgctctagcgggaaacggcggcaacggaggggtggacgaggtgctgctcctcctcacgatgctgaagaaggagacggcgatcgacggcgacgaccgaagcgacggcggcgcccgactggacacccgccggcggcgacgacgcaaagaaccacgcggaggcggcgctagagaaggcggcaagctagggcgaaggtggcagcggatagaggaggtcccggggatccttttataggggctaggaggcggcgacggaggcccacggcgaccggcggcgagacggaaggttttagggtttcgaaagagaaactaaccaaatcggcattgaatccgacgatttccaaacgaattagctcgggtttcctaaagagaaaaggaatgggagatcaaggagattatttcccctcaattgatttggccgcagaaggaaggaggcggccggatttggaaggagatcggcggcttgtggcgcggctaggagcggccggaggttgaagacgactgacaggtcggcaccgagagagagaggagggagggacggcggactgggccggctgggccggacgcaagcaggccgaggagagggagagagagagacttgggccgactttcggcccaaagccaaaagggagattttaaaacctttttctatttaaattattcatgaaatgatattccattgattaaaaatacttccttggctcaaataaatcccagaaatatctaggaactatagaaacaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagctcattaattgattaactaattactgaactgttctttgtatcatttaggaattgagctctgaaaaatccgagaaaatttcagagagtataattaatcatggagaatttattaaaatttaaatccattcatgctttaaatttaggaaattttatttcccacatttaacttcacttgtaaattaatgaacatttaatataaattctattaataatttattaaataatttataaatcctaaaatgaaaaaaatcaagctgtgacatagagcctcttataattcagctcaagcttggaagtgtgtgttgaattgagtgaagtgaggtctatttatagggcagttatgacggttgtgagaaggagaaaagtccgaactgccatgcaaccgtcattaggagagcatctggagcgtccatgccaaaccccaggatcaacggtgattaggggggtttggccgaacctgggttgggccctcctggcctggccttcggtcggtggactccctggaccctcctatgttcatttctcggagttttgggctgattcactggtattttgatgaagttcacaacacatccttgtagggatacacatttctcctcactttagtctgattttcctctcaacttagggtttatcatctgcatacaaatatataccaacacttgtggaatatgtgagattaagcacctataattatgttggatgttttattatccgaactttatgcggatgttggtggtatagaattggcatttaacaatcgccaacagcagacaagtatggcccaaataaatgggccgtcgtgcggcccattcattcactgacccagtccgaccgaaggcggtttattgtccggttcataacaaaactggccggttcaagcggtctgattgtctgaagcggttcaattgcatgtccggtctttctattcgaccgaaccgtgccaaactctggttccagttgaatcgccggtccggtccagttttttccactacgcccacgcgcgtcaaccacagtttcgcatagcatcgtggccctaccgctgccacatgcccgcacaccaccttgtagccttggccatgcctggtgcagtgcgacattgtgcgttcgcatgagagcggggctcatccacgtcgcaccacccaccatcctcactcccttgtacagttgtaccaccccacctcttcccttcgcctagaactagaagccatcaccactccccccctgcgctagggctataaaagccaccgcaagctcttttttgtcctccttttgcatcgatcaccttcaccatcatgccagtctacccagctactcatggcacccgatcgaacacttcgcacatgcttggagccgtgccacccaaacccgcgtaccactccgttttgcctagccatccttaattgccacttcgggttgcctctccatggcaacactaaagtcggagcaagcaagaaatagcatcacgtggatgaatcgctcacgcacgacgattacgatgattccgtagccgcatgggacaacggacgaactgcggccaatcaaacctcatcgttgttttgccgcgggagtgtggacgattcgcgagctcagtagtccccaaccgaaacttcttcagccatcattttccctccgtcgctgcccggtgtgccactcctcggctactgctcggtgagaatccggtcgcctttccttcccttcttcctcgctcgccgctttgcctggatgtcgcagcctacaacagtgttggcacgtccgaaattggcgtgccgctactctcgcgcacccacgccttggcacgcctgtgctatgcccgggtgtgtgccacccctaccaaccaactgccacctgtaaggtgcccccggccgagctcaggaacgtgttgacgaaaaatccgctctcggccgatgatgcttggtgcgaactaagtggatgaacacaacagcttaggagatccgcttagcgccagtacaggttcaaaatattgatgagatgcgagcgtgctagtcagtttgatcttgcacctaacaagatggataaatatgttgaacaccaaagagccgatcggctgacaatccgatggagtaatttcaaccgatgctggtactagccgatgtcgatagggttttgagcaatcggctatatgtccaatgcatataatgatacttgatgtaaataacaatataaagacaattggctaatgataatgtaataaaacaataatataatccaatagaaatcaatcgactaataatgatataaaggaaaaaacattaatctgaaggttgaagcatacatcggctagagatccaatgttgttaaatccaaacgattagataaacagtaaaacatttgttgcgatcggctaaatctaacttgtatgtaatccttataagccgatgcaacgtctagataactcatcggctaaaaccccgatgaaacctttattggcaatcaaaaagcagactagagatcatggttctaagcatgacttagtagatcaaacccaatttttttttgagacaaagaggctaaagcctccgatatattactttaaaaggctggatacaatgccagatttacaggatgtccccttgggaaaatataatttacataaaagtcatgtttttgcaaagaaggacaaaagctaggataagaaaagcaatcaagtccttcttcttccatagaccttcatagctgccctgtaggagttgatgtcgacggtgacaagcatgaccacagcgagttgcaactgatggagcctctgcacaatcccaaatggggcctcaaagagaaacacagcttcacctcataacaacaccgactggaattaagtcttctcaatcttgccagcgatggaggataaaacacaaacatctacaaaaggaaaccaagaagcatacccagactagcccaaaaattgggacaaagatggggcctccaatgaggggaggttgaagcttcatcggtttgtcttgtcgaacacagttgcttgacaaatttacatcgctggagaagaagcaggaggccgcccgcttctttgcttgcacgccggagatagccaaggtgaccggcgataccaggtcttgactgggtctggctgcaacccagttggcgacgataatgagaaacccagcagcatgctagtcgagaaccgatgaaaccaccggcaacgaccaccataacgctaggacgacgatggttggtgccggcaacctcctcgacaaccaaaagaaatactactacgagagaactcaatctataggatgaacctaactgtggatctacaaagaatagagggccttcgaccccctcccccttgtcactggcggcaaaccactggagacgaggagggagagggatctgagagggaaggaaagaggaagacttttttcgcccaggaggtcgcgagagctctcaagaggtttccacgttttttccccggtcaatcccaattgatgcagcactaagcatcaagcctttgactgattttcaggaagaatatttcagagtaataaacagaataaaagaaataagagaagattaccgacaactccagaattctttcgacttcttctactctactctcttcctattatagtatacaatatagtacaattgagcctcttataattcagctcaagcttgaaagtgtgtgttgaagtgagtgaagtgaagtctttatatagaggtaggtatgacggttggcgaaggggaaatatccgaactgccccgcaaccgccatcagggagtgatctggagcgtccatgccaaaacttggatccaacggtgctcaccagggttcggccgaaccagggggttcggccgaacttgggctaggcccccctggcctggcctggcctttggcctggctcctctcctggtcctcctatatccattctttggtgttttgggctgattctctggtatttctatgaagttcaccacccatccttgtatggatacacgtttctcctcactttagtctgattttcctcccaacttcaggatttatcatctacatacaaatatacaccaacacttgtggaatatgtgagattaagcacgtatcactatgttggatgttttattattgaactttatgcagatgttggtggtatagaatcgacatttaacagccgccaacactgatatcggcaaaaccctagaaaaagatctgaccgatacaagtaaattgaaaaatctacttagattaactaagatatatgataaataggtaggcaaaaatatcaactgaaccagagtgattcaagaggtcgaagcgatgcagccttgaacaacaccaatgtagccgataagattgccagggccgagggaacgtaggacttaccctgatgacgctctctctcatggcccgatcttctggtaaggggataactctcgctttgatcgagtgcgacatttgcggcgtggctaccaaccagaacaagtccaggacgccgtgcaatcgctacaccacaaacgatgtcgtaccaaccgtgacgtgcggttgatgacccctgcaatgcagacaagagaacactgcaagaacaatataagatgcaatctaaatattgcgaataggtgaataagcacaaggaatagttgcgattgaagtggtagatctaatcgacccggcaaatcaacacaccaactattgggggctctgaatctatagtcgatcatgactaattgagcgaggactagagacaaggtgaatagcacttggcaaaattcaactaaacaaaacccaattgttctagagggtgtacatagaaatttatagaggaatatatatataggattaagtgctaattcgtggaggtggagggagactgaagcatctaggcccccgttgttaattttggtaattaatgacaaacactaattgtggactaaccgttgtctttgagatatttatattgagttaggttcacatcatgagtgcgcatggatgattattgatggattaaaattgatggcgtgaagcgaagaaaagaagatggtaaaactagtgctttagttttaaattgatcgaggtgtagggcgatcaaatttgctagtttattcttagcttcgtcgtactattaagaggggtaatgacctagcaaagaaatgattttaattgccacattaggtcattgcatttagacttgtgctcacttttcaacacacacttgcattcactgtgttcggcctgactaggggcggtcagaccggccacatagtggtggtctgaccggcgtgccctggccggtctgactggccccaagcgagtggtctgaccggtgcacaaggccggtctgaccggcggcacttgggtggtctgaccggccccctggaggccgggatggtgtcctcggggttggccgatatagagccgacggagccgtattcggtcaaaccgagctaagggcggtctaaccgagccaaggccggtctgaccggacactcaatgtcggtctgaccggccaggccgatggggccctctgacagggctacaacgactagttttctagccgttgcagagtcgcatggtctgaccagaggagtacacaaaattgggggatttcacccccccaacggctagttttggttggtgggagtataaatactcccccactagcagcaagggggctctcttggcacccaattcaattgcatacaccccttgcacctctctcacacacatttgagcttagtgttcatccgttgtagtggttgagattgttctagccaagagtcaagtgcattgcttccattgtagagctagtgtggcacttgatcatctccgagccaggtcatcgcttgttactcttggagattgcctcctcctagacggtttgtgaaggagttgcccggtgacctctccgagaagattgtggaggaggcccggcgccagttgtgagtggtttggagttcaccaccttcgaagtgaaggaagaactaccctgagtgatcgaggcttgggtagtcctcttcgtgggccggctcccgtcttgcccaccccttgacgaagggggcgtgcggtggctttgtggttgagcggtggagttgggctcgcctcaacggggagtaggaaaccggcgagtttccaaacctcggtgaaaaatctcttgtctccttgtctcatttgattgtcgcatttacatttgtgcaatttacattcctagagacatacttgagatcatgtcaccctaggtttgctaaacaatgacataggagtgtgatttactttcctagagatataattgagcctctatcaccctaggtttgcaaaacataacttagttgcttagttagacttgaccctcaccgagcctagcaacttaggttagttttgattaggtgtcaattagtttttaaatcgcctattcaccccccgtctagtcgacatctcgatcctacaagtgatatcagagcttggtctctcttgtttgggcttcaccgcctagagagaagatgtcgaacgaggtgaaacatgtagggaagacacccatgctccatagcactaactactctacttggaaaattaaaatgtctactcacctcaaagctatgagcttccatatttggagttttgtggatgtaggctttgctatcactggcacgcccttgacagagattgatcaccgcaatctccaactcaatgctcaagccatgaatgctttgttcaactctttgagccaagaggagttcgatagagtgagcaaccttgagaccgcatatgagatttggaacaagttggcggagatccatgagggcacaagtgagtacaaggatgccaagcttcatttcctcaagatccaatatgagacattctccatgttgccttatgagagtgtgaatgacatgtatgggaggctcaatgtcatcgtggatgatctcaaggggcttggggcaacctacaccgatggagatggaggaagcctcaccatccaagaaggagatggaggaagcctcaccatccaagaagtgcattgctctccaagccgaagttgaagacaagggcaagagcaaggtgaatgaagtcaatgatgacttggaggaagagattgcccttcttgctagaaggttcaataatctcttaggaagaagaaaggagagaggaaggggctccaactccaataagagaagaaataaaagacccaacaagactctctctaacttgaggtgctttgagtgtggtgagaagggatactttgcttccaagtgcccttccaaggataatgatggagacaagtcatccaaaaagaagagtggaggttacaagctcatgaagaagctcaagaaggaagggaagaagattgaggccttcatcggggaatggaactcaaatgaggagagctccgcctcatccgggtccgaagaagaaggtggtgatgatgcaagctccaagaagaagaagatggccgttgtagccatcaaggaggctccatcactcttcgctccactttgtctcatggctaagggctcttctaaggtagcatctcttagtgatagtgagagtgacgatgattgtgatgatgtttcctatgatgagcttgtgagtatgtttgagaagctccatgcgtatagtgaaaaggagattgtcaagtttaaggccctagagaaggatcatgcttctttggaggtcttgtatgaggagctaaagacttctcatgagagactcaccatttcttatgagaagattaaggaagctcatgataacctcctttccactactcaacatggagctcacattgatgttggcatatcttgtgacttgcttgatgatagtgcttctagtcatattcctcatgttgcatcatctagcatttctacctcttgtgatgatcttatggatatgcctagctctagctatagctcttgtgtttctatttgtgatgcctcacttgttgttgagaacaatgagcttaaggagcaagtggccaagctcaacaagagtttggagaggtgcttcaagggtaagaacactcttgacaagattttcagtgagcaacggtgcatccttaacaataagggacttggatacattccaaagaagggtaagaaaccttctcaccgtgtcactcgttttgtcaagagcaacggtaagtattgctccaagtgtcatgaggttgggcatttggtgaatgattgccccggtagtaagccttccaagacatgcatgtttgattctcattatatgcttaagaaggctcatgatggtagtattgttgctagatatgtgggttcccctatacttggtggtaaaaagaatgccatttgggtgcccaaagctttggtctctaacctccaaggacccaaacaagtttgggtacctaaaagagcttgattttctcttgtaggtgaactaccgcatcggtgggagccattgggtgcttaatagtggatgcattcaacacatgaccggtgatagggctatgttcaccatatttgaagtaggaggaaaagaacaagagaaagtgacatttagagacaatagtaaaggaaaggtgattgggttaggttaaattgctatctccaatgatttgtcaattgaaaatgtctctcttgttgaatctctaaatttcaattcgcttttggttgctcaaatttgtgatattgccttgtcatgtgctttctttccgcaagaggttattctttctagtctccatgacaagtcttgtgtgttcaaaggttttagatatggaaatctttatttggttgatttcagttctagtaaagcaaatttgaaaacttgtttagttacaaaaacttcattgggttggttttggcataggaggctagcccatgttggcatgaatcaattgagcaaacattcaaaacgtgatctagttgtgggcttgaaagatgtggagtttgagaaggataaactttgtagtgctcgtcaagccgtcaagcaagttgcatgctctcatcctactaagtatatcatgtccacatctagaccattggagctcttgcatatggatttgtttggcccaacaacctataagaacattggtggtaatagtcattgtcttgtgattgttgatgattattctcgctatacttgggtgttctttttgcatgataagtctattgttgccgagcttttcaaaaagtttacaaaaagggcccaaaatgaatttagttgcactcttgtaaaaattagaagtgacaatgattccgagtttaaaaataccaatatcgaggactattttgatgatcttggaggaagagattgcccttcttgctagaaggttcaatgatctcttgggaagaagaaaggagagaggaaggggctccaactccaataagagaagaaataaaagacccaacaagactatctccaacttgaggtgctttgagtgtggtgagaagggacactttgcttccaagtgcccttccaaggatgatgatggagacaagtcatccaagaagaagagtggaggctacaagctcatgaagaaactcaagaaggaagggaagaagattgacactaaaccccaccctttgaggaatattgtttcatcgcacccatattccgttcctctccttctgtgcgttgtttcctccaccgttttccgctcctatcgccatgtccttccctgtttccacccccatcgccatttcatttccacagcaaacccttcaccgctggaaccacaccatgatgaaaccggatgtaaattagaaaatggttatctaatatagcttagtgaatgctacatgatataaataagtacttatatggcatagtacttgcatccttgtgtttaccatatgataggggtctcttcaccatgtaatcattatagaccatgcccattcaccatataatactagcatccataaatagattatgttacatttcaggtgcaacaatatgcaaaaacctgattaatggttaagtttgatgccatgccattactaatttcctatgaaccaaaaaccaaagaaaatgcacatttctcctaagagttactcctgtccaactgtgccgctgcaagcacctccatccagctagttcataactccactt

SEQ ID NO: 50996 - DNA, 7670 bp, Oryza sativa
aatttcccattgtgctgaagcaataccttctctattcgagttaaaccgccccatcaacttggttctaataagatccaacattgtaacaatgggcttatccctgtaatcaatgatgtagttattgaatacttcgcttatgttattgaccactaaatctgtcttgcatgttgtgtcaaatgcatgcctagcccaatgcttagtaggtattttggtaagccactcccatgcaccttccctctccttcttcagttcttctatcgcaatctcaaaattatgtttagtatatgcatatacagcagagtccatgtatgccttgagatctccacccctaaaactagcggtgcaaaagttttggtgtatatggcgcttgcaaaacctctgttcacatgcaggaaatacatctttaatcccaccaagaagaccctgcattgaagtgatacattaattaaataaatagaggaaaacttaaaaggccatgtagataatagaaatgaacattaccttttacctatctgacattattgtccattttccgtatgggccaacctctccaccaagagcatatttcagttgttgcaggaaccaacaccaaccttcgtaatcttcttttcctaccaccccaaatgctaaggggaaaagattatcattgccatcccttctagatgcggcaagtacttgagccccattagtaagcttgacaaaacatccgtctactcctacataattacacatggactgttcaataacaaaaaaaaaaggatgcaagtcgtataataacacccaaaatagtatagtctatgaagggcctgcaaccatacttgaagccttctatttgtgcattgagacatatgaagaggcccttgaatctaggattgttaccaagtgggtacggattataggtagacacaatgcatcgactacctgggttcttatctagtacagtctgcaagtaatccctgatccttaggtattgtttcttgtggttccctaacaccacctcatccgccttgctccttgccctataagccataatctttgatatgtcaactccatatttcctcataacagcatccatcatagaagtgattttccaattttgggtcacttctaatgtcctcttcatacactttacttaaccattcactactcaccctactactatccatagttgtaccacatgtgtaaggaccaaccatattcctgatggcaatagttttctcattggcaatttgtgaggccaacatgtaaaatgggcaagaatcattcacacagcatacttttactctatcactatcatttcaaagatacatgtggtctctacaattgacaatgtggtagctcttaagtgcccatctaaattgatgaacatctcgaaaacacattttctcacacaatgcatcagaagaaagaaacatgctctcatcataccaaattctttgtactgaaagctttttcttttattcggtgctcgacaaggtgttgcttcatgcccatcatcatcactggaacataagtccacaatatcaccctcattgtcttccttgcccttccttgtagatggtgctatatgctggctacattttgctctggatgaattgacaacaactagaggggaattaacaactagagggcttggttgactctcatgttgaactgcaacttcattgccattccttctagctattggtgcagatcctgtgtctagtagattaatagccaatggaaatatgtcctccacatcagtatctccctcgcgacgctcatctggatcttctttttgcctcttaatctcctttaacttctcctctaaatcattattttacagttatagaaaatcttcatcaaccgatgatggatttgagctatctgacatggcatcattttccaaaacacacaagtcatccacctcggcaattgcatcacccaagtttgtaaccaattcagtatttgggccatgcagattgcttgactgagatacaccttgtctctggatgatgtacaagtttgcaactttttcactctcaaattgcttacacatttcatccacttgccaatcactttctatagcaaccatgctagctacacccctcccatcttttttgctgtagtagataaaatcacattctgagtagccaatgtccacaatcagtccaaccaaattgaagtagcaaatgatatctatgtccatctttttttgcacatgcatcaggccattaacaacaccatcacggaataaattcaaggtccaaatatcatcctccatcctatcagatcaagaaaatcacctatgactaaagctgcaatttagtgacaaaaaaaatctgctgcaacactatcatatccaacaaagattatcataggttcaacaactagaggggaaatttcaaacccatcatcacaattaggattcatttagaaatccaaatttgcagtaaataagtgaggaaaaggcattcttacctgctgcaaagttcagaacgaggctaatttgctctctccacaggtctccttgatccttcgttgggtatagatcaaatcacgtagtatgttgttggccagggcagagaagtggcgggagatggcccaggttagcaccaatacttcgcgcctaatgacgatgtggagagggtaattcccactttatcgtcatcgcaaaaacaggaaacaaaatcacggaaacggcgaaccggagcagaaaacgacgcacagaaggaggtgaacggaatatgggtgcaatgaaacaatatgcctcaaagggtggggttttgtgataaaaattagttaaccaggttttgtgataggtatgcccccaaaacttggggttttgtgatatttactcttaaaggaaactaattgattctacctaattaatagatagaattaagccgtcatgtcatagtcttcacgatttcttcttgaactcggtatcttatggataagtttccgccaactaattgtgctctttccttcaccgaatccactaaaaaatcttaccaattttggtgttaacagaatggagccgagagaaggaatccccagcttgcttggatccatgctagcttctcatcgaaaaagaaaataaatgggagaggagagatggagagaaagacttgaaacttttgtaaaatcatctggttaaagtggaaaaatcaggccacctctagtctaaagtgctctatctgtttcatattataagttattttgatttttttctagtcaaacttctttaaatttgatcaagcctataaaaacattatagtacttttttaacacaaataaacatagtatcaaaaaaacattcaatgctaaatttaataaaactaatttggtatttagattgttgttgaatgacaacaacgttcgtcgaagaccatggttcactcttggtggaagagtaaaacaatgtgtattaatattgaatttttgggatcccccattacatgtcccttatggtctatttatagtctttaatacgaactcatacaccctatgactaatatataaaggggatttacataaatacccttataatagggatatttataagggtaaaagtaacaatttggccataggcttgttagtggaccgtgacatgggccttctttggcaaattggcctgtttaggccccgtgttctttaattgtgatggcgaaaacgcctagcttggtggcaaatgctttcagctttgccctgaggtagctgcttgtgcaccaattggcacttcgctctggcacttcgccttgggcattgacttgtttcgataggctcggtcgaaggttctcatggcatgcctctaacatagatattgctaaatttttctataagtttgatcaaacttaacaaagtttaattagaaaaaagttaaagtgacttataatgtaaaaggagggagtaaaacttgggtaaaaattcgtggtctatagtacaattactttaatttgacacgacgatgggtagcttaaatatcttgtttgtacaatgagaaaaactaggtttatgatattttgtacacagttactattttaccaaggactgtaaccttcctgctattaccattttaaagagatatatatgtaccgtgatatttttctaaaaagttcgaaccccacaaatgttcaaaattcaaaccgttcaaatttccattggattcatccccgcgaatggggaatggggacgccgttgctctgcggccgacggccccacctgccattctccccgctacgccagccgcctagcaaagcagccaccgcctcgcaagctcccacacaccacaaccaactcctcccctcccagaacggcaaaacccccagaaacgccaaaccctctcgccacgaaaccctagggagagccgcggcggcggcggccatggcgaccggcgacgacaagcccccctccctcgacgccgacatcgacatggccgacctcgccacgctcgacgcacccgcgtcctccgacgccgccgccgccgcccgcttccgccccagggccaagggcaagccgaagccgaagccgaagcccgagcccaaggcggaggattcgaagctcaaggcggatgattcgattcccatgtccaagcccgaggagcccaagcctgaggctgccgcgccgatggaggactcgatggaggtggatggggtgggtccgagcgccagcgccagcgcggaaggggtgggagctgaggaggtggaggatgaggaggactacgtgctgcgggagattgacgtctactttacgcccaagcccttcgacgaggacaccatggtaatggctgctcgcagactcccttccgtaattgtgctgtaggggtggcaaatttgctaagttgttacttgttagtagtagtaaggaattgagctaatttaaccagttccaacctattgacccttttcctcttcacatgtacatgtccttgtagccaataattcagattatttggcctggcctgcacaaactgttctgctcatttttttttgtttaaagtgttctctatgctttttttgtttggttaatggaaaataaaaacttctctagtaaagttgtgttttgcatatagaaaattgactgattaaattaacatatataaaacgttaatagctccactacataagggcttttttccatgtttcaatctgataaaaaattgaacaggaaaatattttgtttttccttctggttgaattgagatacactgcaagtttgttggagtcttttggcagatgctatttttatcatatttattgacactaaactttatcatataattcacagctttacgtaatgcaatatccactgaggccgtgttggcgcccatatgagctaaatgaaatatgtaaggaggtacatgcccaattaactgtcctcttttgatgatttatacctaatttggaatttatactgtactatttaattgtactccaatactttattaaagggattatgactgtcaggttcgtgtaaagccattgagttcaaaagttgaagtagacttggatatcaatacagagtgtgaaaattatgacccagaggttcctctgccttctagactaactgaacaggtgatcatttcctttttgttttcactgaattaatcacatcaaggttttcctttgctgtgtacagagcaaactcttatgtatggccagcatatttctacaatccgcatggtgttcttattagttttggaataactcgatttcatatttttgctgttaaatgtttacgttcatctctgaagtacatatttcatagtattgccatttgagtgatcttttgcagtatagttaatcttcctgtctatttcaaattttttggataaaaatttatcaatttctgatatcatcttgatctaattattattaatttatccattggcaaaaaaaaaaaaccattgttactgctgaacatctttagttacttaattggaattggaacaacatattttcctgcatcgtgttctaaacctctagttcattttagaatgtaacattagtaatcaaactagtttaagttaaatttcctgctcttttttttgcggggaaatttcctgctcttatgatgttcttatgaattagttaatagttcactttcgaggcaagaaattggtatcctctgtatttgcattagtataattggtatttcaccttttctttttgttattttcagacactatcatcatccaaagcagctgatgtggctgattatgcagttggagttcttagaggcaacttggtaagcaacatgagaatagattgtaaggttaacagttaatgttcactaattgcactgagtagcctatgcctctatggaggtctagcatgctacataaggtaaagcaatgaacaccattccaaaccataaacctgaacttggtggctttgatggttgactactctttttaatgtagtagtgtaattattggagtggtggttagtgctttggcttgtgtataagttgctacctcccaatccaaaagaaacaaaccattcataagcaagcccttgtattgtgattaccggttgcttgtcgcacattgatcaggcactctactcatgccagtaagaatatctatactccttacaaaagggaatagtggtggtggtgctgcctccctaccaccaactcccagccttttattttgtagagaaaaggacatgtgggctagagggcccacatgtcaatcactgacaccactttttacttttttgtggaaaggaaaaaaaggatagtgtggggccaaagggtccacatgtcagtaacaaatatatacatcaatcaagagatgataataacatgttaatgataataattctttaattaattaaaatcccgttgcaacgcatgggcaatatgctagtgttcaagtaaatattcagtgaaaacaagaaactgatgtatatgccagtgaaatatggtggtagttgtttgtcacactctataaccaaaacaactccaatccaaactagagataatgagtttggttttccttgaatgtgttcttgtccttggtatgtgataaatgtaattcagggcttgctccaataaatcttttttatctggtgaaaggcctttcgcgtgctacaagttggactttatcagagttatttaaagtgttgctgtattcattgaatagaaccaatatcttgccctgttttacaggttcatttgaatcatattgatgcagtgatgcaactgcgaccatcaatgttacatgtaaattctggtcgatcaaatgctaggcaggcacatggaggagcgagtagtgatgctagcggctcaactatgccatcagttaaggtgaaacatttagtctgatgtcagggctggtactattttattactcttttacaagaacaaaaagctagagaaacctcagaacaaccagtcagctaactaatgttcttgtaagttccatagtctcgacaaattttgttcacagtagcagccataaatatatatatcaacctgataagattaaacaaatgtatttgcatagaatccctcttgtatcccttttgatatgattgtttgagttatgtatggtcatgcatttcctattaattggagtaagcatgtaaaaacttctgaaggactgattgcctgttagtagccaaatgttttgttagctgagttgcacgatttgtttagtggtctactgattttaatgtctggtt

SEQ ID NO: 50997 - DNA, 6383 bp, Oryza sativa
gcttagtgtgcaactgagtgctctagtactaggtctttggatagaggaggaagtttttgtgcaaggctagagtagtaatggcgaggtgtataggttagaaattaccttcatttgttgtgtgctccacgaaaagtgagataggcgttaggtggtgacagccctgtccatccttcgtatctctccatgttcgggtacatcatagagcttaacggtggacttgtcctagcagaccatgggaggaccggtgcctgaagcatttgatagattcttacctttatcttaattaactaattaaaagacatatgaatcctctctagccactttatcttaggttgttgtcattggatagaatcttgatcatagataatacacacatgttccttgtgttcgatacccttcgaatacactaaggggaagtgttacaacagtgttccgtgctcttgtggatttatccgtgaacataagaaataccaacactagttaaagaacataaagaaactcaaacacttactttaataaaggaagcatccatcgaggtacaagcgagagaagaaggcaaacaatcccggctttctctagaactccgttagaagaatgccaacactccggcactccatcaaattcttggaggaactctgatattttggagcactccttctggagctttccctcactttctactaagccaacatactaaaaataaaactacaagtgtgttgtactatacttgagctgaaagttgtgtttgttgaagtatgtgaggtctcctcattttatagcttccaatgatggttagaatagcggttaacccctcacaactgtcattgggacttcatcagggctatccacgtgtaaggtggagatgaggtgggacaggatgggttcggccgacccctgggccccacatctctccaccaactttctccaatagcttacaggtgggcccctatggtggttaaggacggttggtcccacttttggtttcgactgacttttgggccctctgttgacggtcattatcgatcagtttcgactgtcaatattaccaaaatagagaactagtgatgcttgcaatgcataaatatgttagaataataatattccactagtattaggtctactaaccttttgcagagaataacaataaagtggaggagaatcgacatcaactcaaacgataaatcaattggacgatgtcgagaatcagacttatgcatgaatgggccaagaactcagaattgacacgatgaattgggcaaaaattcacaagtctacaaagtgaagcaaaagaggaggtcgtcagccgaagatgggctggtttgggccagcccatggttcggccaaaccagggggttcggccgaacccccatctccaccgttgaggccaaggttcggcatggacgtccaagattgcaccccaatgacggttggagggtacttcggacaatcccccttctacaaccgtcataaccacctctatataaaggcttcactctcttcacttcaacacacacctcaagcaagagctctctcatttctctcaagtttagtttagtagtatctagctggtggaataggaatagagtagaaatcaggagtccggaagtcttcggaagagttcgggtatggctctagtagctttcctttcctcttttgtaagctttgtacttttattagaatactcttctatatacatttatggtattgaaatactttccgagtatatgagtacctactttacattatgttcatattatactgaatatacggctagtttatctgggagatgatttggtgcgggtataatgtttgcttatgcaattaatctttgtcatgaagatgatattatagtagtatctggtagtttaggcgtggtgtctagatcacgggatatcattatttggggttatatgctgtggatgagaggtgggccgctgatggtgacagctcagtacgggtattcctccgcacatgtatatactaagttaattccctggggagggtattcctccgtatttagccccggttgtatggtcatgacgggctgtcgtaagaaactcggcagtcaggggtggtttctcgaagtaccaggagggcatcgaatagagggtattagctagtatatcggttaactagaatgtatgtatactatgatattagaagtataggaatagattttctttctcttttcttcccacttagcttagataatatattatgacaatgagtagctaatgcttgtgtgtcactctacccttggattattttaacccctgcttagaatatgattatcacaagtaatatataaactattagtcaagttctctctacatgatcttcccacggaataaaataaatacgacacccttggaatactctcgggtgaaatgctacaatggtatatccgtgcgcttgtggatgaactctgtaaccataatatatcagaagtatttctgcgccattactgggaattatatttctagtcatgacgttaagaaataccgacaccctccaatccttgtactagcgtatgattggttaggggttcattttcatcgcatggcgggtgtattttctccttaaatgacctgcatacatatatttgtcaaaactagtagaagtggttagtagtaaattcgtaccactaagttttgataatatgtttgaaatcttttacccaggagttgatggttaaagtttgcacttaacaaccgtcaacataccctaataatcttattgtactactagcttcgactttaaatttttagagctacacatacctagctctaaaatttataggaggtcgaaatctgccaaaattaaacctaaattaaggaaaatttggatactaaatgattgcattttagataccccacttttgatgcaaaattttgtcgtgacacacgaatgcctaggagattggcttagctccagtggaggtgctaaatcttgatgaggttcgggcgtgccagttaatttgatcctgcaactaactggatggaaatatatcaatgatcaaggagctgatcatcaacttaggggctgaacatcaacttagggagacgatcaacttatgaagctgattttgataaggttttgatgaattgactataggttccatttatgtaaattaaagtgtatatcggttaactaatcgatacatctgatagctgaagtccacaataatgataactcatcggccagaactcctatgaacaccgcataaaaaatatcggcttactagaattaaacttattagcaacaatgtaataaatcggacctaaccaagaaagtataagatcaaagataataaggacaacctatttggctaatagatctacacaaacatgatggacatatcgatcaatctaaagctacaatatgattaaagaaatagaaacttaggcagaatatcggacctaaccgagaaagtcctaactaagctgatatgattctaaacaacgatgcagttaaagatagaatcaatatatctgagaggcaacacttacttcaacttgaatagaatattagacctaactaagaaattcaagtcgggcccttaattaacttgtatagatggaatcaactagatcccgggtagttacaggcttacagaagatcaaatccattctgaaaagattagaggaatgttattcttaaagatattttttattgaaaatgttggaggactacatttcatttcattaaggagaaagaaagaaagaaagttgatatatatatatatatataaaatagtcccccgcaaaaaaaaagatttataagatcacttaggggtttttaccctccatttcttattcctattaggaataactcactacaacaaagctaacaactcttaaagaaccagatttgtacataaactattttaccccttgtgaatggatgatactccatattagaaagacattgtgtaaagtagagtttgtttgctaataaagcgaagataaaagaattgatgctatgattgttatgtttatggtacctcacgtcactacctttcatgtgtagttggcatttaattttgttataaaaatcatgtgtaaggtgcatatgatcacgataatagtagataaggtcaaccgttatacttttagaatggattaaccaaataatcaacaaatttggtacagtataatctaaagaaaaagcttaactttctttaaaaacatttcattgaaagtggtagcaacataaacttagttttctttttgggtggatgacacaatcaaatgtagctatagaagatagattttgaaaaaaatattgatatccccaccaaaaaatgttggataatttccatctttatttgcataagtattgctttgaataagttcaaaacaaaaataagggaatcaaaattaagcaagttccaacggtgcaatcaaacatgcatgtagcttatcactggtagtttaattattatgtcatcacacaataagttctcaacatacataaggctgaaaataactaaataagcaaatatttggatgtaactgcagcaagatcatgggagagcttggtagattcaatgctccatgcgcttcatcactttataattctttgcacccttgatacgaatgctctaaccccaggtggtgttgatggtatgagcttaatatcctcaagggatttgcagattggagccaacaacgtgagtaatttactaaccctttcatcacctaaccagaaatagattgtgatcttcttaaggtaatcagcggtaaattctttaaccagcgggggtgccgtgggtggctcttggaggcaatattcgcacacttcctgtaattgaaaatgggacgttaggttttctcactgtgcatgggaacaatagatcatagagcaaaagaggattgatgaatcgccatattgagcttcaaagtgagatcctctagcagtggtgagtaccaaaggaagtggagtaagggagagaattcgttggacatgcaccattcaccaagagtcaggcttattaagttgtcgaacattgggcttgtccaaatttccatttcaaatttatcctgtgtatatggggaaaaaaagaaacaatgtcaaatgagttaaagatataaagttaaagcagcatatggaaagttggtttggtacattgagacttcaaatgcccccataagcttcttagttcaacatagttgtcaacttctttttgtgtgaatgacctcttggaacaaacttagcctttatgttcctttgataagatagttttgggtgaatgacaagaaactagagtactcatgatgaaccaaacatattttttttagagaatacaatactatttatcttcttaacccctttcctatcttggtgatgtactttcatttagataagtttgtttgtttgtttaaatcccattgaatctcaatgttttaccaacaaagtgaagataagcatgcatgaaaagcatctatacctctcttaggggagcaatcaactcgatgcttcttgcctttgtaaggccactaactataccatggttgatctcttccccatcttgttcttccccctcgtccatgtccgctaaatcatcagtagaatgaaaaaactcatcaagtataactattgccacctccaggcatggcaatgtcatgatcataggagctctgtgttgagggttctttatgcacaaagacattaaacttgaactagatatgagaagatcttcaaatagacaacaattatcgatatctaggtgcaacaaagaaccagatgagatttcagggacctccaaagagcagtccctaagctccaaattttctagtgctgggcatgaagagttgatgggatagaagacattggcatcaatacaaacattgttaaggaccaaaaatttcaggcatatagaagtgaagtccacaaccccatagtccaacttgaaaggttcacaatctatatcttcagaaaactcaaccactttactgcttctcttaatagcatatgttatccaagagccagcatctcttgtatctgcagagtggaggcgcaaagcatccaacaaagaagagccacgttggcgcaacattcggttgacaaagttgcagaacttctggcctctatgccttccaaactgatttacatcaatgttcaggtatgctgatgaggtccaaagatgtctccatcgtgtggataacatgcctgtgtacacaagctccaaagctggtaaggtggacattatggcgtatagcaattcattaggaagattgctgattctgtcgatgctcccattcctcgtatttatcgagcttccttgatccaacatgtggcctgcatctgatacaaaagtgatttttccttttttttttgcataaagtagaacaacatgagaaagtatcaacattcaaaataaa

SEQ ID NO: 50998 - DNA, 16019 bp, Oryza sativa
caacatttttcatactttttatgctaaatattgtaaaattcactaatttacattattttcttagttaatatagaaaaggaagaaagaggtacaggtcatttaaacctctaaaataggcataagggcatatataattaaaaattcaattcataatgctccatgttctaccacaaaggaaattttgtgctgaaaatattattcatggacaaaaaaaaataacatgtcaaggtaaatattgcacatttgagaatggctttagtactagacaatgccttcttatttgtggtgctttgcactggagaacaatgttttttttcttatgattaccatcttttgtcataaccatgccatctgaagcttgtttatgatgtggttgcattattacaagcccattgttgtgacctgcaaccctatgctgccgttgcagattgacaggagtgctagagtcttgtggaagtagtggattagagttccttttgcttttggagttaaccatttgcagtgcaatcctcaacacatagtctgcctgagaaattggaagaaaaaccaagatttgtcaaagttgcttggtatgttatgctaagcttaaccttgaagtgaagctaacgtgacacaaaaaacaccaaaaacaagagtctctgtatgtgtttataataatggaagtatgttttgggttttgcatgcaccaactatgagcacataattatttaaccgtgggtagcaagatctaaattttgttcgtagagtcatacacctaagattccaccggactcctgatttctactctattcctattctaccagctagatactactaaactaaacttgagaggggagccactccacacaaatacaaaaaagaaaagcagcccaccctcaacaacacatctccgtgcaggggagggtctattgtgtaagcacgtgaaaagaagtatggtaacattgtaacggtagttttcatatatgtacaacataaaatagtttaactgacacattttgctctatagaaagagaaataggaacttgccattgatctggcaagaagaattaatcacccaaatttgagccgcgcaaagacgacccataattgggtgctggggatttaaacctacacctccaatcctattaatatcctagcaaccaaaccatagcctagttggtacatattttactacggaatcaaacgtgttttgaagtctgaacattatttgcatagttccaatccatagatgttctaggcatatattaccaacatttttcatagacctcatgaatcatactccctccatcctaaattataagtgtcagggttatggataccacatacctaatagtagttgactaaatctcggcaggatccaccacataccatgtcctatacggaagcaaccttcggatataggaggagttccggaaaaggaaagacaaccagagttctacatggaaacgacaaggactacccggattgtatccatattagtttccttagttctacttagacaatgggacacctatgggtataaatacaagccccctaggaggacagggggacacccaccacgggacaatcaacacccaacacaatcaacatagaagcctacatacgccaagacacgccgccggatatcgactttagggataagcacgactagtaccctacggtgtctccggatactgtcaggagagacgaaagcgctatctctgatctcgctgggcacggattcgaggtggaaggctaccctgttgtcgactacgagtcagatcgtcagaccgccatgtcgacaacagttagataggctaccccaaatattgtactggtgtgattatcatgaataagagcaataccggcttcggccaacaggatgtagggttattacctgacagttcaggagcccgaacctgtataaaaatccctgtctccatctctttacctcagtctcgcatatatcctagcaacgacgatccccatactatgcaaataccagaattgcgacatcaaacgtcgacaataaggcctatatttttttacacggtattcaatgatatactttaaccactaatttatctcatgttatgtttccaacatatatgaaattagcattgtatgaaagtactttaaaatatgaatatagtgatataacatgcataatatttagcatatatatggttagtatgattattagtcaaaagttatcaagtttattttttcttagaaagagggcgtcctataatttgggacgaagggagtatatatttccgctattatccagaatgtatcatttccaagtcaagcattaaagtagcatcaaaaagtgctaatcagtctaaaagttggcaactgctaaacttgtgtccttacattggaaagaggagggcaccatgataggtgaccactccaatttattcccttgatctggaaatcgttacacatgaacgaatatgtttcatttatcttcttctactgaaaccacaattacctccatatatagttaatagcatacctagcatacctttctagatatgaagatgcggcagacacatgatagaggatttaatttgttatgaaacagtagggtgcagatttagccagctcgatcaattgtactccctccttttatacagaatgcatgcttttcaaaaattcaaactttgtagattttgactggtaacagtaatattttaagtatatttagttataaaaatgtagcatgtttggtatagaccatatttcaaggggctttcacatcatatcagttttctagctactaacagcatattacatacaaatctttctaagtgaaaagagaatctcaaaacgtcaccttattgatccacataagcaaaaaattctagaccatcagataaagaaaaggagggtggaagtagccgttggattggattagtaaaaaaatagtgaaacattattctagagctttatagccttctttcttacagtggagagagagagcgcgcatatcaggcaacggttatggccggatggactagcttggccgatcataaataaatataataattcaagcacaaagattgaaaacatatgctctaattaaccaaatggtaaaaggaagaaaagataaaaatatgattacgtacgcacatagtaaccatcatgatgcttaaaggtgaaatctccaaaggcaatgaaatatcaataagacgcatgcatgctcgacgaaacattcatcaggcaacggtggcaacggttatgcccggatggactggcttggccgatcgtaaataaatataataattcaagcacaaagatcgaaaacatatgctctaattaaccaaatggtaaaaggaagaaaagataaaaatatgattacgcacagagtaaccatcatgatgcttaaaggtgaaatctccaaaggcaatgaaaatcaataagacgcatgcatgcttgacgaaacatttgagtagtgcaattaatgggtgttcttctaacattattggtgagtaaacatggcaaaccattttatttcttcaaatcagacaacaatatttcaaaacaataataaaaaataacatcttaacaactatagttacgattatgatgctatgctcaaacatatacctataatatttagcaacgacaggactaataaaactactatttattttcgtgataacatttatttattacatatcaatataaatatatttgtattgaatgtagatttttggtcaaataagtttttccggacacctattaagtacgtaaaaaaatatgagaatggtagggtcatgcaaaaatacacacggtgattagtggcaaggaggcagcttaagcaaaagcgtaaaagatgattagggagggagaaatggcagcatagaagacaaatacaaattaaacccaaccctgtccgctacaacaatcctaaaactctattctacatataaattatttttaaaaaaacatacaaataaacccacttctcatatttataaaccgcgaatccaccttcgccgatgagtgtagctatagactaagcataatttatcaatacaaacaacgtgtaaatgtaaacatgtttagtacatagagaggttaaagtcgtgcgaacgcacgactatatacgctagttatgtgtttaatgtacttcaaatttcaaggtgcacttccaccatatttgttttcttagctacaaacattaaatgtattatatcataaattactgtttgaccaattatttctcatatataatgaggagggagtaccttgctggtagcaaccatgtaagttttgtcctcttcattagtagcattatcctgaatcattttcattcttccaggaaaatctattggaaattcctccagaagcttttccatcctgtatacataagaagttactacttttaccaccaggtctataagatatgcagtacaactttatgctacatgcatataacttcggttgttgtcactctaattgattgagaatggatagtgtaattgtttttaatgaattctagtctgagtactgcagctgtatgtgttacagaccataaacttacaatgattgtattaggtgtaaccagtagctaaatattgagatggcactggtatatcatttcaatcttgattctttaattaatgctctagttcactaacccttataagaatgattagttaatttgacacatgattatctgtcaagatgagacagtaacatagtcatgtgtcgacttacaaaacaatatggctgcaaatattatagaaactagttgatttcccacgttttgctatggaaattattaagcaattctcgagaaaatagaaaatatctaattccttgtatatacatatatttctattagcatatgtatataaaattgactgaatgatggttggaatagtaaatatgatctgatatcttgattatatgattgtccaattaactatctgattaaatatatagcatttagatggggtggtgattaatggcattgtttaattagtgaggaagtggaggagacttttatctaacggctaataatggaaagacttgtcgatccaatggttaaaactattttgatgacgtggccactacaagataattaagctattgccaccaaattattacaacaaaaaatatttcgtagcaatatattgtactatagcaatgataatttttctatggcaaataattatattttattgcaacgatctacaatcgttattttatttagtacttttgttgcaatagaaaatgagatatcgccacgaaaaatcttactgttgcaaaaaacatgttctatagccacaattttaatttttatggcaatttatataatacatggtacttttcactactttttgttgccacgatccacaaattcattgcaataaaaaaattgtcgtctcataatttaacttattttttttcatatggatacggattgagacaaattttatatggaaattgtagctctcgacgagatctataattttatagttgataacttttttatttgaaatcttttagatatttaaatctatgattcaaatctcagttagataggctcaaatggaacgatatgcatattccaacagaattgatgcgtaggtgagttggtaaaggagatcatgcgtgaaggataggtcttgggttcgaatcctagccaatacatggtgtaaagaaataaatataaatagataggatgatagattaataatttaaacttttaatttggtacgtagaactaatgccacatatggagtggtggcaataacttttattacaacgatgtaaagtgttgcaatttgatttttttgccacatccattccgtggcaacatctaaatttattaccactaaataaaaatcgttgcaataacctattaccacgctatttattaccacggctagcaacgattttaaaattgtggcaatatgtatttattgtcataattttagtattgatgctacgatttttttcgtggcaacaaatgatttttttagtagtgggctaaacgtgatgcctgtttgtggtctcacttatatagaaagcatagatttataaatttggagtatagcttataatggaaggctcgtcatatgtatatcctttatatttacaccaccatccacacgcatgacacaaccctcttgggtcggtgggatcttatgagcacaagaatatatatttgtgcatgtagcttttactgatctcatttctggattgatgcttggttcgaatttaaaatttatgatatatgctagtaaagcctaaaaaaacacccttaatagtgaaggcagcatgactcatggttcttatgaagtgtatgttgcccaatgccaaatatccttttattagagtgcgcagcccggctcaccaaccaaccgtgggcgtgggccattccggtcacattgggcctgctccaccacaggcccaaccagagccacaactttaggtcttgggcctacacaacccaaaagactagtctgatgggtaaggaccgtccccaccttttaagttgtgctcccctatcatcaattaccgatgtgggactaaacccaacaatctcccccgtcacatcaatccatgtgaccccgaagacttgttacttggcctccccatcatgtgacctatggaaatcgttccgggttctaaacctgggctctgataccacttgttagagtgcgcagcccggctcaccaaccgtggtccattccggtcacatttggcctgctccatcacaggcccaacaggagccacaactttaggtcctgagcctacacaacccaaaagactagtctgatgggtgaggaccgcccccaccttttaagtcgtgctctcccatcatcaattaccgatgtgggactaaacctaacaatctcccccatcacacatcgggcccaacaatctcccccgtcacatcaacccatgtgacccccgaagacttgttacttggcctctccacaatgtgacccatggaaatcatttcgggttctaaacctgggctctgataccacttgttataaaagttagtcaatatagcggaacgacgactaaccatctcgatatagcatggtgattctaccacttctaggtggcatatattcatcaaggtggagtttgttagaatagatgtcgaatatactagtcctatttggttacagttggacttggagttggaataggtgtaggatagagttagagtcgaactctgtcatatgctctctcttaaataaagaggggggcaccacaatgtaaccatggcgactacgatgtagtgtagacacgcagagagacgatgatagcgtggccatggactcttagcggctaggagctatattggttggggaggagcgcccataattagagctctggggatgtaggcttcagttgaacctcagtaacaagtatcatgtgttcatctggcataccttgggtgatcaatgactgaagcgatcgggaaggttagtcgtcgttccgctatatcgacgaacttttataacaagtcacttgttagagtgcgcaacccggcccaccaaccatgggccacccaggtcaaattcggcctggtccaccataggcccagccaaagccccatcatcaattatcgatgtgggactaaacccaacaatctcccccgtcatatcaacccatgtgtgaatgtgggactaaacccaacgatctcccccgtcacatccccgaagacttgttacttggcctccccaccatgtgacccatggaaattgttctgccccaccttttaagtcgtgctccccatcatcaattacccaacaatctcccccgtcacatcaacccatgtgaccccaatgtgagactaaacccaactatcacccccgtcacatcaacccatgagacccatggaaattgttccgggtttcaaaccttgggctctgataccacttgttagagtgcgcggcccggcccaccaactgtgggccacccaggtcaacattgggcctgctccaccacaggcccaaccggagccacaactttaggtcctgggcctactcaacccaaaagactagtctaatgggtgaggaccgcccccatattttaagtcgtgctcccccatcatcaattactgatgtgtgactaaacccaacacctttcttggtcttttctacagagtgtatattatatctctcccaattaaaattaccctgttagaagtaattacacattctagattgttataaaaatagtgtttttgaacaatttagaatatacatagaattcaaaagtactttgtaaaaataaccgttgagcagggttgacagtattggtggttaccacatggtaaacgtagtaaattatcttggtggttcgataggataaaccgatgatatgatttggcaaagaaaatttaaatttaaatttgaaaatgaagaatattcgaaatattcctacaagtagtaaatacattctagtgctaactagtaaaatattgtgtgaaaaaataaaaaaataacttcgttcttttgagccaaaccaaagtggaaataacaaataggaaaaagaaaagaagaagtgggttgggccatttctcgggtaccatgtatgatctcggggtatatttatacttcaaaactaacaattagacatgcatgtaagtgtaaaatagaatattggaataatcattaaaaatgtataaatagatgtttggatggaatgtagggaaaaaacatagaaatattaaaaaagatgttgtgcccatcagttcaaaaatcaaagatcagtgcataaactatatttgacatagcatcaatcgaaatccatttgttaatttagttcctctccctattgagatccaaccaccgcacacaagcccgagcaagaatgaattgattcaaatatttgagctgccagagccaggcaacggcgagtggagacgcgaggtcaaagcagatggtgacatgggctagcttgagcggcagtgaccttggacttgagcattgctggcaccaactcaagcaggcggaggcatggaaggcagtgggctggcagatcaccgttggccggcatggcgtacgtgtgctagagcaaccaaaacagtgatgcaccgttgttgaagccatctcgcccaagctcctcatcgccattcccatggttgacaaatatgttataagctgcctgatcttctcgattccacaagaaaaaaggaaatgaagggaaaaaaaagataggatgtgatggaaaaatttcctacatttatcgcgtggaatctatagcaaaggaatatttcatccggcattactattaagtcattgctataatctaaaaggcgctatatatagtgatataatcgataggaatctaaatcctacaattttccccttgttttcctccattccaaaggaaccctaaaggttaatttaatctatattcaaagcataagcatgagagtgaaaagaagcaatcttacgtcatctcgattatcgtattgcgagcttcttgagaaatttgggtcctccagttgagggattgtcctgccatgttgtttgagctggaaccttccatttaaagagaaatatggtttccttcgtgaactgagttgaaaatgatggaaacaatggaaaaggaagagttttatcttgcacatagagtggaacaagcgatcggagatttataggggggaggggtggtgattaagggcatagatggtaatattgcattcggcgcgtgggtagttgggtgttgcaaagtttctctttagtgactgttgttttttgtttacattgttacgtgtgtgaacctcgactaccacgtgttggtatagttgcaatcggtcataatacttgacagagagcatgcgtatcagcatgactatgctcctcctatgttgccaacaatctttattggctgcatgcgtaatggtcccgtgaatttggcattacatatcaagtatacacatacaaccacatttggtagtagtttccagttgttcaccatttcaatgcttggctgaacaacatgtcgacgacacaatgtattgtccttagagaagatcagacaaaattcctacacgagcacccagcagcgagcaccctagcttgctttgcctctctttcacgaggaacaaccatttcacggtatcacaaccattgacagatggcatgtgtatgaattttttgaggtggaaaacaacagtccgatacaaatgtatatccttgttcctcgacttgaaaaaatgcacatgaaagtaagcaacaatattgaactgataaaatctatctatatgttcttggttctcagagacaatagatgtctagatagccacttgacttagccagatataactagactgatctggcaaccgaaacatgatatatatctaccaccgtaattttgacaatttgactctttgtaaaaacttattataataataggccgtgccaaaaacttatttcaaaaataagccgtgacctcagcgccataggaattggcgctgagatccaccatctcagcgccactaattttggcgctaacctccatctgatgtggcttgtattagctacatcatcaagtggtccgcgccatactctttggcgctaaccttgacagtagataaaatgtaaaaaacggtgactcctatcacgtaggtatcatttgtgtggtggtaatgcgctaaagattctagcagtaggtcctgggttcgacccctacgacatgcacattttttttactttttcctactatctgctatagcctaatttgctaccaagatcataagtttggcttataaaaatcattttattctggactagacaaatatgaaaaggatacatattataaaactttttagatatttccatgtattatagattaataaaattataaatatattcccaacatttaaaaattattttgaacttcagaaaatatgtaaaaaaaaatattgtgcatgttctcaaatttttatataccttaattgttgtaattgacatgtatatcgtcatatgctttccaaatttatttttattataataaaattgagaaaatatgtcctcaaattcttcctaataatgtgtgtgtgtatatatatatatgtatatatatatatatatatatatgtatatatattcatatatatatacatatatatacatatacatatatatatatatatacacacacacataacattaattcatattatttagttataagtaccaagcatggtaaggaaaaaatgtaaaaagatgaaacaagaaaatggtactgtgggttcgaacctttatcctttgaccttagattaaatcacctccaccactgagctaccgtaccatgaagctgtgaatgggagattcgtctttttagccagtacagaggtcagcgccaattggcgctgacatatgatgatgtggctagtttgtgccacctcagatgagaggttagcgccaaaattaatggcgctgagatgttggacctcagcgccattgggtgacggctcacttttaaaataagtttttggcacggactatttttagaataagtttttgtaaacggtcaaattgtcaaaattacggtatctaccaactgatggatgacaaacaacccgcaaaaattatagattgtacattatattgtagtacatatgcaaaccagcttggtcacaccgatatcttggattcatctccacatgtatagagctcacatcaatatgttttactctttgtagatctatccttgtgcacagcatcaatactaacggcaattagtttctctccctaattaactttcttttacagttttacctttgatgtacagtatctagcaacgcaaatctgatgatactagaagggtgctttacgtacacatcgcacatcaccttaggtccttaaactcccccatcatgtctttacctaaacttaattgctcttgatccgctgcaattcattattatctctcaaaaattcctcaagtcaaaacaaataaacaaaccataatctccactaaggctacatctcaaatttaggttgaaataataagaggtagacacttgatcatttgcacagatgtcagttgacttcaaatttaccatacactacatattatgagggcctgtttggggaaagcttttggcagatgcagtttctagcagaatcaaaaaaacttcccccaaatattctagcttttagattctgagaagctacttttcccagtttctccatattctcacgagctgaatttctaccaggtgttcctcaaacagacccttagtaagtgacgtagaagaaaagagaatgctaatttagctaagtttattaataaaatattaatatatggtcttttatatacaaatgtacaccctttacttctagagcaacaacatatagtttggaggagagagactactatagcacaccgatttcaaagtagtacataaaggctgtgtttagttggatccaaagtttggattttggttgaaattagagatgatgtgactgaaaaattgtgtatgtatgacaggttgatgtgatgaaaaaggactgaagtttggatccaaactttgtatctaaacacaaccaaagcatcaaatgacgtagagtaaaaaaatgtttgcccatttgtcaggtgaaggtagagaatttgatgtgagagataaagaaatattttcttatcttttgtggtctccactacaagatgtttatacacacaaacacattctaaaagtctcataaaaggaacctccaccttgatacctcttttccatattacacgatactaagagcatcaccaagcgttttcaacaagactttctcgagcattttggcttgtctagtttttgcaagtgaggaagctcatctttggagttcaaccaacgccaaggtgttctcattgattatgaatcccggttaagtaggcttgtgaattacgttgttgggagggtcttgttgaggtgctttattcttctcttttgctctagttctgtttttttctctttttgtgttttgtgctgggagaggggaggggccggtggctcatctccaagatggggagaggtggagaggtgagatgggttggggctggaggaaatttatattattttttagattttgaggcgtccaatttaaaattttataactgcacataaattgaaaaaaataagactaaaatataaactatctaagggctaatattaaaaattgaaaccatctccaaaaccattttgcattgtgagaaaaacccatctcaaatgtatagcctcaacctatgtggatgccacatggcatcggatatcactcctggataaattgcacaaaccacccaattgtcactctaattttgagattccaccccataagcccatcaccaacacacatgagtagttgattcggcccattccttctgacatggattcgtagcagatcatatcagctaggccaggctcgtctagtgtggctatgagttgggttcaactcgagctcattcttaggctagttagaagtatgaagatgaccgtaaatgacgtgagggctgagcgtctaggctatcgatgatagtgatcaacaacaagcttgcattggaagaaatgagacaaatcaactactcattacacaaagggggcaatttcaacctggtagtgttgggtgtgtaggcatttacatcaaaaataggttatgtagtagaatctcaaacctatagtgacaattacggtggtttatgtaattttgcctcaacacctattcatgccttaagagcaagtattgtgagcccctacacacttgcccccaaatgtcacatagcagcggcagaccctggaggggtgccaggtatgcaccggcatacctacaaaaatctataattttttactagtagtatgtagtatgcatcaggtgggccaaaacattttatgtgtgccttgccaaacgaaagcccaagatgtacaagcccagaagttgcacggctagaagatgcccatgtgcatctatgccctgttggctggcagcatggcactcacgcgtagggtttggcacttcgtcggactagcaggcgttggcggcggcgcggcgcggtagcgcggccctcagcatcagcagcctcacggcgagtttaggcgtcgtgggtctcgtggctttgtgactgcacagcaagctggagacggaggttgccagccaccggctagacactagctagcgcctcggcgcatagcggcagcgacagcggtgactgcacgaggaaggcaacgaccaccggccaggccaccaaggtccgagatatttaactatttgtcatttttagatgtggcaattaactatttgccactagacctatatgctatagacacatatagatctatatgtatttgagataggggtggcaaatagttaaatgtcaaacctaaaagtggcaaatatttaaatgccccgcagggtccagctctgggcatcatccgtccatatttaagtatactcgttcactattattagcttttttgtttctctgatacttttcttctcttaacagaaagagagaaagggagagagattgattgaagaattgaaaacttgaatgaatgagtgagaaatgtgaaatcgatgagttcgaacttctaaaattgaatccgcgtttatgggatttttacactgagatcaagttgaatcattggaaatatgaagaggaattgtggcatttctttctatagcaaggaaccatcagcttcacctaggccatacccgatgcttctttcttataactgaatgactgatggtgttgggaaattttagaagagtgattatccccttatgggaaacttaaggacagggatgaagactaaaaatgagttgtaatcggtgttgttctctgttccaccttgggagtgttaatacaacaccagttgaataattatattgtacttcccaaaaactatattgttggcattaagcattcaatttacctcttcaaagggggacacacccaggaaaaaaaaatcctacggtgaggtggagaagagaacagaagagagagaaggggagaaatgagagaaaaggaagaggaaattgaacaaacaaaaataaatgaaaattttagggccagttcattagagttagtttagatgtgatgtatataccacccctttaataatggctatcatatggataacataagaggtgacatctttctcttctataaaaaaaaactaggctctaaggtagaggtgtcgtttggtcttagtgcaccacgtccccttcacgtagacaatgttgtgctctaatgagccgctcgtcccctgctagctagaacccggtggccttgttagagagaagcagaaagatttcctgagaagcagaaagcaagagagaggtagaaagctagagagaatgagagagggaatgcgctgatgacctaggaagtgtcgttgacgaagagactaccaccgccaagttccatgtccaccacccagcaccgctgcgctttgatctcactgaccaaagctgcctccggtagggaggggtcacgacgactagatccaaacgtggagaagttcctaggcccaatccgccttccatccatgacgccaaagagattgctgtgtcgatttgcattggagggactcgccggcacagcgcagcctcagtctcctcgcacccgcaaccgctacagtacacgaattaaaacctaattgcttgctagtcgtccaaagctagttacagcaacttctctcccacgctttctcatcccacacaagagaattaattgggtgtgaattgaaatgagacagaaaaaattaattaataaaactaaaaggtaatttatgggaggacgtgtgttgtagttatatccgtcccataaaaaataaacatagtgccaatgtgacacatcttagtactattaatctggacatacatatatttagattgagtaaagtacattggcggtccttaaacttgtagggttgtgtcatataggtccctaaactctcagaacgcatattcaggttctaaaacttgtcaaagtgtatcatttagatcccaaatcgacacatcccctctaggatcctacgtggcgttgatgtggca

SEQ ID NO: 50999 - DNA, 22489 bp, Oryza sativa
gcatgccacattaacgctatgtaggatgctaaaggggttgtggcgatttgggacctaaatgatacactatgacaagttctaagacttggatatgtattttgagagtttagggacctaaatgacataccactacaagtttaataaccgtctgtacactttactcatttagattcatatcctagattcttttttatgggacgcagagagtaatttttgggaggacgttttgaacaaacttttataactttaattgtcaataactttaaaaacactagatttatcttacaaattactataataaaagtaaaaaatatttattacatacattataaaataataataataataataataataataataataataataataatatatttttgtcaataatgtctaaaacatgaaaaattatagaatatgactacaatgcaacgaagctttggcacgtggcgcgtcgtcttctcccgaatggaagaaagggccaacgaatttttttagagtgaattacactttgggctacattttattatttaattttcactttggaccacccttaaacacatctgttcactttggatcaaataaatttactattgttgcgatttggatcaccacgaacgattttttttcagcacaatcaacgacattaatcacatcagctctagtatacggccgaactcctctgtgtatggctcatatgtttaccgaaagggaagttagacatgacgagaaaaagttgttcatggtagttcaaatcgcaaccatgataaatttatccagtccaaattgaaaaagatagaaaacatggataataaaaggtggaccaaagtactatgagaaaatctacacaacagtatcccgtcacaatgggataaggtctcatcaaccttatctccttcgatcccttcccctccacaatctctctctctctcactcaggagttaggagaagtcctcaggagtcaggagaagtccaagagcatggagatgaagccagctaggaggaaggggtcgtcgtcgtcgtctccggcggccgaggtggacgacgacggcacggcgtcggcgaggtcggggcggcatcgagggtgatctcgtcgcgcctcctcgacgccgtcctccgcccgctgcggcgccgcttcttctactggcgccccccatcgctgccggcgtcgaggcctctcccctcctccctcacactcctcaccaaggtctccatcaccctcgcgatccaccagtgccatcgtccttgcccgctgctcccgccgcctccttgctagtgagtgcaggtggctcctcctccgccaccgcagaagaagaagaagccggcggtctcggtgcctctgtcaccgcaacgccaacgacaatctgctctagaacctctacctcctctctttcaccatcaacttcaaaatgaagttgctgaagcgcatgtttttggagatggtcgtcgccgacttccagccggacctcaccatcttttgcgtccgtgccatggccttctctattaggtattaatcgcgatacctcagtatcaagcctggtactcacaagtattaggcctggtacccaggtaccaaagtctatgatacctaggtaccagccggtaccaagttaccaggtacccaggtaccaagtctgtgatacctaggtaccagccggtaccaagttaccaggtacccaggtaccaagtctatgatacctaggtactagccggtaccaaataccagttggtacccagtcggtaccaaatataccaggtaccaggtatcaggtaccagctgatactcaagataccaggtgtcgggggaaacacacatagaagctaacggaaagaaagggaagaagtcacttaaaatatcccgttctaacgggacccgttatgtagtctctctctaaaaaaagtatttttattttttgagacaaaaggggaaacgaattggggccagggaatttaagagcagaaaaccctagcctagcctagccactcgatatggcgacgggcgatgtgcccgccggcgaatcggcggcggtggcggaggagcgggactggtcggagatgaccccggtgtgcctggcggaggcgttctcgcggctgggcctggagcacgtgtggcgcggcgccatggcgtgctgccgcgcgtggcgggacgccgccgcctcccgcccggcgctcttcgccgcgctcgacctcgagcccgccttcgcgtccgtcggcgccgacgccgccgagtggtggacgcccgccttccagcgccgcgtcgacgccatgctccggtccgcctcctcgctcgccgcgggggagctcagggaggtccgcgtccggcactgctccgacgacgccctcgccttcgccgccgaaaggtacaaacgtgtaaaattttatatgttttcttcttttttttttctggaagtgatgttttgttcgaagttattagagacgcatgaagctttttgttgattaattagaagttcaaatttcgtgtgatatgatacctaattgcatatgtagtttctcacaatttccccgtcacagaggcctcctggaaatgttttttttctctaatttctctttgctgaccaagaaatatgcacataccaagcaatggtcttcatcttcttagacggtggctgagctagaaagatttttgagtccgggaaaacttcaatataactagtatttgttatagaaatttcatcatcaatattaaaatttaatggagtttttgccggcgagcccgaggccgcctgggcaagccgggtggtgtctctgcccctgttcttagaccttcgagatcgaatataatgatgcgcatatttgcgttctgtataatggttgtatgcgcaatttaccactgttcctttctcaattacgatgcagttttatttgtgcgccttaatgccttgaatttatacaagttactgatagtttttttttatgtagtatgcattcattcataattcttcttggtccttagatctatattctctgggctttcaggttgtaaaatgtgttcatgacactggagggtgttggtgacttttttttctctatttagcatttattcccaactctgcagaatataatatattttaaactacatattccgttcttaatgataagttatggttttcttatttgaactaatatattgactgatgcttgatttttcattgatatattttatagtgtgtaggaatagatatatggggcctatagtctaactatggagccacaaatatgtgggaatctgtactaaaggtcataattccattcttaagtcgaatgttggtgatgttattttattcaggaagacaaagtcttagaaaaacctctcaaatttctatattcctccagggaaccaacagctctatttgttgtaggttttgccgtgttggtgatctagattttattttttttattaaactgactgcatcacaatcaaggaaaactaggtgctgttttgtactcatgaatttgcaagaaaagattttcatgtattacattttgagtgtagtagcctgaaactttgcttcttttcagcaatgaagttctctagaaactcatactcttgtacttatttaaacacaactatttcaagaagtaaaatacgtctgttcctgtcttcctgctaatatattaccaaaattcataatacatggagaaccaaccatccatatagtttttacaggttcatcttgaacgtttgtctgcttctacaccattctaagtaaaatagctttctcaattcaactattctgtaatttttttttcaattttttgtattgctgtttgtataattttaatgtttttattgcatatgtatccatcattcagcctcttatgtaaatgtatattggtgtttctgtgcatgttaacccagtaaattatttgccaacactacagtaatagatacactaaactgaaattgagttggtggttggtgtattgctcttatttgtcaagcttctgtggaaaattattttgtgaaatatagtagtattatgaaaattatatttaaattgctcgtgtcacatgcccgctcacgttttctgttatttggaaaattgtagtgttattgcctttggtgaacatatgagtggacaacagtggaggaaatgtgtttgagtgcaaggggtgataaagagtagtctcacacttactctcacttacccccttatgtgtcgtgggagctattcccagccaatagcaatgagactctgacctgacatagagttagggatatcttttaacatagtcgctaacctgagctcaatcagctttttaagttggagacttgatgagtcatgttgaatgtgatccccagggataagttgtttggtatgaacaaaccaacccgatatgagaaaacaagtaacacaacttatctcctaacacctttctttatgttattatccagaaatgtaccaaacctgtgtcaggtacctactctactttgcacctacatacatgtggcttcacaacacatacaaatgatccaaaaacaagcttataacaaagaacatatttgcttgcaacttcgtttaaaggaaaaaaaacatcatatagccaaacagttttgtttccaccacaatactagacagaaccttacagcaatacagaggctcggtgccatcatcattgagttggagctcttgcagctcagcgtcacccattttagcaactgagctgcagccgaattgacagtgctggtgacatactgacatgtcacaaaattcatcaccagtgatcttggcgtgagttgtacaacctcattgcaaagtagtataaaagagcattccatttctgcagatagttttaggttgggtccatttctataagttatttagagcaaaagctacatgctattttgctttctcttcagctacatttgacatgtcaatgagattgtaggtgccactattgacttgctttattcatatgcaggtctccaaagctcagcattctttccattagaagcagcccaagtgtaagtgatcgatcaatgtttattgttgcatcgagctgtcatatgcttactgaattggacatcagctactgccatgaggtttcatacaagtcactggagatgatcggtcagaactgccgaaacctcaatgttctcaagcggaacatattcaattggctcgattcatcggagcatgttggcatagttcctgatgattatctaagagattgcccccaagatggtgacagggaagccattgcaatttcgaagttcatgcaaaatttgaagcatctcgtaattaggttctcaaagctatctgttgttggcctcaacgcaatatcaggaggatgcaaggaattggaggttcttgacttgtatggctgcgcaaatttgacactcaggggtatacaacaggctacttctaatatgaagaacctgaaggaactagagaatcccaacttttacattcccaggtcctccttccacatgggtaggtatgggcactggcagttatacgatgaaaggtttcagacaaatgtattccagatataaaaacagcctcaagttcaacgatcacctcaggtgtttgttctctgacatatggcttgtatttattagtactgtgaatgttgtatttgtgttgtgttgtggaaaaataatgacaataataccctgtatagtgctgctttactcatcttttccatgtacccataagaaaattgtcatgcttcagtaataatttgtaaggtcacctacaatgattcttcaaaatttcttagtatcaaatttcttaatatctggtgctcttgtcatctgtgtttgagaagatagctgatgctatgtgtttgtgtaaacatttgaaagcaaagacatcatatgtgtatgcagaacttcgtgcatacatgtataaaaaatgtggataatcagtagttgtgttatgttcagacccttgttctttgttggtcctggaataatggcataacttatgctcacgtaacatggttggtttatttgatgctgattcagagcacctctcgatcatggctgtcaaccctgttgcactttgcttcattttgattgcttgtcatgttcatgtgcaaacagatacgatatgctctcttttatggacagataacacatcacctttcattctgttgtgaacttgggatctcaaatctggtatgtttgttaggtttatcaatcatccacatctcatatgcagcagaaacaacaaatcgatcgcattgtgaaaatgattggcatccttgtatagagacactagagaaggtaaattaactgcctttctctgtctcaatataatgagaggcctttctttttcagaattctgtcatgtaaaaggacccccatttgttttctccttcaattcgtactgacatcaccttatccttttcaggacgaccatggtcgtaaaaacagaatatccttcataatctataatgaacaccgaccaggtagtgagataattttcttgcatattttgtacgaaatttgtttaatatgtcgctatcctttccatgatatcctttgtgctgcattttagtggcacgaaagaataatggggctaaagggagccttcagtatttactagtaaacaatatatatctcaaaggtacaggccattttttttcttcagtcactgacaaaagatgaaaactaatttctggatccacagatttacaggctgccacaatcttgtggatgagatatggcaaagttccctggtccatggagaaccatgaaaaatctgaacaaaccacatgcaagaaagcaaccatatctgctccttgtaatgctttgtgtccctctctatccccctgcagaaggcacaagcttggaaacagaaaaacatatgataatcctgtctgagtgctaaattagcaatctttttgggtgacaggtcccattagacctgaactaagccaggaatcctgatttataaagctcaacagtgagcgacaagggcacaaagcacctccacttcataatgttccctaaacctttctccagagttttcccaaacaaagcagataggaatatgtgttttatgttactagaggaggtaccatcattttcattgtttgtgttactttccggcgtcctaagacattataaaataggactagctatattaatgaagccatattttcagtaaattccatatatttatattgcaattacactgtagtttttagtacttacattgtaatttttatagtgcacactatataagagaattaggataaaagcaattgattacctacatggaagaggacataggagggattggaacatacatatgtaaaagagatgtagcaatcacatatggaaaaaagtgactgacattaagtaaaaaatgtggcgtcattttttttagcaaaagtgttacaaaatttacactaaaatggtgtacccctcgttactcgtcaagcacagtaaaaattctccatcttagtagctacagtgctacactatagaagttataagaaaaaaaaaacgctggatatgagaagaagggctcttataacagaaattattaagaggagcgaggctcaagatagcacaccaccttgtggtgttagcgggaagactcccaggcctttctctacagaagttataagaggaaagagcctccacacacactccacataatagcttcttgttgatcagtccatctcaagatgaagaaaagctctcttgctgtcttcctcctcctactcacccttgcttcccagggcacatggtgtgctgctgagagaagccacaggattaatggagctcatctgagacctcatgtccaggtggaagaatcgcatagtcagtactctctctctctctctctctctctctctctctctgttgcttccttgccatggcactaatcttgtcaagaaatgaatttgtgatactaatcaatcttatggagaatcaaataactttttgctgaaaacctttggtttgttcagtcactgaaggcaagaagctcctggagattcaggtccccaggaagcttggccatgaggtgaagtttcccaagagaatggccatagctcacaagggtggcagcacgggcggcggctcgacaggcggcaccacaggcggcgccagcaatgtcaacagtggaccggccgacacgcggccgaggaaaaacgcggcggcgatgccagctccggcgacgacgacgtccatcctggcactggccttctccttcgccattgctgtctcagctttcagcttctgaagctgtgtgagtggtggtgttcttgcaagaaaggtattagtatgtgtgttagtggtgtggtaatctctgaatgactgaatttgtgtatccagtttatcagtagtgcacactgaaattgtttcatcttcctgtatcttatattcaatattcttgatttatcgtctgcacaatgatgtcccagacattgttcttgcagttccaggttcttgtggttctcattctaactgttcttatcttggattctgtccaattggaaaaccacatgctgaaacagtctgttaaaaaattgaagctttttcttcagtcactgacagaagatgaaaaccaatttctcaattcatatatctcaatccagacattacaggctgccacaatattatgggtgagatctggcaagggccctggtccatggtgcaccaaaaaatctgcaccaaccacatgcaaaatagctatcagttctgctcctttcagtgccttgtgtccctctttcttcctgaagaacatcattagattcagaagcttggaagtaacaaaaagaacatagcataattttgtctgtttaagagtgccaaatcagcaatcttattgggtgacagatcccattagacctgaactaagccaggaatcctaaattataaattacagagagtgacaagaccacaaagcacctccacttcacaatgtccccttaacctttcttcggaattttccacaaaagaagcagacaggaatagctgccatcctgtcataacttgtactctatccattctttaaatacaaggatttctaggttgtctagtactccctctaatgttttagggtaagtctgtccaaattcgtagtactagaatgtgtcacatccaaacaaaaaaaccatacatttagacaaggagtacagatttaaggttttagaagaaaagagcatctcattaaacggttggatggttggaacttgggagtaggaggctgggtggttgtgggtaagatgaaaagaaatttgaatgggaggtgattagtgagataagtattactctagaaatacttatattacgtacaaaatttaaatcctagaaatacttatatttggtaacagaagaagtagcgcatatcttagcgaataactttacgatacacgataggtaccgtcaattcaatgttagttttgctgtacctctcctaatatcttttaacactagggaggtatcaaaatttatactgaaaaatatttaacctctcctcggttaacttatcaagttccatgaaatgtctcaatcttagtagctactcctacatgagttatactccctccatttcaaaatgtttgacaccgttgactttttagtacgtgtttgaccattcgtcttattaaaaaaatttaagtaattatttattcttttcatatcatttgattcattgttaaatatactttcatgtacacatatatttttacatatttcacaaaattttttaaataagatgaacagtcaaacatgtgctaaaaagtcaacggtgtcaaacattttgaaacggaggaagtaattacatacaggagttacatataagaggaagagcctccacacacacacacagttcacataatagttttcttgttggtgatcagtctccatctcaacatgaagaaaggctttcttgctctctccctcttcctcctactcacccttgcctcacaggccacatggtgtgatgccgagagaagccacgcgatcaatggagctcgtctgagacctcatctccagtttgaagaattgcatggtcagtcgtcgatctctcacttgctttcttctttcctgatgctttcgtttcttcctttgccatccatggtgcttctaatcttctagacaaactgaaaactttcggagaattttaacgttttctttattttctgaaatttgttggcgttttcagtcactgatggcaagaagcttgggcaagcagctgacactgacactgacactgacactgagagccacaagcaccatgacgaggtgaaggttccgatgagaatggccatagcacacaagggcggcggcaggggcggcggcgttggcggcggagtaggcggcccgggcggcggcacgggcgtcggcgggaggaacgtcaacggtgctgccgacacacggccggtgcacaacgggaggagcaacgcggcggcgatgccggctccggcgaaggcgacggcgtccgtcctggcactggccttcgcatgtgccattgttctctcggctttcagcttctgatcgaagctgtgtgtgtgtggtggtattcttgcaagaaaggtaggagtattatattagtatatgtgtgtttagttgtgtggtaattaatctctctgaattatgtgtatccagtttgtcagaaatgcagtgaaagagtttcatggccaattctcaaccagtatcttatgttcttgatttatcatgtctcatggtgtccgaaatattgttcttggattctgtccagttggaaaatcacatgctcaacaatttgccatctgttcaaatcttgcaggctcacttagtcacttccttgtgctgaattttgggtttgcaaaagataaaaaaattgatctgtagtggaattgtcctgtataagatgatagagtgaccaataatttacttttctcatgaaaaatatataataatcttctttgaaaagggaatacttggctcaaagcattgtggggccaaggattagagatgtgtcaccacgtgaaatcattcagtttgccacttcttctgaaaaggaaatgatattatatggatatccacttgttctgttccctgctgcctgcgcacagtttcgttcgttgcctgcaccgtgccttaacatgaatagatttggcgcactcctgaggaaagttttcttcttgtactggagtaaggctgtgtttgaggaggagatagagaagatttgaaagatacgcaaaacgaggtgagctattagcgcatgattaattgagttttaactattttaaacttcaaaaatggattaatatgattttttaagcaactttcctataaatttttttaaaaaaaacgcaccgtttagtagtttgggaaaaaacgtgcgcgcggaaaacgaaacaaacaatctcacaatcacccagggccgaacgcagccttaagatgggataagattattgaccaataattattctgttaaaatatattttatgacaaaaaatgatgttactagtttcatatttaaaagtatgtttttattattatacttttgtatcgtataaataatataatggtaaagtagttattagtcaaattcttatcctaacaaaataaaatacaccttacacttttatatagaggtaggatttaaaatttggatatctgtcactctaaaaattgaagtcctaaaaaataccacagaatatattgtattgtaaagatgccaccataaagacattattatcggatattcgcaatattggtcgctttggccacgatttagatcacaacaaagacattttacacccttcttttatcatattctttttctctcttctcaccatccatgacagcaagcagctcaagatctagctcactgtagcaatgctcgaaaatgctaataggaaaacagggatttcggttggtattttttttctttcttttttttttgtgtgtattcaggggatcggaacttggagcatgtgtggtcctcaatcagcacagacaaaaacgttgctgtcttggagagattgttgtcgctccttgtcgcctcgggcatgtgcagtggaattgcagaggatggttgcaagatacttccttcgtccgctaaaaatatagtaacctaggataggtcatcctctatcctaggacaatgtatctggacatgtctggatgggtcttatcctattctagattgttatattctgggacggagggagtagaagactgacatgatggcaaaattctaaacaagggaaggagataggtcacagacatgagtagatgaaattacaatctagagagcaaccggaatcttcaaattaatgagcaatggcgagtactccctccgtccaaaaaaaactcaattcctagatttccgtgtcttacgtttgaccgttcgtcttatttgaaaaaattatgaaaaaaaatttaaaaagataagtcatgcataaaccattattcatgttttatcatctaacaataatgaaaatactaatcattaaaaaaatttatataagacggacggtcaaacgttggacataaaaaaccgaagaattcggtctttttgggatggagggagtagcccttaaggctgtttgtcttttgtctttgcttttgtgtgcccagcttgttttgattgcaaccctactttcgacatcctaatgtatttcggtcttccttgtatttttttctccgggaagactaaatggctgtcgaatgatttttgatagctaaatcattcatgtttcaatatatttagaaccgttgtttaatatgttgtagcaaaatatttcatgaggtgatttgattgtgtttcagttttttaaaagattgaaacttttttatctacttggtgaaacattttcgatctacttgtgaaacaaagctcggttggcttcaaaatctatacgatggaagcctaaaaaatcatgtaaatcccatatagactttttctcgatgtgcatggatttgtttcatgtttcaatatattcggaaccgttgtttcatacattgtagcaaaatattttatttggtgatttgattgtgttccaacttttttaaaagattaaaatatttttgatttacttgggaaaacactgcatgatggaagcctaaaaaatcatgcgaatcccatatcgatagcccttttttctctcccaaaatataaaaggatagatcatagacaagttgcttgcttgctatgtttttttagtaattacttatttacctcgttttaaagcttgactactaatttagcctgattttttaaagtttgcacatttgaccatttttcctaaaaatgaatatcaggtctaaacctgtttcgggaagacaacctaacggtgttaacacagggaaaaaccatttatgtccttcttaatttgacccttttttttaaaacgagtatcaggtctgaccctattttgtaaagacaacctaacggtgtttactcagggaaaactaccgtttatgcccatctcatttgaccctaattttccaatattttaatttattagacctagtatttttttcacttcatccctataaactatgtgatgaaatttgactaaaaatatgtacaaaattgatgtaggtttgacatatttgatttaggtttatcaaaatttgttccgtgctgtgcccagtactaggatttggctaaaatatcgactctctaaatatattttctaataacacttataactgtgtggttagaagagagtcagagggcatgtttgtttttgaaaaatagggtcaaatgagtagagttgaaaaaggagagtcaaattgatagtagcctttacaatagtgtcaaaagcacaattatctttttttttcagactgggactcttagaaaggaaagtgggtattgcatgtgtactttattaatacttgcataatttgactcagaccctctttaatttttgttgcgcgaaatgatgtacactaacagcacatcttgataaccgtagattgtattggtttcaaagattggacggccaagattgttttttctttttctcaattagtcagacaatttatagctgattttgattaatgtgaaaaaattttagcttgcatttctcatataattaaggagagcctccaattagcataaagataataaaaaaagattttaacggctcgtagtgtcattattggtgttgctccctccgtatttaattatatcgcactattgactgcactcggtttaaatttaaactttgaccatcgatagctctcaaaattaaaaaaatataaaaatcatattagaagtgttaaatatattagaaaaacagtgaccaaagttacccatcaaaatcaaataaatttaatagtaatttcttgtctctcccaatatcttagcacttggaaggtactccctgtgtttcatattataagatattttgactttgatcaaagtcaaactacttcaagttgaccaagtttataggaaaaaatagtaatattttctacccaagataaatttatatgaaaaatatttaattattaatttgataaaactaatttgataatgcaaatattactatatttgtctataaatttagttaaacttgaatcagtttaattttaaccaaaatcaaaacatcttataacctgaaatgaagggagtatcgaaattctcaataaaaaacattgtacctcttgctaacgtgtcaagtagcttattttagtagctactccctccgtttcataatgtaagtgattctagcatttcctatattcataatgattttaataaattttgatatatatatatatatatgtctagatttattaatatcaatatgaatgtgaaaaatgctagaatgacttacattgtgaaacggatggagtagtagctacggtactggtgctataagaagaagagcctccacacacgctccaacataattctgtcttgctggtgattagtccatctcaagatgatgaaaagctttcttgctctcttcctcctcctactcacctttgcctcccatggcacatggtgtgctgctgctgctgacagaagccacaggattactacagctcatctgaggcctcatctccatgtagaagaattgcatggtcagtgatctctctgctcctttcatgattcttcttcctttgcaatgatactaatatttagtgttccgaattttttgctactaatctcctggagagtttaatttaacaagttttctgaatttgttttggattgttcggccactgaaggcaagaagctcatggagattcaggtccccaggaagcttggccatgaggtgaaggttcccaagagaatggccatagctcacaagggtggcagcgcgggcgccgccgcggccgccggcgcaggcggcggaggagtgtccgagtcgcggccgcgcaacgggaagaacggcgcggcgacgctgccggctccggcgacgacgtccatcctggcactggctatcacctgtgccgctgttctctcatctttcagcttctgatcagatgtgtcggtggtgttcttgcaagaaaggtactagtagagtgtgtgtgtgtgttttcttttgagatgatagtatgatgtgtgtcggtggtgtgctgatgatcactgaattcgtgtgctgtgtgtccagttcgtcagaagtacactgaaattgttttcatggctaattatcagcatgcatcttattgttgattcgtcatctgtctcatggtgtcacagaggttgttcttggtagtactggtacttgtagttctaactgctctcatatctttgattcgatctgtacaattggaaaaccacatgctgagcacaagttgctacagattgaagcatgacttcattgtgctgaattttgggttgacagaatttcaatctttgattatgcagtcaaattgccatgtctttgatgatagagtgatcaataattcacttccgtcgcaaaaaaaaatgataatcttttggaaaaggagacactgggcttgaagcactgttggggccaatgattagggctctgtcaccacgtgaaatcactcacttcagattgccacttcttctgaaaacaaacgctattttatggatatccatttattatgtttcctaaggacagctttttagatttaacatagggatgaaaaatggttggaaacgatatcatttctatacatttatatagaaatggtctcagtatggtcgcaaattttctatatttatcaatttaactatttaataacgagttccatgtagcattaacggaaattagaaaaaataaattttatccgtagctagaattataaatggttgggaacaatatcacttttattgaaacggtctccggacggtcggaaattcctgccaccatattcacccctaatttggcgcactaaagagtaaagttttctcgtggtaccagagtaattaagataggtgacaatactatagctctttttacttttgaaaattagatgtgtcttccttattgacattctaagaaatgccaccgaatagattgtaactactctgaacacatagtagtcggatattcgccggtttggccacaatttctagctagcactacaaagacttctatgcctgctttctcatgttcattttctctcttctcaccacccatgacaatttgatagccagcagctcaaggatctagctcactgcagggaagctcgaaatattactactagggagtgatggatttgggttggtgatcgaaaatttttagttcagatggccgtttcttggagcatgtggccctcagtttagacaaaaatcgggtgttgtcttggagcttgtcattgttccttgcctcctcaggcagtcaggcatgtgcagtggaattacagaggttgattgcaacgtagaccaagaatatttactccgtccaaaaaaaacttaatctaaaaagagatatgacttctattattacaattacatccccttttaaattgagtttttatgggacggagagagtatgtcacgtacaagttgctggctggactgtgtgcaactgactagtcgtggtcacagaagttagtacagtgtgcctttgacagctgttgctgctgtcgatgggaaagagaaatgggtagcaatgcactgggtgattgtgtcatacccatggcaaaatttgctacaggacactcaaagattgtggtctttgctgtaagacacccgaagatcgtgtatttgctcgtggacactgtaaaaaagtggtaattagctgctggacactcttcccattattttattatttccggtcaagatggagagagaaagagttatgtaagtaccaaaatacccctggacactgttcttcctctctctctatcttttttccccttcttcttccttgcagcagagcagaggtgcgagtgtgcgacggcggctggcccgagcctggacggctcagccatggcgaggcggcggcggggcggtgtaggccccacatcctttctttttctcttctttctctcctctctcgagcaggcgtggtggcagacttgcgtgaggcggccggcggcggagcagggggcggcggcgctggagagagggagagagacggccgacgcgatggcgagctcgacggcggagagtagcggcgcgcggcacggcagcgggggagagggggcgcgcgcaccgcccgtcctccatcgcgatggcgtgcagcacgttcttgtcctccagcgacgccggcgtgccgacgtcggaccacgaccaggccacgttcttcttgtcccggaagtccagcaggatgatgaaggaggtgtctgtccgtgggaacatggtcgctgccatgagcgtgctcgtgccgtcgagccactggagcttgtcggcgtcgccgagtgcacagcccggcggctcgtagaagaagtcggcctgctcgccggtggtgcagtcccagacaccgatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgccccttgttgcccgagacgcggccgattcgcgcctgccatctccagttgtacacgcgcgatgcggaagaggtggcgcaggtcgccgggaaggcagttatacacgcgcaggtcgccgccgctcctccatcgctcatttgtacacgcgcacagcgctgccgtgcgcgacgcagcagccgccgtcgggcgcggcgcggacagccgtcccgtcgcccgcggcgttccctgccatggacgccgccagctgcagctggtccccgtcgaacggcccccaccgtgcctcgcggaagcggtcgaggaggccgtaatagagcgaggtagagcgcctcgcgccccccggcaaaaccttcgcgttgctgtcgaagaagaacagagaaagagagattgataagtgggcccatggacaaacttgtctttaacctaagtttctctctccgttttcatcgaaaataataaaatagtgggaggagtgtccagtagctaattaccacttttttaccgtatccacgagcaaatacacgatcttcgggtgtctcacagcaaagaccacaatttttgagtgtcctttactcctttacatatgaccgtgtcatatgtaaaggagtaaagggcgatgggagaaattagagaatgacgaagctagggagaatacttcctgtggttataaatatttcatacactttaactacaaaatctaaccattcatcttagtcaaaattttagtgtcaacataaaaaatttaagtcatgcttaaagtatttttaacaaatagaataagttacaacaaaatatgtaataattacattatttttttaatatcatgaatggccaaatttaatgatcaaagtcaactatgtcaaatatttatgactggatggaggagtatcatttttagaaggaaccaagcttctaaacttattcaaaaatagcaaaggtggcaaaatatgaaattgccacatctttggagtggtatcacaacgattacaatcttttgaatagcattttgaaaagcatcaatctttagagcaacaaatatccaaattaagcaccaatctttagagtgataaatatccaattttctcctttttaacgtgtagtctactttggtgtgtcatgtgggcggagctttaatttgatatggacttttcggtttgatgccaagtttatgccaatgtatagtatgtatcagcgaggaactaaactataatctgggattctaggtgctataaaaatcttgcgagatgctatcaactttgtgttcccctctacctgccatgtccctacaactcattgcagatctctctgtcttgggctcatcatctagccccatatagaggaccacttgctttccaatcctacactgctgcttgattatgcaatcttatgttgctcctatgtccaactttaagtactaaaccaacctacacatgacgaaaaggaccgaattcaaattcatggaggaaagcttttgagtcatcaaaaaaactcgaatattagggaaggacctaatatcaaataatgagaaggggtggggctttgaacccaggtcatctagcctaccatcttatggagctagccggaagacccctgagcatttctcacttttgagttatcacgatgatagtttcatgttttgaattggaggtgttgggaatgctattaaaatttaaaaaaatattttgcaaaagttttgtttatcttttttttttgtcaagaagccagtagtttcatggggaaagtttgaaattactaactgaaatggtgttgcctcacttgcctggtaaagaaggatgccacagaccttggcaagttatgggttgttgggtacctgtgaattagcatcccctctttttatcctttccagaaagagtgatgctttaagctatctcaaagggaacataaatgtcatgtgccaattcagccttgattagagggggttttgggaaaagaaacattttggagtaatggatatgcaggaatttaactgttgatcattatccattatgcgatggaaaaataaatggtagggaacacatgagatgctcctttgttacaggtgtgataggttatcttgatgcttgatatggtcctcttgaacagtgaaagttgctgtgattcgttagaagataatatagcctaaatggagcctgtaaagcacttcttttacagaacaacaaatggggaaaactgtgtaaggatcagatactctgcatcgtacttttgtgtcatgtggtctctatgatcatcacagaataattgcaggcagagtagggttccaaaatccggagtaaccggccggttaattgcccgttctacaagccagggccggttaggagatgaattcaaattaagaactattccgaatgctagttataggtctggattacaaggttggtattttgggcaaaacaaggtttttgaatcctgccatggcccatggggtatcagaaattatttagaatcacgaattgaaatgatgcgtctatgcagatgggcagctgatactgctttgagctgaatcaggcagctggcaatataccaggaacagtaacaactagatagaccaccacatggtgaaagccttttgatcctgtaattactgactttgatgtatactagcaacatgcccatgcgttgcattgggtgaagcatgaaaaaacaatagtaatggatgtgcaggagtaaaatgccaccaaattaattgaggtccttgtagtcaaatcgaatctttccggtgtatgtaagacgctaacatgacataattatttgttactctaaatccattgacatgaatgatcataggaaaactattaataccactttaaaattaaattatgtattatagagtaaagtttgaaacgcaaaaagtatttacttttgtcatgtattattatgagttggttctaatgcatggttattttttgtacttgatattgatagactttttttacatattgtaaagagtagcaatagtataagaaatgtttttcgctatctatcatatcaacctcactgcactccaatcgcataatcattttcactcaaaaaattagaaggaaatcatacaatgaatagaaaaaaattggatgtaaacacgatttattttgttggtgattacaatttttttgaaaaaaagacatgcgattgttttctattttctaaaaataatttattttgtcgtaaatactttattttgttggtggtcacatgttttttttaaaaaaaagacatgtgatttttattttttaaattaataaaattgctccttatttttatctgcttcctggtagatgtggatccaacctattttcagtgtagtagcctcgggcaagccttctatttaagctagtgctgcctaagctaggcaaaaggtggtattatttgtgcactgacaattgacccgtgtggggcccacttgccacgtaagttaaaactggccacgacactgccgagggatctaaattgacatagcattgtaagttagaggatgatgtatacctggtattttgatttagggatggattttatattcagcgacaaatgaagggacctaatgtgaacttatttccggttgctacaggatcacacagtactgtactgggctgctgctttgctatgtgggctgactgctaggctgcgtttgcttttttgttgggtcggcctgctgctgctttggttgggctgcttgctagctttctcttcttttttttctgtttctcttttatttgtggagcgtcaaaaaattgccgtcacgcatcctgattcgcggattactggcgaaaatcgcgtgggcccacccttgaatgacggacgaaaaaattaaccggaagctttacctattttttatattatatagcaaaagtgtccgtgcgttgtaacgtgaagtgtacagaccagaaaattgaggaaaagttaaagaaaaatttacattatgtagaaaggttatattccctcccttgtgtaaaaaatcaatttacaagtaaagcaagtatgataaataaaacgacatgttaaatttaattttattaaattttccatgttaagttaagctatttggaattttattggaattttcatagcttaattgctaattttaataatataaacctcatttaacaattatttaattggaaaaagaatcaaaatcctccctttcaggtttgggccgaatatagaaagtttatagtctctccgttaagtctattctatttatctggcttgtttcctttctctgttgaagtccattttgcatcctcctgatatcgaccacacggtccatttggcagcccaataggccggcggcccgacgcgggagcagttggagccgtctgatcaaatggacggtctagattaatcctaacctaaataactacacccaaaacctaaccctaggactcattcccaccccct

SEQ ID NO: 51000 - DNA, 4670 bp, Oryza sativa
tctccccccgagcggctgcggcagcgagcagcggcgacggtgtcggcgtcctcccccgcgagcggcgacggtggatctcccaccaccggcggcgtggctgcgtcctcccccaccaccggcagcgcggcgacgccctcccccaccactggcggcggcggcggcgccctcccccatcaccagctagcggcagcggtggcggcgcccaacccaatcccgagcgacggcgacggactcgatgtatttggtgtttttgggtgttgaagtttgggtttctcttttttttttcaattttttcgatcattcaaaaaatcgaaatctgattgggatttgagggagggacgaaaatatagagggggtgacgaatggaagaatacgaatcttttaattagttaagatagataagagatatttacggactattaaagcgaatagaaatcgaacttttttgccgcgcttttttccgccctttttatttttttctcgttcgttttttattttttactaaccgtttttttttgccacggaatcgaacagaccagatatgaattttttagggacgggagtagagacacatatgtatacaaagtttatataaaaaacatataaaaaatataaatgtatacaaagtttgtatatatacatagtattaagaaataaaaaaaccgaaaaaacaaaaaaaaggaaagaaaaaaactgaaaagaaacgaaaaaaaggaagaaaaacaaaataaccgtgcgtgggccggaataggattttttttttccttttttacgggatcggatctatttttttcgccactttttctgtttttcgaatctgacttttttttcccgtttcctggggaatcggactacggttttttttcgctatttttttgtccgtttctttttttttcttttttaggaatcggacttctcttttttttttagtttttttcgctattttttattatttatgacggacgatggaaataaaaaaaccgaaaaaacaaaaaaaggaaagaaaaaactgaaaagaaacgaaaaaaggaagaaaaacagaataaccgtgcgtgggccggaataggatattttttccttttttagggatcggatctatttttttcgccactttttctgtttttcgaatctgactttttttttcccgtttcttggggaatcggactacggctttttttcgctatttttttgtccgtttttttttgtttttcttttttaggaatcggacttctctttttttttagttttttttgctattgtttattatttatgacggacgatggaagcacctcttattttttttattttttaagtagtagtagaattaggtatatagatgaaagacaaggtgcttcaggaattattgttgttggtgacaaaactagaagctacaggttagcaagatcaaaatggtactacatgtgttcttactcaactcctatagtcctatgtagtgggaggcctgaccaaaatggtacatggatgattaggggaacagtgcttgatatatgtaaatctagccttatccagcccaagtaatgccctagttaggctaaacccccaaaaaaaaaatggcccaagaggtgctgttgagcctggcttgagaagggaattttggcatgaaataaaagcctggccagaaacatatttggaattgtttagtgcaaatttaggccccgtttggtagagcttctaactccaactcccaactccaaactccaactccagtgagagctgactcctctaggagctgaggtaggtaaaaaagtgtttggctaaattattcagctccaaatttctacatcctttgtcgccatttcatcgaacaccttataggcatcgccttgacgttgccgccgcagccggtcaacccgcgagccaccgccaccggcaggcccacgcatctccgccgcctcacaagccgccgcacaagtgccgccgcacaggccgccgccgtcacctaggctatctcctgccgacgcccccgcacgcgagtcgcctgccgacgccgccgcccgtgagccgatgccgacgccgaccgcaacaccgcccacagccgctgccaccggccacctgccgccaccgatgcgccgcggcccgcgcttgctgcccccgtatgctgccgacgcagacgccgccacaaccggttgtggccgtcgtcggaggatggggaagaagatgggccgccgccacctactggccccgccgccgacgctgccgtagcccaccgccaccagcctccggccacgcgtgcgcgccacgcgcgctgcctgtcgtcatcccggccatgccgcccgtcgtcgtcccgcagccgccgccgcccaccgctgtcgggtctcaaaactaatgattcggaaaccgacatgtttagattgtatcaagccctggaccagtagattgatacaggttcaataatctggatcgtctttgcatacgtttagacatagctttgaaggagatattattacataaagtaatagggtatttacaagattgtggctaactaatacaacagatgctatagaatgacttaactctaatgtttggctatagacttaaaccatctatctaatctagacttgagaattaggttgaaatgaaactaacttatatgattaaactcccagcttcggcacaaactccaaatggactctgaaaaagggggttgaagcaagggtgagtacaacatactcagcaagctattatatttaatcaacgatgaatgtatgaaatgataatatctgtgtaaagctaggtttatacttgcaaaaagcagagaatgtagaagtagaaaacctgtaatgttttaaatgcagcagtatttaataaaatttccaattaggtttctatccaagatgccatagtgagtcccaatgcccgataaccgcgagcacggctattcgaatagttttaagaatattcatactgcagtagatgtacgctttacccgcaatccatgacgtgccaagcaaattagccttgtcatggcaaagtttttcagttactaatatcagtggtacctgttccatgaactctagtccccatgcgctctgaacgtaacgttatcagcagcgagaggagttctggcgttcccgaggtctttagagagaactgattatatgacaccatgtcatcgcaatcagggttcacaaacagattatagtacagattatagtcatcataatttatctcaaatatttacctgtgcctcggtaaatattacaatattgcccttcgcggcataaatttgcctcctgcgcgaggacttaagaagaaccactatacagaggtaccacctttgctagataacttaatcagctaggtctatgcccatacgagaattgcggtcgtactcgtatgttcttcacatgtactaggcagtcttatgtcggttggaacagtactagccacccggaaatcaaccatttctaccgtactgtcccaatctaagtttattaaattttatgcataatctaactaggcagggctaagcaaaagctagcatatctggtttgctatatgttcaggttatgcattcaaaatcatgaatggctaatgcacaagatactggagatatagaatataggactattatgctcaaaggggaggaataataacttgccttgctccaacgcaaataaatccaagataggcaacctgattatccagtcctcgaaacaccacaggttgcccttcaaaagataatagactctactaagaaagacgaagacaaagaaccaaattcaatacaaatcatgaaatagcaagaaagtgataaagcgcaagaagggctaggcttggggtataaatatctctgttaaaggggtatagggttctaaagggttggaggctaaggtggagaggggattaggcaactaaggttgcttatattttatgtgaatgcttggttgctgaaaggataggatgtatattggataattgaactgattcagttggtatatggctagtattggctagtggtaggtttgggtagtataatacctagggtttggttatatttaaaccgactgcggaatagggaagcatatcggctaggctctgtataggttctaggagagtaggtggctgagtatagtggataggcgatattggtaggtggggtatttggatgacggttgggttttaactagcaaggtgttagctagggtttagttgtttaggccgatattgaggtaggataaatatcggttagggttttgggtgtttgctagtcatcgctagagttggacagtatagcgactagatttggtatcatttctagccggtgtcgatagacatcatatcggctagaacaataggaggtgggtgcaggtttagtggggtggaagtgttactccgataaccgtgggcggcggagcgattaggatcacacagagctcgagagctaattgtgtggtgtgctatggaggtcgatggaatagtgaagctctgaccgctatcgaggcgtggggtgccaggagcagcacttcgaccttgggtgtggtttatgccgggctttacaaccaacggttcaacgttgggatctgtagaccacgcgaacgtccccatggaaggcgtaaagttccaaccggcgactttttagtggctaaagggtattttgaaataaaaggagatatttgaaaagcaaatgacatttatataacttaagg

SEQ ID NO: 51001 - DNA, 922 bp, Oryza sativa
  unsure (1)..(922): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcatcgacaatggctcgtagaatgtctcggtggcggcgcttcacctcagatgaatggcgatggctcgatttcttcaaaggactgccatgcatgcatgtctttcgtgttagagaggtccatgcaattggattgggactcactagagagggagaaatcaaagatggagctcggcggccggttgtagaagatgatgctgatctccaagatcattgcgccattggatggggtacttgggggtatatggagagaggtcaacatgaagctgatggcgtggtggtttggcttgcaacagtccactgcagccaaaacgacaacgatgtcaaggcggcgacgcgcagagtgcgctccaaggccggcgatgacacgtggcgttcccgtcgatccgctacacgagaggatggaatcaaaaggaaaatcttcggcatgataaggtgagtatggaacggtggtgaggcagagatggagatagttctacggtgatggcgggtgttgtcttcttcatggcctgcgacagatttgagggcgacgaagaggttgagggcatcctctctcggttcacggtggggcggcggcgggggcgcatcgccggggttcacctccaacgcggacgacgcacgacggcttggccacggcggagctcggtggcggcgcaatgagaaagagatgaatgaagaagaagaacagagaaagaaagattgacaagtgggcccatgggcaaacttgtctttaaccaaactttctctctccgtttccaccggaaataataaaataatgcggctggtgtccactagctcattaccactttttacagtgtccacgagaaaatacac

SEQ ID NO: 51002 - DNA, 8991 bp, Oryza sativa
agagaaggataaaatatattttcttagcacaagagcaattattcacaatatttgtaataatattattcttgtaccgaagaggaaatcaagccacatgaattaaagtggcggctagatcaaaaggaggattttagatatttggcgataaataagaataggtttggaatcaaaggattggtttaagatcaaaggatgggtttaacaattaattctaataaaattggaattgctttagtttaggttctagcacaaaatggaaaggttgcttggaccataattcataaaaataaaaagagttttcaaactaaatttaaataaaggaaatcatgatcagaggaaagtatcaaatcgagaaataacccgagatggttttaaatgaaaaccacaaaaagaaattaaataaaaggagaggttttgaattagttttaggaggtctctctaattataatattctaggtttaaggtgttaataagaatataagaattggcatgatgcataattagaaaatagcaaattttcagcatgttacaaccgctgccgctacctgtcgccgtcgatgctaccgttgccgccgctgcccgccaatgccgccacactagctcgggattgggaggaagattgggggaggagagaacgggaggaaagaaggggtgaaggggtagttgagtggcattttcatgtaaatacactaaaatattatagggtagtgggtcttttaaagtggagtggagctatggagcagcaaaaacctagctccacccccgtagtttattttatagaagtagctctgccaactccactcaaaaaaaggtaaatcttgaccgtttggcacagctcctgctctaggtaagttggagttgggagctaaagttgtgccaaacccttaacaggctgtctcgcccaaaatagaagaccctatatatgacttactagtcaatgtggctccggtatatagtacagacaagggatcgggccgacggttaaaccaggaaaaaccggatttatcagtaccctgagtagctcggtttatttaaaagaccgcctccgcaattgacccgggctgtaatcggccggtttttggcatgaaacggtgaaccgaagcaaaccgagccagccgggtcaacaagtgtagcaacagaacttgggccatctagaggcccatgtagcatggcaagcccattcattcgaaatggactctaaaataagagtctgtgttgagaattggtccctggctggtgggattttggcactccatggtgaccaactgagcagctgaacctggtttgctatctaaacatgtcaagtgtccctatggtttcaaaacgcagtttaaccagtgaacagttcactggtcagacaagtggaccgatgaaacaacagctggtttaacctccgatccggttttttctactatgctccggtagagtagttagcaaggtcgcttcttacatatataggattagctattaaacctacaaacaccattaagtttcaaattcaaatcaaaatattttttcccacatatacaagtatagtcaaatgtgcctcacaatttatccggatactaaaaattgaaaccaaacaactcatgtgcaactttactctttttttattagagtaaatttcacacgaaccatcatttttctttaccaagataggttatatgcaaacttaatgacatggagtaaattctctcttttttatttgcaattatatttcgatttgagcatttaccagttaccccccccccctcccgggttgatattatctctgtcaagtaataaaaccatagtattctaaaatgataagtagattgcatcaaagtcagactaatacggataaaataattgttatctaaaaacgtactctttaatttaccaatttgcaccatttccaaattagaagtgtttcatgtccgtgtaatgattcatattcatctctcccaaaaccaaatttgtaactaactattcttttgtcattatttaatactccctccgtccaataatataagggattttaagtttttgcttgcactgtttgaccactcatcttattcaaaaaatttgtgcaaatataaaaaagacaagttgggcttaaagtactttggataataaagtaagtcaaaaaaaaataattccaaaatttgttgaataagacgagtggccaaacagtgcaaataaaaactcaaaatctcttatattatgggacggagggagtacaagattagttttgagttttgacaaatgtttttataatcatgtactcctactactaagtgaagataatgaaacttatgaagtgtgatatcattttctttacacaaaatatattctttcaacattatttatttggcaaagctatacatacttttaatatatcaaatattaaaacattttactgttcaagtccctatcacctactccttcccgttcatagttcttcacattttagacaacgacatggctttcaaaacatatatttgactacgattttctattaatatatacaataaataaataaatatttacttttattatagtaccttttaatactaatctataatatgttattttagtgcctttaaattaaatacttaagttatgccaaagttcttaaagtttaaccataaattatccacaacgttaaaaaatatgaaaccgaagagagtatatattactccctccatccctaaatgtttgacgccgttgatttttctaaacatgtttaaccattcgtcttattcaaaaaaaattaagtaattattaattcttttcttatcatttgattcattgttaaatatacttttatgtatacatatagttttacatatttcacaaaggtttttgaataagatgaacggtcacacatatttagaaaaatcaacgatgttaaacatttagaaaatgagagagtatatatataccttgtgcagaatgaagcttagccacccagtgtacaaacacccaccagaaaatcaacaaagctttaagctgacataagacacaaaacacaccccttcttaatctaattatttgacgcgtactaaaagagagaaaggttggagcccgtcgttttccaggatggacaaatggtgtactgcgacgtggcgtcggccgattgggctgtcggcgcctccacgtcttgggtgcttcgcactatccttcctgacgtcggttttaaaaatctgcagtttctcaacaaccaagagggcattgcccatgatttaagggaaaaaatgaagagccgatgcccatcacaagtcactgaaatgtgggccatatgtatagctggggcccacatttcagaatcaattcagttgacttgggctttgctttttcctctctctatatatttttgtgatgagggtggcagatgcataattcctccgtcccaaaaaaaaaagataaactctgatttccgtatcctatttgaaaaaattatgaaaaaaaattaaaaagacaagtcacgcataaaatattaatcatgttttatcatctaacaacaatgaaaatacaaattataaaaaaatttcatataagacggacagtcaaagttggacacggaaactcagagtttgccttttttttttttttgggacggagggagtatgcttgtggctttgtgggaattgaatggttctttgcacatatatataaagatgaagtaaatttattaacataatatgaagccttaaatatgtggagtatatattaagccaatggatggttgccactccttggcactacaactttcctctaggcaatgagagagagtacaaagttttaatcatgggtagctttccttactcctaaagttgccaattatttggacttaatagtaccccctctatgaaaattagaggtttgttttggcaagcagttggaagtgtgttcttgatgcttttcatcttctcctttctttgctttcacatctggataactcttgttaatctgctgtgatgacttgtcatcttccactctgtcttgtcttttctctgccttgatccagtccatttcttacaaaaccaacaaacaattcgttttgtttcggttgctacaattttaaatctttccatttcttttggtttcttcaaagatttgtttcccctttttttagacgtgtgcaaatagtgtgcataactgttcattttgcaagaattaatggccggagttggggaagaatgcggcgaggtggcggcgctgcgggaggctctgcggcagcaggcggcggccgcggaggagctgaggggcgagctggaggaggagcggcaggcggcggcgtcgggcgccgacgaggcgctggcgatgatcgtgcggctgcaggcggagaaggcggcggagcggatggaggcggagcaattccggcgggtggcggaggagaggatccagcacgacggtgactcgctggccttcctcaaggccgtcgtcttccaccaggagatggagatcagctccctcaaccgccgcctcctcgccgccggtgacggccgcgccgccgccgccctgagatccaccaggagagcttcgccggagatcatctccgaagaagaagaagacgacgacgaccacctcatctcccgccacggcgagaaggcgcgaaaaccatgcaactgcagcgaccgcaccgccattgctgaattgggcgcagacatggcgcagatcaagctcaacctacaaagtcttcacaccgaattcatcaaagcgaaggaagccaccatctccagaggcgattcgcaggcgcgattgctcgccgagatctgcgcgaaactcgacgcgatctccaaaacgcgtcaggattcatcatcagatgatcctgtgcaggtgagagtgagcagggaagaaggcagctcatccaaagggagaagctacacaaatagtgagctgctgatgaaccatttcattgaggtgagtgcgatcatcttctctactctgcttgttaggcccttgctcaaggttgctgcatccatgtcattctttaggtgcttcttgatattggtactagctctggtgttcagaaaagttttgatgaactagtgatgtgtactaagcactaagcagtggcattcagtgctcaggagaatagtttttttttcatttaattttgattccttcaaatttagtcactgattgtaataaggcatatcttgggtgggaaatgctcaaacaaaacttatcttcatcagcattttggttgtgaggaaacgttgcagaatgattacttgaccaagtcattttggaagtgacagtgtaacttgtcactaatccctgtggtgaaatgcatgcttgtctattaccccaaagcatcattatattattgtactaaattattattatggtactatttaggcgtttactgtttttcaataagaatttcttctgggttttcttaacaggcaatgatgtacataccgtgagatgtgtgaaggcctagacagcatttttattggtttttgaagattgttgacttgagtacaaagattgctgatttacgattcctttttctaccatattttctctgggcgatgatgtctactgtgtacatacacatatggtgatatgttgatagcttatgtaaattgtgacgtgttatacttcttttttttggtacttttgacagaaaaggcactgttgatgtaatgtggagtaaccaacaattgtaaggaaaaaaagattagataatggattttgctgagcgattgagatctaatcaaacgtcattttcatctgtaggtctgtaccatgtaagtagccgtaggttggcagaatacgcaatgaaagctactggtaacgttgcttcatccatctccaaacgcctactttgctgcttctagtcatctagagtctaccgcaaacaatgaattgtaaagttcggcaccaaacatttgaactccatgaaatttgacatgtatacatgacttagcaacaacaaactaaacagttttcaaaagtagaacacaatcatttcagagaaaaacaattgacgggtgttccagaaaatatactcctatttgctaagtcgtaatatggcagctctgcaaattgcccccttgattaggagggcagaaggaacttggattggatacacattcccaattaacactaacaaaatatcattctaacaacggcagcaggcatccattctgcaactacatgtcacatgcagtctcaacgttaagccttctgacggtatatagttcccagggaacgaaaatctggaaacatgcagtcaatgctaaccattcctggagtctggcctagatgttgtgaacttgcaataaacctaaatctcagatgcttatgtactgatttccgtaactctgaagaacttcaaaaactgttggaataaacaaaataaaggagtaaatcgcttattagattggcaataataacaaatgaaattttataataaggtcaataggtggtaacagaactcacgagtgagctgacaaacacagtgattaaaacgattccctaaaagctatagtaaatatttctgttttgaatcatcattgaccaatcaacagaaattcagctcaaaatagtcaatagaaaaactaacctagcatctaccagcaaatggcacctgataatagagggaggacgtttagatgtaacggtcatcaattttgacagagatggtcacttgataaggtaaataggtaatgtaattcctccatttcatttttcatatatgctgcttttctctaagaactaaattctcctcaatatataaaagaaaagtcaaagcatacctgtaatttcaaggaatgggaaacactttgagcatttacaaggttcatcatcgtagcaagtgtcagggttcatcaccatttttcaacaccaagtgtccatcttcagtcaagatgcagacctcagtgacagcctaataaaaaaacaatgtccctactttagaaagaatggatttccaccacataaacaaattcaaatgtatggcttaaatatcagggtaccatgaaattacagccagaataaagatagaaaatgaatcctcgaggtagccactgcaatcttaacagaacttgaacaatctcttacggttacaggtttacttaggtatcgtaaaagattgtctacatgagaattgctcgtatagttacaaaacatcggacatgacttgtctttgctagaattttcacttaaccccaagaaatgaaaggaaattgctgttatttgaagatatggtgacagctcacaggcaaattttagttttttgtgcaattactcaaagaaagaatgaaaagtcctcaaaaggtactagaattgccatgtaggagtgagggagctgtgtcttcatcattaagcacacagacaagctctagttgtatgatataatggattctatgcaacaaaatattttttcctgtagttgggtaacttcttttcttctttttatttttttgcaaaagctgggtttttcacagtatctatactactttaaaagagtcaagtggtggtggtgaatggtgaatctgccaccacccactgacatgtgggaccatgaagttggtgaatttgctaccacctactaccatgaggtgccatttaggagccactaatcaatagaccacccattcccaaagctatggaggatgggagaaatcatattcaacctgctccttgcaaaacacttcaactaagaatagttctctctcaaaatttcaagcgtgtaaactatacacaatattccagtgggttttgtgcctaagattgtaaacatcatccccactcgtaaaaagatagaattggcaattctttcttcgtacctaacataagacaccaataagaatgaagaaaaaacgattttaagaactaaatagagtgagcacctgtacattcacttttgacctcccacacagaaccactaagaaaccttaagcaaacaaatgcgtaatcctaacaaaatcctcaagaaaaccccaagaagacagtttaaaaaaaaacttaactgacaactggcatgacagacccctcccaagaaaagcaatgcaccaaaataattgaatgaggccagctaggcagaattatgcagtaacaggacaaaacttaaagacaataactgattccctccacacctgatggtagtctttttcatttagacctttctttagatgattcgctgcacaatcaaggatttcttgcttggttaatttcgaatctggatctttatcacggaagagcttaataagaatatttctgcaggggaccaagttaaccaataagtatggacttctctgtcaacatcaagatggtattcggagtattttcaaattctgcataccgtggactattcggcttcgcaggctttgcaacgtacacaccatgaacaggaacagcaacttggtttagtgacttttggagatctacaagaggaaatgaagcacaatttgttgcagcgtttgacagagcttgcagttttggtccatcctttctgtcagaagcatatttagctgccaactgcctcaagtctctacgaattgcttgaatactacatcaacatatatccaatgcaatcagcaataaaaagaatacggaaataagaaaaccaaatacaacgagttactgcagtacttggcactataaacagcactttatgcaacacaagtattggaaaattctgtacttgttcgaaacatgcaaatagaacgtaaaaggctaaaagctatcatcaacaagatacaaatgaaagcttttatattggtctgttgtcttgcaaaaagtgcctccatgcaaccatgaatcatctaatactaagccaggtaaagtttgtagaacaaactaacacaaaaataatatttaatgcaggtgaaacattggtattattctattcatactgccagtcctacaccctgaaggtgaatatctacaacccactgttaactgtagtttctatacaaataccacaataactaataacaatagactgcttatattggtattactgaaatactgaatgttactaggtaggcatga

SEQ ID NO: 51003 - DNA, 1633 bp, Oryza sativa
ccacccataccacccatgccacccatcatatcacccattccgcccattccacccattccacccatgccaccaaaattctataaaaaaagacataaagaaaaacattagtttaaaaaacaatatatgcatgagcaaaaaggaaatctaggaataaacatgaaatctgaaaagaactaattaccgaaaagtccattccatccacgttgacatcagcacctaaaaaataaaatatatgcatatcaaaacgttggataaggaacaagggcttatttacattaataaggccagattaaatttcctggaatatctatataattaagttaaaaaataatatattataagagcagattaggtccctaaactgatattagttttggggcttgaatgtggaatctaaacgagtgagacaatgtaggtttatatccaacataacgagtaataacagtttgtcctgcgcatgatttttttttaccatgaccagttgaaaaacaaatggaatgccttaaagagaaacatatatggaacattcttcaaattcaaacatgtcattatgtgctatgatcaaatgatactccattctaacatgttaggcgcacttgcttcatctcacttgttctcattatgctgctactagttgcgtcaaacatgagaaaacaagtccacagtttatcaccgcaaaagaagtgcatagcttaccatcatcatcttcatcaacccatttgtcccagtcaactttcacaaagtgtggtgccttttgatcatctcgaacaagcttcttccaccatttggcctcagctttttctacaatacagaatatggacctaacacctacacttattttgctctcctgtagaatcaaaacaaataaacacgggataaggaaccacgcattttaatatagaggaaactgcagtcatatagctattgcacgagcatgtattacctcaacatttactttgtcgttcaactctagctttgattcgtataagttcccatcagttccagctgtagcagagaaagagaatacaccttctggttccagattgaccttagcatccttagcatcagctaattgtacagttatgtaaaccttgtcaatcctctgagcccacttcacttcagggtgccgactacaggaaacaaaaagaaaaccataaaaaaaattcaattctgagcaccttacaagaagcaaaagaatgagggttagatccctttgaggttaaactccaatacaaatacatcagcagcctacaaaaatccacaagtttactgtgtgccagtaatatccatgctatatgaacaagtgacaagtactccctccgtatcatatttgactttttttctagtcaaatttctttaggtatgaccaaatttatagaaaaatttagcaacatctacagcaccaaattagtttcactaaaatgtaatgctgaatatattttggtaatatgtttgtcttgtgttggaaatattgccatatttttctataaacttggacgaactttaaaaaaattgactggaaaagaagtcaaaacgacttataatgtgaaacacagggagtattatacaaaatactgataaaaatgaaagttttcttaatgagtgtaaaatggtggtgtctggtgatcctatc

SEQ ID NO: 51004 - DNA, 6709 bp, Oryza sativa
tctactaataagagatatctaggaataagagataaactaattgcctcctaacagttatcagaagctgcacgcaccatggcatgaaccaacttagagcaagtttaataataaagccaactatgaacttatagcacatattagagttgacatgcatagtagataagctataagcttatctatatttttcttctcctctctatctcatctatacaattaacttatccatcttaaagtatgtgaatggttagctcttacatgagactgagacccaaccctcttcatttttcaaactctctcttccacataagcttacatttggctacttggcttatagcccactattaaacttgagcttattattactttattattaaactcctggtcgtcagtgcgaagttatcctcgttaactataggactatacgagcagatgatcacctccaattaaccaaataaaaccctggctagctcaataaaccacacgagctacacctaaacagtagctgccgcacaagcataattaaccaacccgacacagtgggaaaccaaagcagagagatctaccaacacaccgatagctgggggcaacccgcgcacgtgcgcggggacatggccgtgaactgaggcgcaccaccaaaaaccatctaaacttcctacggccaacccccaaccccccaaccctagcaacaaacagatcccacagaaatcaaaacacgacgaaccctagcgtcaagcccacgcccgcggaagggaccccacgggccctctcgcgctgccggggatcttccccccgcgtgcacagcggctgccccctccagatctaaccgctcccggcgctggacggcgcgtgcgggcggcgcggagtatgggtttctccgccgaatcgggagccgaagtgatgatgggagaggaggaggaggaggaggggagcaatcgctcacctcatgctgccgtttaccggtggaggcgacggcggcggcggcgggtgagggccgagggttttgcgaggttttttggggaatggaagatggagaatgaaggagtggagaggaagtgtcttgaagtagggaaacggaggcggtgctgcgagggggatgggctgggcttggctgggttctcgtgggccttgacttcgctgcaaccgaaagaaggaaaaagtccacaaggactccctcgaatataggatgaatctgattcgtatcccttacccataataccagatatcttgaccctcttagctattaaaactgatgcaatatgaatcctttggtggttttgaaggtggttttcgttgatgtagcatctaagtatcgcattgacttagtcttcgtcatctacgtggcattaaaaaaataaaacataatgtgtggggcccatgggtcagacgacggcgtgaaaccaacgggaccaaggcggcacctagcgaaagaagagcataaggcggcagctacctcgtcagcgggggaagtgctggccacgcacggccggaatcatctaggcgtcgttggtcttgccttggccacggtggggaggcgagagaggacgacggtagggaggactaaccgatggtggttggggaaacgaggatgatagcaaggaggccaaggcaaggggtgagaagggtatgcaacagcaaggaatgctatgatttcccagcggcgtttgcggtgttatcttctccaaagcccatggccgcggctgcggcgtgctcaacaaagagccacttgggcatcgactggagaaggaacaacggaagttgtacccaagggggacaaagggctccgagcgtcatcgtcgtccgtgatttggctcccagggtgctcgacattgcgaatggcaatggcattcgccgagcttgatatctcccccagcaccaaacccttcctcctagcaccaatgcagatttggcaggcgagcgagcgatcccgtccttcctgctagtcctggggcctcgcggaccgcagacaagctcaccaccacctccaatttctcttccacagggcactagtgcggtgccaacactcctctacctatcgtcgtcctctccagcctccctgctgcctactcgtccttcttgctcctcccaagggctctccaactactgtagcgtccctttctaccgatgaggtctgtcggtgaaatgggcccaggggtacacacagtaaagggaaatatctttcccatctagtcgcgtggccacgcggcctcgtttccccccgcccctcgggtagcgaggtggctagggggcctcggggtgcggtggccagggggcctcggggtgccacgccacacccctcgggctttcggggcgtgctaccccggggccctcgcccggccaccacatggtggggagaggaggcgaggcgaaagacgatgctccgcgcctttaatgcgcggcgccccaaccgtcccgcaccgcattcaatgcggcgtggggggacgtgcggcgccgctcgattgacccatgtcaatcgagcatgaccggcttgtgactggtcacaggcgacgggacggggggcagtgcccccatgttctgctctgtgtcaggcggagtgggggcatgtgtgccctgtcccgtcggcacgctgctaggggcgccccacgcgcgtgatgaaccgccgaagtcttcatgcaattaatagggaatgacagggatgtcccccgtgtcaggcagaggacagcgctgggccccacctgaagataggcgaccatgttgcttccggttgaagcaaaggatagcggtatgattaggaccatgtgggtcccccctttccgtggaggggtaagtgcaaacggtgcatgtggtatccccttgaactataaaaggaggaccgttaccactaggaaaaaggacgattggaggagaactcaagctcgaaggaagaacaactaggttcccatcggagcttgaaatcccttgtaaaaactcaccataatcccacacacaggagtagggtattacgctcggtagcggcccgaacctgtataatcctcgatctcccacacagtcccgacagcgatcgagcaactagactgcaagcggaagtaggctcctgtcatcgtgccatttcccccggccgaactcacaaggggggggggtctcacgaccacctgctagggaggatcactcctcgacaaggtcgctgctgcctccggttcctctttcgtcaggcatcgcgcatggcgccaccactccctcccctgtcgtcatcctctccagcctccccgctacctacccatccttcctggtgctccaaggggctaaccggccccgctgcattccttctcgtttacgaggtcaccaccacttccggcctcttctgccgggcattggtgcactgcccttggtcccgccaaggcgccaatcgtcgccctgaccacaagagagtgggagggaaaaagaggaagaaaaatacaattgttgacctatgagtcccatggttttaatgttttttttttttattataacatgtcaatgcaacacatggacgtcatgtcagcaatacaactctcactattaccttaggagtaattttgtacaagttttaatagctgagggagtcattataccttgtttgacggttgagggatataaatcaaattcgatatatatatatatatatatatatatatatatatatttaatgtagtcaaagtggactttttccgtgaaagaatggcataggcctactcgtgctacaccaaggctccgtttagtggaaacatataacacaaacttcgcatgtatactccctgcacacaaactactaaatgtcacttacgattctcgaaaagtttacgcatataatttctaatagggttacacctatgtgtaactcaaactcattatattttagcctaaaaaatctgatgtttttaagaatataaatatttagaatttctctctgtatatatgatgaatttaataataaagtttacacgttgatgtaatagtattgaaaatacatgtgcatttttttctagagttttatgtgaacacgatatatacacgtgaaaacttgtgtgcatataacaaatttgctataataaaatggtaaaagttgaaagtataagggtgatataattacgtttatacgagtttaacaggctaacttgcgagtagagccaaacttagttccttaaggttaaaagagttgaaccgagcaggctcgttttgattttttttattttaagaataaatttcacttcgggccactttttattactgatgtttcactttggaccaccctttaagcaatattttcactttggagtgggtaaacctgcctttgtttcactttggaccacccgactctcttctcaagcatatgaacgatctcgattacatcatctcctactcgtcaatgaactgccacagctatatgtaagactatttcttcgacatattaaaaattggatgtagatcgataaaagagtaagggtggtccaaagtgaaataaaggtaaaaatacccggtccaaagtgaaaacattagtcctaaggtggtccaaagcgaaacatcggtaataaaaggtggtaaaattaactcttttatttattaaaatatttacataaataattttctatttgaaaattttacaaaactagtcgccctcgccgcccttttacaaaacttagtcacccaccgcccatcgctcgttccatgagttcagatcacctcactaatgtatgcataaataagtgagtaggcgatgacgaatgacctttagataaccttattcatgtatgcataaatgtgtagatgatgaaagactaataagcgcttcatgcgtgcctgcgatgtacacatttatatggatgaatacaattcataatagaagattccgttctacatatggatatggtctgttgcatccatgaatttcgaagtatttgaagatgcaccctcagtgagttgataaccaccattcacatggttcaaaaacacgagtgcatttgaagggagccacaaagatgatactacagttacacaacataaaagaaaatcccgaaaaagtgtccatttattgcagaagaggagtctatgtttatgatttgctagcagcttctgcctgttgaactgtggcaccaggttgagcagaaactgctgctgcagcagctgatggagaatacaccttagctctacgaagaatctcggcaacaacccagtgcttccttttgctcaagggcctagaaggatcaagcttaacctggagagaaattatccagtcatcatcaaaaaggtttttcttggagataaaaaattaatgcgctcttaggtcgcactttgtgaactacaaaagggggagattagtctccagcaagctgataaaatagaaaagtgcagtaggacagctcaagatcactaatatattcgtcataagagcaaatatgttagtcccaacatatttttttttctaaaaaaaaaatccctgtcacaaactcacagggtaaagttgaacttttatgctgtctttttatttatttatttatttattttaacaataggtggtgcaatcaatagtcagaacataaaagtttctgttaaatccagtcccttggtaatgtggatcttcgggcgcacaaaacaaattaatttgaataggcaaaatcttatgatgtgaatatgttaacactgttatcacatttgcataaagcaaaactaattagaaagtggcatgttaacattataactatgctttgcaacaaattatctttcagacctccgtccatgctttgccaagttgccatatcacataagatatgagaaaattcagaggcaaaagattatgccactattaaaatctagtacaaccatcattgtcaaaattctcatggaaagattgttttgcatctgatgaagtaactagcttactgaagttcagagcccccaaaaggggcctctcttgtctggagttgacactcctgattaaagggttggcttactgtttagtgtatcaattacgccaagaattaaacttcagattgtgccttaactttcagttgctaatgttatagattgaggctataaatacttgacatatcaaaaagctctggtcaagaactattatgtgcttatgattaaccctcaaatttctgaactatatgaaacaatgtacataactaacaccaaaatcaaattacaagaacacaatatttaagataacttatcacggtggaaaaaaaacacaaactgtaactcaaagagtaccactatgcagtagtgccctagtagctcatatatgaacatcataaatagaaagcagtagcatataatccaaacagttgttcactgccgagagtagtaaaatacaaaactaatactaattgaagttgttttcagaaatactatcatggcattgttaacgagcagatatgcaagcagacagagaaatgtcaactcttaaggattaggtgccatgacatgtaatgatgtcaaccatatggttgcaacctccctacaggcatcaatttaacagctggaactatacagaataggataacaatccacaatactgtaacaactagttttgttacaagtcaaactccttcaagtttaaccaagttcatagaaaaatgtatcatcatttccaataccaaacaaatatattataaaaatatgttcaatggcggatataatgaaattaatttggtgttataaatgttgccacattttacctaaatgtttggtcacaattaaagaagcttga

SEQ ID NO: 51005 - DNA, 1203 bp, Oryza sativa
tgtgcataagggaataaagaaattttataagtcaatggtggtggcagtgaatcagccaccacaccaactctacagtagatccttttatcaacacattcctgaagttctttagtattacaaaacagtctttctacatatcttattccgcctctaaaatacaaatttataattcgaagctttacgataatgaaattgtcgcatatatatgcagtataaaagtaattttatgaccagagtaatgtaaaagttgtcaagtgcttcatgtaacttaaatgacaagttatatataaatgaagggtgtgttcaatgaaaaaaaaactcacaatcatttgtttgaaacaatattacgagcatttagctggtgaatgaataaattttagatgatatagcattatagccaaatgaacgacatcacaccagagaaatcaaatgctcgcatcacaaatcagcatggattaaaaaaaaagaaaaaagctgaaacagagagagggggagtggagaggggagctcggttaccgacccggtcgccgatgttacagtcctcggtctcatcgtgcgccatgaacttggaggtgcgcttgacgtagcggttgtacatcttgtggtggaagaggcggtcgacggccaccaccaccgacttctgcatcttgttcgacaccacgatccccaccaccggcttcatcgtccgtcccgcccccaccccacccgcggggagaccgcccgccgactggcgatgggatcggccggggactggcggcagagagggcggaggaggccgccggcgcggagaggggggcggcggctgcggctcgccggctgcgcaccgggagcggagacgataggcaagcacgacagtgagtgaggaggggggcgaatcggttcgattgattccaagggagaagctagggtttatgacttgggcccaggatgctccgatgttgggattttaagttgggtggcccgcgggcttagatgttgttctaaggggcccaattggggaacgaagcctgggcgcctccgccctttgtgctgttcgccgtacatgaaccagaatagatttctagatcatactcctccgttcctaaatatgttctagatcatacgccattgattttttaaaatatatttaatcattcgtctttttttaaaaacttttttgaataatattcaaaagcttgagtagtagtattatatttaacaata

SEQ ID NO: 51006 - DNA, 1915 bp, Oryza sativa
gttcacccagactcgcacagttcatgctcatgcgtgaaggaacggtcgttttcttttgctccttttgatagaggcgctaccgctaccttacccttacctagctaagctagggtctcccttcagtgacaatgatcaacgatggagtaattccaacgccatgagatccgtgctgttttgggtggtataattggacgtgtttggttgcctacaaaagcttttatcccgtttatgtttctatcttgttttgtaattatatgaataggaaatgcatgtgaaaataaaaaacggttttgttatatatttatcagcaaattttctaaaaacatattgtaacttgcatgtaattatagagtaaatttcacgaaaatagtacttcaaccaaaatattagaaaactacagatttaaggtcttctatcataaaactacaaatttagtgcagttagccgatgcttatttctcggatactgtcattgtcattgttcttctctgagaaaagaagttgacgacccgtgggctttcacctccacatgacattgctccatcaggctttcacccattgcagatgcttctctcatgatacaatccgcttcctgctgagcctcctttcttcttgatccacagaaaaaaaaatggagaactagcgctgacaatttatcgcggaagaaacaactcaccgaaccgagaacactaactaatagaatagtactactaacttgtactaatagatcccgcagaaaaaaaaacttatactaatagatatcaagaaatagaaacaaactacaagtctatataacatagaaaaccaagcagccatgatgggtacgtgtgcgatgaatcccgttccccctcctgatcttcctcttcatgcctgactcgttttcatcacctgaagctaaaatttctcacaaaactatagatttaggatggagtgtaaaaaaaactaagcagcaattttatcacaaaactataggtttagtgctaatttatcccaaaactataacatttatagctccaacataaagtttgcaatagggatttaaactctagaatttgtatccttgtgataacttcaatatgaaatatgtacttttaagataacttataatataaaatctatagttttgtggtacttggtcttaaatatatagttttgtgataattttaccgctaagtctgtagttttttgatacaacatctcaaatatgtagttttgcgtagtttggtcaaaatatctatagctttgtgaaatttactctatttataatgtagcttgtatgcaaatttcatatattttgaaccattagatttactctaagattcatgctagtgggaaagagaaaatcgtaacacacacgggtgaggggatttggtcccatgacttccgctttgcagaaatagctccacatggtgggatttttcaaagttatatccaagttatactatagttttatattataattatactataattacatttgataaattttgataaaaaaattgtcaataaatatatatatagataatcccaataaaaaaatacctctactaagttaaaaacggagtcgtcctccttccatcccctcctcccaccaccacggtgtgtccgtacgctgaaagtaaacacgacatccaatgttttatctttaatcacccttctagcttatctctatttatatgagcctggcccattacaattgttacaaaatactccatcatagcatatccctatttgttcggtttggccatgatattatcgttactagtttaaaaaaacttaggttccatgaatatctcacgtttggccggaactatctagaggtttaggccctgtttctttcagcttgggattattataatctagattattgagtcagattactataagctagattgttataatctgtagtagaataa

SEQ ID NO: 51007 - DNA, 745 bp, Oryza sativa
tgttactcgccctacagactcccgagcatccaggacgaacacgagggaaatgtgtgattccctggaagattggatttaaggaggacatccacacgtacaggagtcggatgaggagcaagagagataccgaggcgaagattgcagatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgtctcaacggggcaggtcggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccgcaagttgctgcttaggttgattactaatagataacctctcatcacgtgaaggtggcgtcaggaatggccatcccaacggacccttccgggacttaccactacaggccgattctagcaggatactcgagtgtcgaagttgagttggtggaagccgcgtacgaggacctcgagttggactacccaggaggagacggtgagacgcatctacgagacacaagccacgccatcatactatggcgcaagcagtacatcatccttcctgggcgacaagcgg

SEQ ID NO: 51008 - DNA, 1512 bp, Oryza sativa
ccccgcgctgacaccgccgtcgtctctcgccgtcgcttggcggtcctcgccgcctccgccgcagactccgccgccgcatctcttgggtgagagccaccgctgcctctctctctctcgatctcgatctcgatatatctctctctccacggccaacgaccgacttcgacgcggccgccgccgccgacggcgccaccgccactgccactccgccgcccccgcctcgagctcgccacgccgccgcgatgccacgccgtcgccactgccactccgccaccaccgcctcgagctcgccacgccgcggccgccgcgcgccgctgccgcgcccccacgccgccgggccccgacgccgccgccacgcccgcacgccgccgggccggcccacggcgccccgacgccaccgccgcgccgccacgctactgccgcgcgcgcccaacattgccgaccgtttacgaacgtgattgaaacgtgaccgaacgcgaacgagcgttacgaatctttgacgaacgcgaacgaacgtgcacgaaacgttaacgaacgcgaacgaacgtgaacgaaacgttaacgaacgcgaacgagcgtaacgaaacgcgaacgaacgtaacgaaacgttaatgaacgcgaacgaacatgcacgaaacgttaatgaacgcgaacgaacgtgaacgaaacgattacggaacgcgaacgaacgtgcacgaaacgcttacgaacgtgtatgcacttgtactaaaagtgtgagaacgaacgcgtttatactaatacgatttactggtaatacatatatgattatatatgtaacttggcccgtttagactaatacattttcctgataatgttgcagagaagacatcgtcgtcgtccctcaagccgaagtggtagctagccatcgaaggaattcgcgcaggcaaatgatgtaaagaagtgattgttagatatttaatataagattgttagacttagcatatatgattattacaattttaatataagattgttatcgatttaatataagtttgtaacacttagcatatatgattgttagagatttaatatattattgttagacttattatatatatgtgactattacaattttaatataagattagtagcgatttaatatgagattagtagagatttaatataagattagtagcgatttaatataagattgttatacttagcatatatatatgattattacaattttaatatgagattagtagcgatttaatataagattgttagacttagcatatatgattattacaattttaatataagattattagagatttaatataagattgttagagatttaatataagattcttagacgtagcatatatatatgattattacaattttaatataatattagtagcgatttaatatgagattagtagagatttaatataagattagcagcgatttaatataagattgttatacttagcatatatatatgattattacaattttaatatgaaattagtagcgatttaatataga

SEQ ID NO: 51009 - DNA, 1506 bp, Oryza sativa
atcatattaagtacaacaatagaaggaacaaattattaatcacagagttccttttacctgcagtgtacaagaagcatttccctcctttgctgacggacaacgtctggaggctgaggaacataggcaaagatgggccaatcgacaagagattggaggccgaggggatcaagaacgtccaggacttcttgaagcttaacaccatgaatcccaacaagcttaaaagtgtaggttctcctgtttcaattttgttcaaacactttgggggattatagttcataatttgtataatacaaattatttctgctttaatttgttctgttgtgcacacactgttcagcttgttggcatgtcagatcggcagtggagcgcgacattgaagcaagcaaaatcatgtgacatgggagggaaatgctatgttttcaaatctgaaggttgtgagattaaattcaaccccgtaggagagatcttagcagtgagattcggcggtcggatgtgctctttgcatgaactgcttccacaccaaatggtaacttccttcattccaccaaattaattaatccctgtatggtcaatgaaatttgattgtcttactaatttcttaagattaccttaaatttgctttgatctcaattgcaggtccaaatcaagcaattggtcagccaagcataccaacagtgggatcagatggaggaagtgcagaatgagatggcacttgttgataaaagctaattccatttcatgatgaaaagcccatgatttcttcaggcatgccaagtaatgaaattgctgtagctccctgactttgtcagctttatttttaatttcaaaaaagcatgcattgattccttggaccttattatttgcaggctatatcaatcaagcagagggattgatggagaattcaggatgggagccaagtgagatgagccaggaaagcatgatcagctctgcatctcagaatgccatgtatgttgacagcttgggaactgcaacaacctcaactgctgaaatggtgaccaataacatcagcactctagaacctgcatcaactgttccagattctgctttgtacagctggaattcgggcatggctgctgatgatcacttcagctggcagaacaacacaaaccttgtaccctgggatcatgctaattgatcattgctatctggagtccgaacaaattaatcctaattgctatcggtttagatagctagtgttgttatgcttttactcaaataataaatatgttcatattgagggagctgtttttttttctctaatcttaggttgtttggctcttatcttttcttaaccttgatgagtgcattttgtagcaatatctactggtcaagttagttattatgaaaaaaaaatagagggtcacatacgtcttccctattaattaatgcaatactggtagctcgtatatactagcactggtggagaaaccatctttcgtcggtcgggctaattccacaatagtcccagttgcaacaaaaagggta

SEQ ID NO: 51010 - DNA, 14160 bp, Oryza sativa
  unsure (1)..(14160): unsure at all n locations
ttcctttcatcgttgtagaatggagattcaaagggcccgacggcggagggtctacgatactgggttcatcgaccctcggaaaatcaacaccgaaatgatcgacaagtacgagaaagacacagaggacaatctcgtccatctcctaacgcagcaacattcaagacgtacatactactgccgtacaacacagagtgagtttttattgtcgttcgaacanattttgttcccatacatatagcatgtacatttttgatcatatatatctcttctcacgcatattccagattccactgggtcctgttttcttcgacttggacgcatgcagagtcactgtgtacgactcaatgaataaagaggagaagatttttgataaggtcttcaaactgatagacaggtaatataatgccatctattccaaagtcgcggggaatctattgctattatgttgatctcaagtaataattaattaatcatagcttgcaactgcatatgtagggcttgggatcggttccgtcaattggtccgcgggacttggaaagaaaaacttggacggaggtttgattttccagtgagtacatgcatgatccaaaattatattggattgaatctctaattacagttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtaacatatatatatgcacataaaatgttaagtgctttaaattatacatatgtctgtgtaatatatgatttatacatacacacacacacacacacacacacacacacacatatatatatatatatatatatatatatatatatatatatatatatatatatatatatatatatatatatatatatatatatatatatatatatgtctatatantatgtatatatatgnanngagacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacagcagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttatcatgggaatatgttatgcattgacatataatagggttctttgcaaaaagcagtactagacaatctggaaaagttatagcaagaatttataaaacatataaactttagatttctaaccagggtaccatatgagtcccagtactcaactccatgagtacggctattcgaatagtttcaaagatattctactgtagcagatgtacgctttacccgcagtccatgacttgctgataatcatcggctttagtcatggtccagtattaagtcattaacaattgtggcacctgttccatgaactcatatcctcatatgctctgaatgtaatgttaacagcagcaagaggagttctggcgttcccaaggtatttaaggggaactgatcgtatgacaccacgtcatctcgatcagggtttagaaatataccatatagtttatactcgagtatcacaaaccatttacctgtacatggtaatggttaaagtttcccttcgcggctatagttgcctcctgcacgaggacttaaaaataagaaccactatacagaggtgccatattgctaattaacataataactaggtctgtccctattctagaaactgcggtcgtactcgttcgttcaacataagtatctggtaaaacttatattgattgagacagtactagccacccggaaatcagccaaatcttacgtactgtcccaatctaagtatagggtattttaaccagattgtaagcaaaataagcaatactaaattatctgggtttctatgattgatttatgcatagaaaatagaatattgaatagaaggctataagtaaataatttataaaatataggcttgaatgatcaaaaggtatatggtaacttgccttgctcgatgtcctgagattgatggatattatctattgagtcagaagaatcctcaagacctagggttagacatatgtaaaattcaaatttaaaaggaattcaaatgaaatccaaaaatatgaaaaatagagaaaataaaataaaatgcaaaaatagcaaaaaggggctcaaaagatagagaatgattttagaagaatattggtccaagtttcattggaattggatctatattttaaaagatatgagcttctaaagtttaaaaatcaaataaaagtgaaatggcactgtgtgcgggtcccacctgtcagtctctctctctctctctcttctcttcttctaccttcggccgtttccccaaatgcagccggcggtgctagggtttgggattacggcggcgatggagggggaaagtggttgcggccgaagaggggagggagctaggtatctccggcgacggcgatcggcggcggaggagctaatttggtatgtggatgggttggcgactagggcggcggtggtacggttaggctgtaatggtgatcaaggtgatatgagttagacatggctaggggagggggttctagagcatctacgaggtgtctagagggattccggcagcttgccgacctttggcaaggtgcggagaatagttgccgacgagcgcctccataggcggcggccgtgctcacatcggcagcttagaggggagcatggtagtgcaaagggattgctaaaatggaatctaggtagtatgtagatggttgaaacggaaaaactcaccgagatcggttgaaacgacggatgcggcccagaaaaacttcgcggcggtgaagaacagagcagcgcgggggcggcggtgctcgggttggtgcggcgaggtaaaactcgacgcagagcttcggttagggcttactatgctagaacatggttgatataaggtgttctaagggatatttagggcggaggatggatggagaggggtggagtcgatcgcgcacaaggtgttcgaccgacgagggatggtggttgatggggtggattggcgaagcagagcttcggggttgtagggctttgattgttgatgatggatgatggacaaggaagggattggggtcctatttatagggctaggaggagcggatgagctcggacaccgtcatcgccatggatgagcttgggatttggatgaggcaaaggtggcaaaggctgagagagggcgggaaagatcgatttgagtggcgggaggccacgttcgaatacttaccgatgaagtattgacttgaccgcggttggaatcagctggcgacgtgagggcgctaatccgggcgcgacgcgcggcggcggcgagggtgaaaacggctggctcaggggtgaatggtttgaattgtgagaggagataccaccgtctatcttcaatctaaccgtgcggcaagaattggcgcgattcaccctgggtagaagcgaaatcgtactcggcggcagctttggacgggcgcgcacggcgtcgagcggcgatttcttgcggcggtcgtcgtcccggctttgtcgtcgtcaagattggtgcggcggcggtgggctgagggcgtcggacgggcgacggtgcgccaaggcggtcaggcacgcgcaagcggccctgaggccgacgcgcggcgacacggcgcgtggctaagtcggatgctcgggcggtgcgcgtgaaggggaggatgaggcaaagaaagccacggttttgagtgggttgtggtcccctaggaccaaatctagactttgcacaagattgggtaggagttgggctgctctagttgggctagacatttcatcgagcaccttgtgtgcgatgaacagtgaatttcagaatttttgaatatttcctataaaaagaatgaatttaatctatgaatttgaaagagtttcactagggtttgaagtatagcaaatcttcgatgaactaagaaaataatctatggtttgaaatttgagagaatttgctcaaattcactagggtttggaataaagggaattattagggtaaattagtagggctctaagaaataaatacttgaaccaatttaagaatcaaatagatttttaaaccaaacaaatttaatcaaaagccagcatgatgcagtcaaattttagtttaaaatttgaggatgttaaatatggttgccattaaaaatattacaccactaagttgtactccctccttttcacttataaaacactttaatttttctcattgtcaaacctttaaatttatttaagtttatagaaaattttagcaacatctaaaattctaaattagtttattaaatctaacattaaatatattttaatagtgcgcttgctttatattgaaaatattgctatgttttaaatataaatttagtagaacgtaaaaaaaagtttgactaaaatttttttaaagcgtcttctaatataaagcagagagagtaagaaccagagaaaataatattaattaatcaaacaatgcatgaccaactcttcagtctatttttttactttttttagaggaacttaccttttcagttatgtgaactcatcaatttccaccactctagaacgaggcagtccggcctagcacacctccaaacatgtaaaagcccttaccacccagcctaggctcgtgcaacccaggcagactaatagggctggctcgagtgggccggattgtagagtaggcccatccatgggcaaggcccagcacaggtctacggtgtctagcggcatgatcttgtgatatccttcatgatctcctatcctctcactacatgctctctctctctccatcctaaaatataaatagttttgaatcgatgggacacatggcagatttagatagattgtcagtctagatttatcatactaggatgtgttctatccaaccaaaacttcttatattttaggacggagggagtactacacagtggcaaacctagaacggaaattatccagggtccttaacctgtcataacacatataatactttaatttttaactaatacaatatagttaatataagctaaaacatccaagtattaaaaattacccgggtccggtaaccacagtagtacggaacaccccttatactacccccgttttttaatatatggcgtcgttgacttttttacaaacatttaaacatttatcttattcaaaatgtttgtgtaaatataaaaatatttaagttatgcttcaagaacatttgatgataaatcaaatcacaataaaataaataataattatatttttttaataagatgaatgattagacgtatcttaaaaattcaatggcgttatatattaaaaaagtaatcattgtagatattttttgtttgttcgagctatgtgaaacacggagaaattcaataattggacactttttagtttccaatttactttaactaacacgtgtgaggatgatattgttggtaacttttttgacaatttgataagcacgatcacagcacctaaagctttgcggtgatcctagagtcgccaaccacctcaatctagcaaaagctaaatcaagatgggttttgataaactaaactggctaccggagccgatctagatagaacgatagataactacccgtctcgtgggcaaaacggaaggttttcaggataaacctacaaagatgtgtcgcactctcgcagcgacggcggatgatttacagcgcaaatcaacaaagatggacaaactaaactagaattagaagcaaaagtaaaagaacgattcgattgattgatggttgattgtctttttacaatgaaccggacttgtctcttatataggggttggtcttgccctctacaggctctcctccacgtccaactcgggctaaaaaccaatggaaacccaaaatatgtctttccgagcaaggaaactcgagtcccgacaaaaacagaactggactcggattctaccggtaagactgactacacactgtcggtctgactagtctactagcagcggtctgaccggccgacatacggcggtcagaccaaccctcttagaagaaaaccggcggactttcaaactttgacaatttttcctattttatttttaggtgccaaatttagatgtaaacagatatatgggaccataagcgggctaagatatattaaataatgggagcccgacttgggaaggatcaaattattaaatatcttgtactgctgcttactagctttcttcgtgtgattcatcatgccaatcactctcccgcaaacaacgcagccaggatgaggtcttgccggctctctctctcctcctccttgcgcttgcgctgcccactcggcaggcgttttccaacaagcaaccgctccaacccacttcaatcaatacaagaaaattgcaataaccacaacatttgagtatttgagaaaccatttgtagtattagcccttgtactatactcctacatatttatatttgggttttgactaaaacgaatggtcaaccgttatatgtaaagtcaaattaaggtgagaggtagcagtactcgtcatacgtacgaacaaaacactgtcgctatttccgatggagctgtacacgtacacgatcattccaatccaatccggatcggtgtccagttcagcctgtacacagagcctatctagtcgaccatgcaatgcacaatctgtgcgaccaagaaaagacagatcagagagaaagaaaacgggaaattaacccgcagtagttgccgcccgttccttccaccaatacgtacctcgatggagatcatggaagagccgccgccggcagcgggaggcgacgacgatcgcgaggtggagctaccggaggacgtgctcgccgagatcctccgccgcttgcccccgcgaagcctcgctgcgtcgcgctgcgtctgcacggactggcgctccgccatcgactcccgccggctgctacgccctcccgctgtcgctcgccggcattttcatccacttcaacgccctcacgttcccggagttcttctctcgtccatcttcgtcaccgacaaccgtaaggggcatgctcgacttcctgccacccgaagaacaaagccccgacatcggggaccactgcaacggcctccttttgcttttctctctccttgtggtaaacccggccactcgaaggtgggcgcgcttgccaccattgccccgcaccttcgccaagctggaatctgggttctttgacaaagaattcatcgtcttcgacactaccttatcgccgcactatgaggtttttaacatccaatttgttgacgtcggatggtacaacgtaaaaacgatggatcccgtcttgaagaaatcagaatggccaccatcgccgctcgtcctccatgtcttctcatcggcgacagggcgatgggaggagagatcattctctagagaaggggatgcagccggaaccgtggctagcgctcagaggctgtgccggccggagcagtgtggtactgtctattggcgaggagcactctacgtgaactcgtattttgtcatgatgttaactttagcgttaatatttttatttagtttcaacttgtattccgttttcatatttgttaatataaattcttatgtttattttgttcttcgtagggtatcatgtctgatgggacgacctatcaagtaatcaagcatcccaaaatttacaagagcaaacaaccaccatatatttacataggaaaatcagagaaaggagtgtacctcgcatcacttcatatgctggactgttgccttttaatttggatcctcaataaatcatgtggtcagtttaagtgggtattgaagcaccaaaacaaccttaagcccatgctactacgcctgaataatagtaaacaagatcacggaccgtagatcttacaagatgttaactaccatctttatagtcaaaagtttccaggagagtgggagttatacaatgggaactatgatccctctcattttcattctccaaatgatgatgcaccggcggaaaataactttgaatggtattccgatgatgataatattgtagaaaatcaaggtaactgtgaagagcacgatgatggcgactaccttgagttgcttggatttcatccttataaagaggtcatctttctgaattctatatcaaggaaaggattggcctatcatttgaatagctcaaagcttcaacatttgggtaacttatacccaaaacactataaccacttcgcccaacatgaatacataagccaggcatttccatacacaccgtgctgggtcgatgagttgcctgaagctagtacttcactagatagtctccatcaagattagcatgcacgttgtttgcatgcggaactctcttttgtaaggcttttggtttgtaatataatctcaagcaaagcttccaagtaatgaccatatatatctgcatacgtatatcacgttgccactgctctaatatatatttgtgacatgagttagctataccacatagaccatgaatactcgattactgtggttcgtacatactctccatctcaaaatgtaagcatttttagcataatagtaagtcaaacatttttaactttgactattaataataaaaaataaaaaaaagtcaatcatgtaaaattgacgttactatatttataattaaacaaactatcataatatgcaaatcttattatttaaaacatcttatttttatagatattattgatcaaagtagcttaggacagagggagtaacaactagtaacagtgcacgtgggaggctcgttcccacacatataattgcaaatttattagagacaatccattatatgccactgagtttgtcatagctctacgatttgccactgactttgtcacgttctataatataccatcgacttttacttaacttatatgatttaccatcgccgtccagttagtctccgttagtactgtacaattttgtccaaatgaccaaaatacccctaggataaaacttccaaaatgtggacaaaaattccgaaataccatattataaacataagattgtaaacattcaaaatttgtccaaaaacttaaagtctgacatttcagaatttttatccaaaatttgaaagtttttgtctcaggggtattttggtcatttggatgaaagtgtacagtactaacggagactaaccggatggcggtggtaaatcgtagaagttaagcaaaaatcgatggcatattatagaacgtgacaaaatcagtggcaaattgtagacctatgacaaactcagtggcatacaatggattatctcaatttattatgttttcccactgtgcatattaaacagaccatataaatgtgaagtttaatatgccacatatctctccgtttacaatgtgtcatataaacggaaaacaaccaatgataccaaatatacaatttgcgatagtttgataaatgtttggcataataagaagtgtataattgcaaaaaaagaaaatccctaatgtaggttatagcttccttggtctcacctggttatgcatgtgcatatatgcctgggcaccgtggcttgttgacattcctgacaggtaagaaaaccctgaaaaacaccaaatagaacggaagaaaaagcgaaaagaattactcgtggaaagtatcggcaatccctaccagtataataaaaaatcattatttctataatgatgcatttagcataattagttactactgttttcaaggtagcacacaaatgttgcatttagcataaaagagatgaagagagcctctggtggattggtggctagtggtgcactggtgcatcagggtactgcaagcagcgaaatcgccgactccgctgagcctcgggttgattgccgatgtttgtgactccgatagtggagcgagatcgatgtcggcgactgtgacgccgatctggtgacacgcggcgtgcaacgatgctctcgaggcagaaatcgacggcggcgcgatgcgtgggcggaggggttgcgaggaggcgtcgctgtgcagttggtgtgagggtggggcagcatgattttttggatgaacgcgagagagaggatgagtccgggtctctgggagggcggagagaggaagggggtgagggaggtgggagcgtcgtcgggcgttggattgggacaatcctgaccgatcaatgagaaataaggatgtaaaaatcaattggtaaataatagggtagaattcagtttcagcaaatatagaaataatggttaaaaagcttacagtcatagggcctcatcttttcacttgtgcttttttcttatcaaccaaaatttgaattttcaattttaaatttggagctgattttgagattttttttattgatcgctaagaacacgtatataaaagttttattcacaaattactttttgttagtgaaacgatggctgcgatatttcatcaaattagaatttaatatgttttaattaaattttctcgttttttctttccgttgcaatgcacggacacttttgctagtacctaattaagaaatacgcgaaactcctgatggggatcgatcggccctagcgatcgggttgccccccatctccttcacgtggtttctttttttttttgcaccgcattactttcctattttagtaaatttatacacctgaagtttgtacacctcaagtttacacatctaaagtttacagacccaaagtttataaatcaaaagtttatatatccgattcaaatttaaatttgaattatctccacaaaaaaaattaaatttgaattcaaatattttttatataaagtatttctatacatctaaagtttatacacctaaagtttatagactcaaagtttataagtcaaaagtttacatacccgattcaaatttgaatttgaattatatccgattcaaattggagtttgaattatatccgattcaaatttgaatttaaattcaaatattttttatatatagtatttctgtacatctagtctatagacccaaagtttataagtcaaaagtttacatacccgattcaaatttgaacttaaattcaaatattagtttataggcccaaaatttataagtaaaaagtttatatacccgtttcaaatttaaatttgaattcaaatatttttccatttcaaatttgaatttgaattcaaatattttttatatatagtatttctatacataaatttttctaattttttttatttttttttaaatttatggtgtagtaggaagagaagaaggggaggaggaagggggagaggaatatataggggatggggcgagcgatcgcccatcagccacgcccagaaatacgtaaggcttcagctaaaaaattttctccgtcttcccatttttgtctttttcgccgttttcctttctttttttcttttcccttttttccgttttcttccatccgaccgtctctttttttttctttttcacccttttttcctttcctttttccttttccattttttccgttttcttccgtccatcttttttcgccggtttttcctcttttttttctgtccttctctttcgccttctttttccttttttttcctttttttcagtttttcttcatcagctgcttttttactcttttttttcgtcaccttatttttcaattaattgcaaaaatcgattccccgttactcctttatcatttttcccatttttacctttcaattctgttttaattcaccggatttagtctttatttaaaagtcaatgtttttatcccgatttttgcggattcgcttcgattttgataaaaaggaaagagcagatcgattgtataaaagccatcaaccaattttggaaaatctagaaatatttgaccggatttgatggggaggatcagttctggcattatatgaacatgagatgttttcaccattttccagaggttgaagacgacagtcagctatacgagctggagctacagctctacttgtgggttaggtcaaagagaagcagtctaagcaaaggaggtggcggtctaggctgaaactgaaaagaaaaaaaaagggaataagcttttgttcaaaaagcaaagagtaaaatgtatagggagcttttggtccaaaactaaagaatctaaaaatatttttacccatcgcaacatacaggtattttttctagtgaaaactaatatccaccgaccaaatctagattagtctaaatttataatagaaattaagcacgagtaacgcgttgcacgcatggaacgatgaaaataagcacgatgaacacgtacatgattgcacaagggttagctctgatcgaaccaccacatgcacgctctctcgccaacatgcagcttataagcatctttagtggactaaagatccggcctgacaccctctagcaaccggcgaaccgacactaaagatcatatagtcctgttgtccttaaaaaccaggactaaataatgacgtttagtcctggtttataagagaaccgagactattgtaaaatttggccgaccgatcgaagatcgtttctccagtagtgttacttagtaattttatctaattaaatagcaatacaacagcatataaattaatatacacaggtcaacactgttatcgtcgtcaacataagcaaattaatcaagctagctagccttttgccattccaagttccaaccatggccagctagtggtgcacaagggggatcaccatggtctcaccatcaccctcctcttggccgcggccttcttcttcctcatcctcctctcctcctccctcgtcaaaatcaacgagaaaccgcccaagttagaccacaggaagctagcagctgcagcaggtggcacaaatgtcgtggaggggcggatagcggtctgcctcgtcggagcggcacagcggttcgagctcaccggaccgtctattgcgtggaatgtgctagcgccgcagtacccgcacgccgatctcttcctccacaacccgctcgaccgtgactcctacaagttcggcctcctcaaggacgcgccttgagtggttgcggttaggttcttccgcccacgacatatacccgagacaattcgcgcgcatgccagactccttactcgcccatgggtgtacgggtaattttgcagctctcagtttcgttgtcttctgtttgagaaattaattaattctgttttcacaaaatcatctggaaagaaaaataaaagaataactttgtacacactactaa

SEQ ID NO: 51011 - DNA, 2043 bp, Oryza sativa
  unsure (1)..(2043): unsure at all n locations
taccacccaccgacacacccactcgcctgctgtcgcgcgtcttttgtcgctgccactggatccgggcggaggacggccgtcgctgccgctcgtctgcctgtcgacgcgccaatccacccgccatcgtgctcctctcgcctttgccgccgctcgccatcgcgcctgctgtcacccgccccatcgcccccgcccaaggtcaagggcggtggatccgtcatcaccaaccctccgtagtgctgtcactgtcacccgcccaaccaccgcccgtccgtcgttagtagctgccgccaccggtcgtgcgggcgccaagcccaccgtcggctgccgagagagagagagagaggagaggaggaggttatagagagaggactgagaagtggtggagagggaagaggataagaagagaagtggtggagagagagagaggaccgagaagagaagataaggttgcctgtgaaaattttttgaagtggtggagagggaagaggagaagaggagaagtggtggagagagagaggaccgagaagagaagataaggctgcttgtgaaatttttttttgaagtagtggagagggaagatgagacaaatcagacttagcagacccttacgagacccgcattcaaaaatgattttcttatgcggacctcttaagggtccacatgcaaaatgagcatacggcccctaaagagacccgcatacaaaaatgaatttttgcgggcctattaaggagtcgtatgcggaaatgcctgctcgatttttacaggtgcgggttgttatggtctgtctgcaatctaacgaggatctcgttcagaaaaatcatttctgtagtggtgatattatgtgaagtattttgcccaaatgttagttttttttaatatgtgttgtcgtgcgtttcatggcaatttggtgaaaaaaatctataacttgctaaagctaactagaaaataagcttcataattgagatgtatggtgccacacgacaaaatttctcctgtcaccattgtaaaattgtcttgggaaatgaaaatgttcccatattctttgtatgcctactctgaaaaatgcttgaaaaatggaaccatagcgaatttacaattacttgatttggtgttaatccacgccaaaattaaattaagtctctgaatctacctacttttgacctccaaagatacattatgcagcagcaaggcaaactaacctggtactaaactactaactattatattgatcaattgattacataattcacgtgtcgagcaatgcttatcttccatccttgaaagctgaatatcattcgaaactagccttcgtgttcttgtttccaagatggaattaaatcttcttcaaaacgtcattacagccaaagaaaagcatgggaaatttcaatctaatgtcataggaaaacttcctctcctcctaacttctaccaacaagcatttgcgatccacaaaacaacactgattctcctcgaatccatcttgaaaatcacactaaaaaacactgattctccttgaccccattttccatgcatcttgaaattaaatcacgagacagtttagtaggatccgtggctatttaagccgcttgatatgatgactggtagctcactggatcatcagcaaagacaagaagacaagaacaaagcaagcatggagagatcagcactaacaatggcgctgcttctgcttccgctgctcgccgtgacggcgagcgcccaggtgttgtgccggtcgcagttcaacctcgccaacgaggcgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51012 - DNA, 1683 bp, Oryza sativa
cgcaacagcaccagcgccttcatggaaagcgtcggtctctgtccatcccatgttgtgtgagttttcattaccgttgcttcgtgactcggctagcagttggaagtgagcatgaggccatatagctgcggatgaagagaaacataacactttagtaaaatgttgtcgatcaacgtctaaatcatcatcgatatataggaggggaatgtaccatcagcatcaaatggatatgggaaaaattgcaggtaacaaaacgaagcaactgtgagacctgaataaggtagagaatgagatgaattacatgtacttatcttgagagcaagaatgtttaaagtggtacagaagcgttgaaactacagacctataatgccgcctgcaaatacatcttgccagtgatgccagtaatcgtcaacccgagagactgccacaagtgatgcaacaagtagaggcagaaagactaggcatagttttgcaatatgcccttcacgtttaaaagctttaagtttgcctgctaagtaccacgcaagaaaacccagaccagcaaaagcccctaaagtaatgaagaaagtatcgaaacagatacatcagattatctaccaacacatagggaaggataacatgttatgggtatggccatgaaatagcaatctccaaaccattactttatagagaacaaactgctgatatggggatgcatgatagaacaaaaaaaccaaaatacaaacaatttggaagaaaacaagaatgagattaaaaaaattaatctgctggctcctggcacctgaactcgcaaatacaacctatatgcattaagagatgcattcaaatacaatttcaattgttaaaaaaaaaaaaactaactgctcaatagcatgggatttaaactagtagagaaacagttcatagttaaaccttcttcccagctttcctacatagttcccaggaagccaggagcacatatatacatgagatattaatattgcaagagcagtatcaaataatgctcaggtataaaacctgaaacaaccactagactaaacagcagtgatgcaaaataaccattggagaaaatccgtggaaacgtacatgatgtagagagtgtgggataaactgatgtaaataaatgcatgtcacaactcacaagtactcaaaaataatgaggagcaccacaaaaacataaggcataaatcataatgaaatttgaaccaatgagaaaattacttacagttaagttacaacttcaaaaaaaaaaaacctaaagcataagacatcatatctagagtacaactgtgcactgtttattacctgaagaatgcccacttgggaagctcttgtagccttccttgatgacactcctttctccatggcatatgacatcaccagtgacattattgaaattctacaaaaacaaaaataattgattacttttaataaggtaaaggatgtttaccttgtttctgtacaatttgcttaatctatggcacaaaaaataattctttaagcaagtaaatcatagaagtaaatggaatccctgtacaggtcatattaatctgcatgtccttaacataaaaggttttattttccataacttctgtaaaaaaaaaagaaataaacagaactaaaccaagtacatgtcgataggaatgaaattgcttaaggagagaaatcagaatttacaaaaggata

SEQ ID NO: 51013 - DNA, 3196 bp, Oryza sativa
ggtatcagccattatcccctaaaattgaaaataaacagaaatgagttcatagtcagagaaggaaaattgtaaataacatgaaggtgatggatgtaatccagtggtgttaggaacatggaaatgaataaggaacaacaaaggatgtcatgatagatcataatcataaatgtgttccgagttgctattttctgtcttgacaaagcaataaaacttttcagttggggttctccagaatatatagaacgtagatgctgtttgatcaaaagtataaagtattgaaaaaaaatgaaaactacatgtttgcagcaatcagaaaacagttaatgaaattgcagtatagggtggaaaaaagtggcatcagaactcatgtaaattctaacgtataactgtatttacaaaaggcatacaccacacaagtgagatcatcttattctgtgggatccaatttacttggcacttcgaagggcatgtactatttgaaaattcagaataatacaaacaatttacgatatcgatagcctacaaaaggtagaagttccaaggctgtggtcaaacacttcaatgtagccagcaattcacaataatcacccatttcagtagcaacaattcattcaatctaagctgaagtcctgaaccagccacctgattgagtactgaagtatgagtgttttattgataagattatactcatggcccgatattaaaatttcatcactgtcatgtggccactttggactttgcttggaaacaatattcatgcaatccctgagtccagtatttacagagtatgaagtattcagtatgacaatacttaacatgacaattaatattcaaactttcaccatcagtaattttttaaattgtttgattataattcgtttggttgtacttgttgttaaacttccataatactaatagagttgaccaccccacataagtccaaacctcatatcactaaaaaatgataacagatctaaacaaaagccttatcatgttattaataaaacaaaagtaacaacataatgaagtacaaactacccctaaagcaccttaacaatctttggaaagggaaaaactaagaaaaaaaatctcaaattatcgagaactccacacggagagcacaacaggttctttctaatgaatttcacaggaagaaaagaataactgacaggctcactgccccgctggcgagataccaatggctcctcctcctccagctcgcaccgacgagatatgttacagttctgccagataaagaaaaataaaatcaagaagtaaagaacacggtcacccccccaacccaagtggtcggcaggagaatctaatctgagaatccatacatgaaatagattggaaatgagaatgtaaaaaagaagaagaaaatgcgtgctgcagactgcacagggtgctcacctgggatctcggcgccggagtcgcccgcagcgtcgcattccccggcttgccgcgcggccgcgaaagcgaatggatggatggagacgatgctgagtagcagcaggagtgcaggagagaggaggcaacgcggaagcagcatcccgcagcagaagatgaggggagaaaagtccttctcttctctgatggacacgtgtccaccgcgaatctgataaaagccattctctcttcttaaaaggccttctttggacaggacttctagtcgggagtggatttttttaaaaagttcgatataaatattatctccgtcccaaaataagtgcagccgtagatatctgtgcccaacgtttgaccgtccgtcttatttaaaaaatttgtgaaaaaattaaaaatatttagtcacacataaagtactattcatgttttatcatctaatagcaataaaaatactaatcataaaaaaatttcaaataagacgaacgatcaaacgttgaacgtgaatagtgcaaaactgcacttattttgggacggagggagtagttgtgaagaattacgaaaaatattgaaaatgttgagattcgtgatatctatctgaaatcaagtttaaattcgactaacacatcgagaaacaaaaatgacaaatttagatgtaaatagtacgttactattcctgcgctaaatttgtcctttttatatctcaacgtgtgatttgagtttggacctaattttttcagaatttttcataaccatttgaattttttttaacaaaacaaggaggtatcccctcgagggatcgaaatagtttccccttccaatctaatggattcgctggtactaagagtgaagaagatcctaagcaataggagtaaggcttattcggttttaataatttttatagggttatagtataatttaaatcttagaatttttttcatatatgcatcatttgttttataggaatagatcgtatcgaatttcggtagtcttaaaacaactttagccgtgttctttagtgggagttggcaactcaaacatataaaataaagctgttcattagtgtgtaattaattaagtatcagttttttttaaaaaaaaatcgatctatatgattttataaagcaacttttgtatagaaatttttttaaaaaaatcacaccgttgagcagtttagaaagcgtgtggacagttaacgagagagatgagttgggaaagctaaccaaagacctcagtcttgcacttcaaaagttttgtaacaaatactccctccgtcctaaaaacctaggttggatgtgattccacttagaacaacgaatctagataaaaggttatccaaattcgtcgtcctaggtaaaatcacgtccccacctaggttagcattttttgggacggagattttacctccccacctaggttagcattatttcggacggagggagtaacattttttgggacggagggagtatagtgcatatggcattataattctttactttttctatttctatgatttggaaatcctatgatggctcaattttcttcctcgtataactactacattgttatggaaatgtggaagtcaggtatcacattctcagatttcaaggaaaccaatatgctcatgtaaaaatcaagacaaattgaccctccaaaccgcacctcatttgttctgtttgtaaccaatatcttgcttcaatacaaacaataactatgagcagccttcaaaaacaaaacaaaaaataactatgagcatttacacaacggagcaactaaaactgcaataaactgg

SEQ ID NO: 51014 - DNA, 974 bp, Oryza sativa
atttactataaaatcagtggtcaaagttgtatgtcagatatcatgaggatgtccagaaacacatttttctgtacaggaggaagtataaacaattataagaaaaagatgagctacaccatttatttgatagcctcggagtcttaatcatagatacaacatataggtgttaagggtaccaacatgaataaattcaatttttcaataaatgtcctacatagttaccaagagaatatagcattgaatttaaactagtcaagaatttcatttattcataaatgtcctgcatagttaccaggagcacatcagattggagagcagtactccgaacaatgccctacatgaaggctgaggcaactactaaaatactcggaactgttgcaaaagaaaaaattggagaaaaatccttggaaatgtatgtagagaatgtggagaaacagatgtaaaaaatgcatgttgcaaggcatgtaaagctcgatatcaactcagaaacatacaacggtacttcaaaacttaaaagtaccgatgcgttgcatgtcttacatgaagaatgcccacttggaaagctcttgtggccttccttgataacactcttttctccatggcatatgacatttgtagtgacattatcaaacttctgaaaaatgaaacgatttgttacttcaatataacctgcagactacatgaagtttaatatctgagatcaggacactagcacaaggagattacaggtattccatcagggaaacaacgccaaaagaaatctgggcgaggacgaccaacaccatccttaattgcatcagtaatcacagcagttataagtaccgaatatagaatccctgcacaaactctatggttaaattatatggttcagcatgaaccaaagatgtaacttcaatagatatctacaaatgagagcatcgtatacccagtatgccatggtgtaaatcatagacatttttctttttgaagtaaat

SEQ ID NO: 51015 - DNA, 3667 bp, Oryza sativa
taaagcccagtagtctagaatacctacatctttgaagcccttcaagcatattttatcatttataaaaaaatttaatggaaaacttcctgttagattaaatacagttaaatagtacattgttgtttagaaaacgaaagggagatgcagaattaatacaaagtcaaacccagtcctagaaaagaaacacgaaaaatgagatagaacttttgtgcaggagaccaagtcttgaagtttgaatatccatgtcaaatcatgtatcgctaaaaactgagaagatgttctgcaagtattggcaagccgcaaccctttttatatgcctcacgccttgaccttgctgtatatccctcacaacttgaaagggcaaagggtatttgaaaaagtttgaacaaacaagaacatgaaagaaggttcaggattgtaatgcctaataactggacctgttgtgatatccaaaacacgacaacaaactagaaattccaggaagttgatgataaccatccatttcatttcaaacccaattacaaagctagaaaacctatcacattcacaaaaactcattcaacctaaactaaacagcatgtgattgagtagtaatctgatttttttcttctttttttttattgatgccatggtgtgcatttctaggtagaatttcccccttgtatgaaacagtaataagcagcagtttatcattattaatatgtgccattcatttttttactttagtgaacagtaaagactaggggaataaaaacaattcaacggatccataaatcagttgcaggttatatgagcttatgagctgttaaaaatccaagacagaagaatcagcagcaaatttatagaaaggggcgtaatctgtttactgatgagtcgacaaaagatgtctagagttgactggatacgtcaccagtccaaaccacagccgctgaaaaggtaaacaacaaacttaaacaaccttatccagttgaaccaaaaaaacctagcatttctagcaataacaacctagaaaacacccaataatcctaaaaataggcacccataaacgaatgagaatcactgcaaaaacaacgaaatcactaacgagaatcactgcaaaaacaacgaaatattcccaggtaagagtgccctaagagatatgtgcataaatctcacaggaagaaaacgaggatttctctttagaacaataataaaagcaacgaaagaaatcaagaaccaacagcttcaccggtcccttggtcgagatgactaacaacgagccctacagatcggcgcctcctcctcgtgctcttcctacaaaaacaaaggggggcaaaaaacaaaacaaagaaaaaaaaatccaacaataaaggttacaccaaagcaatctgcagttgcaggagaatcttccacccacggaagaaaatgaaacaaaaaaagaaataaagaaagaaagaaagaaaagacgcacctagataatcccggagtgccgcgcgcgaggtcacattaccgcggcggcggcgctggagacgcgggggagtgtggggaggggagtggagtggaggcgctggccggagagtgacggggacacggggtgaagccgcggaggggaacgaaaaggaagcaactggagaattggagatgggccacgcaccggtggctgtgatgcatctgtggccgtcggttatagaccccacgggccaccgtaaacggcagaggctaaacccctctcttttttttttggcagtcaacggtcaaaccctttttttaaaaacagaaggaaaattttcttttgcgattaggcataattaatggttttttgagcgtacccgttcgagcaattatactgtttttcactttgatcttattgattttattgtaaatttaaaatttgcactcttatttttttacttgtcaaaaacactgttctacgacttaaatgttgtgttcagctgttagggctgggaactaatccctcgtgcatgcaagacggaacaactcatttgtgtatgattaattaagtattagctattttttacatgaatttttaaaaaaactttcgtatagaattgtttttttttttcaaaaaatacaccgtttatcaatttgaaaagcgtatgtgcggaaaacgaagaaaatgaattagaaaaatagggtaaagagcataacctaagggtgtgctctttccagcttacaggattagattctcctcgttttccattaacacgctttttaaactgctaaacagtatatttcgtacaaaaacttcctataaagaagttgttaaaaaaaccaacaaatttattcataaaaaaattatatattaatacttaattaatcatatgctaatcgtatttctcgttttgtgtgcgcctaagctgtccaccaccaccgctgaaacgatcgcaccctaagttaatgcttaataaataagtcgaaaataggagatagcaagcacatgtgtataaccatatgttaatttacatctgggacatcccaatttcccaaacacttattgtggcataaactaatttctcaagattccaaagaagacaaaagccaatgttcactcaatggtgcttatgattgcaacagccagcatgagctgtgcattgcgcgtgacaagccatagtcacgttgcttccttttgtgtaggccaccgggtaactaggatccaataaaagcggaaaagaagccaaattctcaaccatgccctacctctccaagctttatgcctggacagcatcatgcttggcacaaaagaacagaaacaagagcctaagcacagttattaacttattattagtggtgatcttccatctcaaaaaagaaaagagtggtagtatatcttgtcctaagctatgtccagccatccaggatagggtggtcctggcccccttcttcaatggaagaccatagagcatacagcaatgtgccttgttagttgttagaaagcatacagcaagatctagttgagatggatatagtattggacaatgctttagcttgctcatctgagaatcactaaagtcaaatttcacagatgaacaaaaattatgacagtatgtttggtctcaacacccactttgaacttctacagcaaatgcatgtaaaatgtcagtgtaccatattacagattacatgcacaatgaagcattccattacctccagaactgttcattacaaatgcagacagcgctacatgccaacagtatatcccagtacatatcagtccatttcattttgttacaacaacagaagccaagtatttgaaggatcaacatcaactaaggaaacaaggtcaaagaatgagttcagcatacaatttcttttgaatttgttatatttctaggggcacatgtaatatacctatatttataggttttgtataacaagtggtgcactgacgcatggtacacctgtttacaaggatacatcctacgagttctgtgggtttacctatattttgcgcagctggccatgtcacatggccaaccttggaaagtttgatcagctcaactcaaaaaccatctgaggtgaacatatattgtatcattgactccgcatcgtattgaaatttcaggagcttcactgttacataaactactgatcatggtgagaaaggaactctatgatgcatgggtaaacttcatccgttgcctgtacaagggacaaacatgtgtaaatc

SEQ ID NO: 51016 - DNA, 3348 bp, Oryza sativa
  unsure (1)..(3348): unsure at all n locations
acaaaaagttagcaatcttcatagaagcaactgagatagcagacaagaaaagcaccacatcttaccataaacggcttcaggaggacagatgagatctttatctccagctagtgctaggacaggggtctgacaatatcgcaaatgatctttgtatgagaaagtttcagttctattgcatagccccccttcccgaaaagctgttgtaagttgaaggacaacctttgcaggcactgtacctgcaaattacatgataacaacttaaatgaacatatccaaccccattgacaaaagttgctgaaacagacatcccatatttatatcatagcataaaaggttaataatgcagtgtattatgaattaattctggagtacagaaatcctatatatggatactatggcatatatacagtgctgtgtgttcttgaacaatattctggcaacaccctttaaagtaacattctggcaaagctgaaatcttaaaatgcatgacatgcagaatccagtgtgacagtgtgtaattaaagagtactcacagaagttgttaaaaacaagcttggacaacaactccgggtgcatcatatcctgtgctgatatttgatgattaagccaggaaaaaagataaggtggaccagatgcccagggatatgctgccgctaataatgtacccaatggaacagcagggacattaagggcttgcgcaggatgaacctgagaagtgaactcattagttttattcatgacaatgaaggaagaaaaactttaaaaatgaaaagtaataaacatctttatcaagttgaaactgtcaatcgactacgaactcacaagtggcagtaacatcttcagtgatgaattggatgtcgtgtagtcaacagaggaagccaaagtaacaatagccgctaagtttgatggaactccttcgaaacctttgagattaagggaaaaataataagtcgtgactttaaaaatccacaaccgaaagatagtaggctgagctgtaaacgatcatgatattgcttatcagatgaacaatttgactgtgtttctagaataaatataaaggtaaaacttgtaagacgtccaacaatctaccgttaactccagaaagctgagcaaaacaagcgcagtagttgttgattgcctacagctagaatgttccctttacattggataattgaatagtggctccaattctagcagcagcagtagaattatacttccatagaaaaagcaacagtaaagggcaggcaaacagtcatcagcaaaatacagtgtaatgtctcaccatattttgacagcattgcatataacaaaattcctcccattgagtgtccaatggcaagcagcttcccatcttttactctactatgttgtctaatatattccacctgtagtaactgtgtgtcaagcgatattccacaaaaacaatcttataacactaatgatgaaattatcaaatggaataattaaaaaacactgttacactgttagctcactgaatataacaacagtgccaactattcaacaattatagctcacaaaaggatggtgacgcctcaccgcagtaggtatatcctcctccaagtaatggtcgaagtcccaattatattcagaatttagattcatctgagttgccacaaagtgttcccatgagtcaatctgctcttgaaagttcttcagaagacgcagactttcttctctcattggaccaataacggcagagctttctaccatttcagatagaaccgaaatcttatctgtgatctcatgaaaatttttatttaaactagcctcttccagaagttttgaaattcgatcaaagaaactagtcatctccatcagtaaaggtgggtcatccaacgcaactattccaaggtcatcataatcaataccagagaaaccagaactttgaactgaagcaacctccaatgtgcttgatttatcaagagccaatgtgccattagatatatcatcgaaagcgcctgatggagatgaagcagaattatcatgatcacgtatgctcagaccagaacctctcacttcgacaatccatgtatcaaatccctggttagacatgtgacgggcgaatgaggcctaaaaataatgaggggcaccattagtatgaacggcacagatagaaaagaacttgttagcagaacacaagactgccatcagttgtcactatagttgagggagagcgaaagatacaactattaaaagaaaaagataatgagatccttgataatcaatagtactaaacttgtagataaaactgtagcaagaacacgaaaaattgagcgcttctttatcacaaccgtttttttgtggcagaagtttttactggttctccgggaaagtatgttggtcttgcagaaactattatgggatttcaactaatcctttccggggaattagacgccctacctgaacaagctttttatttggtgggttacatcgatgaagctagcancgaagctattaacttagaagagggagacannattgagaaatgaaattaantnngttatgcactaagcgaatcatttgggattgtgaagtgaaagaaacattttatctactagtagtggccaaattgccatattaccaaaccatacccccccctccccccaattaacacagctgtagatatgggtcccttgagaatcgcctcctcaatgatcaatggttaacggcggttctgtggagcagttttgccagaaagttaataatgagatcatcattttagggaatgatgtggaactgggtagtgacattgatcaggaagaagctcaacaggcacttgaaatagccaaagctaacatgagtagagctgagggtacgaaagaattggttgaagcgaagctagttcttagacaagttaggatacgagtcgaggctgttaattggattcccccgtctaattgaagacaacccacattatctaaaaaaattgaagacaacccaacagtttagttgataacctatactccaaatacaagactaccatgacttgtaacctatagttcttttgcaacttgaaccgcattttactttcaataatatgagttagatgcaacataacttcatttatttttctataaaaaaatagattaactttattacagcttataagaaaacaaatgaagctcaagaaactgaatattcagcatcctcggttttttcctctttggaatgcatttntttagttgtcttgatgctgttaatcttataatatgagttaaccctatcttcccttattcattggagatcatgttaacagggagtcagggactgtttcctcgcatgtgtgaaacaaacaagaaaatagtgggcaaaagattacagtgctta

SEQ ID NO: 51017 - DNA, 2489 bp, Oryza sativa
atagtcaataaatttaaggatctaaaaactattgaaggtcaagatcctactatacttatgccttttttaacagaacctcatggatgtatgttgataatgtgataggcctatgaaagtatgtaactctgtatgtaacacatcactttttgtaattgtgttcaagaaaaataactttgtagttggatatatgcaactaatgtttactttgaaaagacaataagttccagatttttcaacagagttagatgtattgcccccactccccagtatacatcatgcctgtcaatgccatatccatccaacttggcatatggcaaccaaattgaccctcaacttacaatttgcaggaaaattccaaacaagagtagtttcagcaaacaccatcgctctctccccatcccaaatcactccaaaaacttgagccatgcatttacatgattccaagactctggccaccacttcctaccatctcagtgtttagtttcaggcgaggaaattctacatcagcagaaaaagagttgcagtgagagaaatctctgctcaccccgggggagagatcgaacccgatggcgttcgtcccgactcccgacagaagcatcagcgggtggttcctcgccggcgcctgcacgaacacgggcgagatcaaatcaaatcaagcacggctctggaaattggaaaacaacgggaagaagcaccaccggtcgtacatgaggcggcggcctgtaccgccagagcgcgagacgccacccggcgccggagacgggcgcgtggtggagctcgtcggcggtgcagacgggcggcttcgccggccgcgagggggccgccgcggagaggtggatcgggggcggcgcgtcggcgcggatcgcgcagaggacgcggcggcggaggcgagcggtaggaggaggggagagtccctcggcggagctccggcgagcgccggcgccggcgccggagatgggctggagaagcatcggagttgccgttttgggcattttttggttttatttgaaataaatttttgggtcgttataaacggcgctctttctgcgcttctttcagccatcaacctggcataaacactttaaacagtctgttagcattaattatatactactagtggtagttgcaattttggtaatgtcggaaaaaaatcagtttacttccaaaaaaaatacactttatgtagaatttggagttaacaccttaacctttgcaattaaggtgacacatgatgtacgtgccttatggtttataatattgcaccgttatctttcagtttccacggtaacattatacggtaactctatcatttttttcgtgctaaccatgataatatcgggaaacggtaacccctaccggaacagtaacggaaaacttagtattaggtgtagcccatagccattcaatcaaaatacgagatttaaactgtttgtcgcaacaaaagtatcgtggtttaaaacatactagtatattgtatacttcggtacatagacgatctcaactcccaaggtaagaaaaaaaaaagaagttttcttgttgtgtatatgcgacacctattgtgttaattgaaaagatatatatcgtcccccgcaaaaaaaaaaaagaaaagaaaagatatatatatcgcccattttatattaaattttaaaagctttagtattagcatctttttagtatgatatatgccaatcacatgtcagattatatcacattataattttattggggtaaaataatttaaaataaaactagtgaataaaataattttaaagactatataaacatcaaaaatgtcaaatttttaaattggatggagaattaagacataaaaacagcggctctttttgagttattgaattggagaaaaaaaatagcaaccattttatatattgtgtcactaagagtaccttgtttcgttagaatggatataagggcatgttcaactattgagaccgattcaggcttataagttatccacgtcacacaagatctcttagtgctctctagtcatctcttgcaacttgttgtagtttaccaacgttgcattgtatattatgtctacaatatatgacggaagtcacttatcctctttcctcatcctcatgcataataagatagtaaagcctcgtagggctccgtttttgtccttttttgaaattttttttctcctcgatagttgtggtatgtggtttgcagatgcagaagctcctcgattgggtgagcagtggagccgttccttctttctttgtccggtttccctcactggttgtgccggtctcacgctgcatgcgcgccacgcacttccttatcattttttttatcctgagagtaaatgacgtgtgatggtgtttatgcaaaaaaagctcctcttgtttgaacggaatagcacgcacatcctcccaccgaccgacaccctattccattttatacgaaaaaccactcgtctttcagaaaaaatacaacacgaagaagggaaaattctgctacat

SEQ ID NO: 51018 - DNA, 7007 bp, Oryza sativa
  unsure (1)..(7007): unsure at all n locations
gggcaccggcgccgcggtgaccttcgcaccacgccgcacggacatggcggcaatggtgtggtttcggcgcaaaggagccagtaaatctacataacaaatgtatagatcaaccaatttaatactttgagtcgtcgataaaaatcttgacaacaaaaaatctatacatctagttatgtttacgtgtgatctcttatgagggatgccagctaaactcgggaggatttgtatacatgtttagaccatactcaaagtaataaccctatgttttcagcgccatgtgatctttattgatatatagataatatgagtataaaaggagggtatgtgttcctagccctatcttatagtctcgaaagttccgatgagatagtggttagacgatcacaagtcaaatttctcgggctcctagtggatcttgggcttgatcttggctggacgggttgtggcttgtctttcaatgtttactgtacagctgtatcctagaagaactcacaaaggtattgttggaagttttcggtatagtcctggtaaaagtccaagtaggtctcatgtagtcttttcaaggtgggcatgattttcttttatgaatacatcagttcatctaaagaactagcactgatgtgcaatcattattgccaggacatacacttatctagtagatggaaaatcttctagtagtgatgatttttaacaaaccggtacagatagagcagcactgctaatctgttttagtaatacttcctccgttctaaaatgattggcgtattccaccatggcagtgagaccaaggagcactgactccctttctcctttgattcgtactccaagctgtgcatcgagcaaggtatgctgcgccggcgcttcattatcccgcgcattaccccatgccgtcgtcgcttcgttgccccatgcatggctccacggcgccatcgcttcacgggtcgtgctcgcgcccacacgccatccaattccttcgctccatccgcacgaatcacatcgtgtcatcccagccgctcgacgaccctgcgtgaccatcccgctacggccacgatgtcgcttcccactccggccgcgaagtcgtctctcgctctggccgtggtggccgcgatccctgcgacggcgcctcctgctttgtctgctgcgaccgacaaaccatctcctgcttcggccatgtcttcatccatcgccgcctccatgtctttccaaaggtgggagaagaacagaaaacaccacggctgggttttggcatacgaaacaccgagaggtattcgtttttgaatttttttgagaattaatattatttttatggaaaatcgcaaaagtagtggtcaaccgggaaaaatcgcgaaagtaggtccctgtcgaacgggtgcagttcgataggtcgcctatcgaacggccagagcgcgactggcgaggagatcggaaggctgccgttcgacaggacctgtcgaacagcccccgttcgacaggaagggctgtgtcgaactgcccctgttcgataggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacagaaatgactaaaagtttaatacaaatagataagtcaaggacgatcagtgcccttcgcacgcttgctaggtcctcccttcttcctatgcctaatctgctcagtgggatatgtcaaattatcaggggggagcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatgacgtagttagtaacgatacatataattagaaactaaagcgtgtctatcatcatctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttagtctgttttcaacaacacacattttaatgtgccgcaaaaaccatagccagcttgatgtgttcttgctttcaacaaatgcaaaagcaacaggaacgacatggctatccgtgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaatattctccccatattcattcacctcatcgagaatagccatgtgtgtgcccgggtttcttgcctgcatcacctccaatagtgggggaagattgtgataagaatcctcatgagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaataaacacgtatgttgctcaaccctcgaacctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccacctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccattcatgttgacccctcactggccacacggtatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattataacttatactatattgccgtgtactaatttacaactattagtaacaaacaactagtttaataatccaaataaaatataacacctttgtatctattttaacacacaacatatcaataatatgtactaactaagaactaatttaaccgtacaattacttaaatacctctaccaacatttagcaataacaaatatgtgctaaccatacatactaacatcgaacaatacgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaaacaaatcgaactcgcggcctgngtggacggggctttaaaccggcttgtcgaatgcccattgttcgacagggtcggtggagggccctgtcgaacgcccccggttcgacaggcctcgcggcgccgggtggtgggccctgtcgaactccccccgttcgacaggtgagcgtgtcgaacgccagccgttcgacatgcctttgtcgactgccagtcgtcgataggtgccctatcgaattgcacccgttcgacagggacctactttcgcgattttccccggttggccactacttttgcgattttccataaaaataatattaattctcaacaaaattcgaggtttttggcatacgaagcggcgaggataagaaaacgaagcgcatatgcgagatgtgtcgggtgctgcctttgaagtacgacgatgataatttttggttttctacaatacgtcgattatttttaatcgaaacagagggaataaatcagtactaatagggtgacactcttatcaacactcctaaatgttgtgttaggcccctttttagcattacgtttgaattgaacaagcattaacaagttggttaatctgaattcaattaaaaacgtttgttcacgttcgcctcaatctgatgaatgcgggcttttccggaaaagccctgttcctgttactctgttaacagcaggagtcagggaccttacttacatcctgccatgcacgttgaccgtaagaccacatgcaaacaggtagtagtcgttctacgctggccaaaaggtctcacggtcaaccaattagcgcagaacagagttgtgaaacaaataaatagggattcactatgcatcctttcaaaacaagcttgggaactaacagtgctactgcctcactcgtctagcacaagcatcgtcagatcacatgaattgttgcatgctcagtggactctagcacgggcacagcagtatctcacaaaagcagattaaagcatccaaagcttaatatatgattgcagagcgatgaagcatcaaagcgcattaagaaaaacaatccaagaatggtttgcgtactcagttggagctccagtttcatagcatcgttctacaagggagcacccatccctaccgtcataacgtaaaatgttttcttcagttcaccagatccataaaagacgggatgcaacagagaaaggaattatgtagaggggccttcgattgctctaacttgtctcggctttagcgtccgactcctgggattttccggcttcagcagccttctctgcgtcttgaggtttagacacttcttctaaacaagggagcaacaaagtcaaaaaagatggcatgaggacttttaacaagcaagattacaattaaaaggtactaagatatataaaaaaacaaagataactggcactcttatatcaacttaattgacataacatagttgtttaaattgcttataattgatgcctagatgtacttcaagtctgcaatttcttggaggtacttcaaatctctagatttatgtacaatatgatgaatacaaactgatttgcaatttcttgggaatgtgcttcagttctctagacgtaagtacaatatgatgaatacgagtacacgcgacactaaccttaatctgcacctagtgacactaactttacatgcatcaaaaagtttcctaaccagtatgtaagtataatggttaagaaacttttgatgcatgtgattaaggttagtatcatacctatcacaaaatcaatgcaagtaagaaacatatcagactaattaccaccataatagttacagcatgaacaacataattcgggccaaactattccaaaatgtgcaggagaaccattaaatagcacttttacttctacaatcacaatatcaagaaacagtcctgtatgatgaaaaaaatagctttatcctattgagttgcatttatatgtgccaagcatgaaaggtgcaatattttgatcactgctgttaagagtacgaatcacacaattgcagatttttcaagaattggcctttcaattaatggcatttgtcacgtgcatgagtcatatcactcatctggtcaggcagttcaaactaaaccatactaatcttaccaaactgcaaaaataatgcttccttaatttatattttcacagaatcatattatgctatcatatagctaatagaaacaagtggatattaatgagaatctgtggacacaataaaggaagacaaaccttcatcgtcactctcgtcctcgaactcatcnnnnnnnnnnnnnnnnnnnnnnnnnnnnnnnnnacccatgccacccatcatctcagccatgccacccatgccacccataccacccatgccacccatcatatcacccattccgcccattccacccattccacccatgccaccaaaattctataaaaaaagacataaagaaaaacattagtttaaaaaaaatatatgcatgagcaaaaaggaaatctaggaataaacatgaaatctgaaaaga

SEQ ID NO: 51019 - DNA, 1676 bp, Oryza sativa
  unsure (1)..(1676): unsure at all n locations
agattagtcaaacttggaaccaggtaatttgaaaaaaaatcaaacgacttttaaacttgactggagagagcagaatataaacctttttacttatgaatctgaatatgtctatattccttgtaaaaatactactccctccatctctaaatgtttcacgccgttgactttttttanacatgtttgactgttcgtcttattcaaaaagtttaagtaattattaattcttttttctatcatttgattcattattaaatatatttttatgtatacatatggttttacatatttcacaaaagtttttgaataagacgaatggtcaaacatatttaacaaagttaacggtgttaaacatttagggaatgagggagtatatattttgggatagaggtagcatatccattccattataagtttttttatttatttagcaaacactaagattaaaaaaatcatttcagtcatctaaatggttaatttttttataaaaaagagtaaatttaagcatacctaggttttatggtcaaaattgcaaaaaagaaatcataggtattattacatgagccacttaaccccaaatattatggtttgaaagttttacaaaatgccaccttaagcattttgagcacaaaattaatatataaaatttttaatggtgaagttctttactaaggttgatagtttaattctttcctattttcaaaattttgtttaaaatatgctgacatttatcaagattttaattaaggtggggttttatacaacattgagacattatgtgtcatacatcatataagcattggttttctacaactttaaccataaaaacacgagattttccgaaattttttagttaaaagaaaatagaattgcttaaattcctccttgccagcacctgattggcgcaaattgtatgtattttgatgcatgcattgtaagaacctgtggcatataaatgtctatatcgtggtatgaattcccaattttatatgtctacaacgacaaaactttactttgggtatgtattttgtagacaacgaaactttcttcggctgagttcttatcccaatttttccaactcacatctctcgttttcagcacgcacgcttttcaagctgctaaatgatgtgtttttttgcaaaaatttctatacgaaagttattttaaaaaaccatattaatcatttttaaaaaataagttagttaatacataattaatcgtgcaataacgtgtgctctgttttgcatgccggggtgccgaacacagcctttgaaactttttattaccaaattaaatactccatatagcaatgacgactgggagcgggatgcatggtataagcactaatcagtcaagaaaggtgctggcagaaacgcgttactagctagtacgtgtgagtccggccaggagcatggatgcagcttcttgggcatgacggagcaaatacgtatacgtgtagcatggatgcgaccgagcgtgaagactcggtcggtcggtccgccgtgttcatgttacatgcggcgacggtttcatgactagaccacgaccaccacagacgacggcatggtcgtaggttaacttccagggcccttctgtcaaactaaccactctgggacgagatatacgtagtgcaaaacctaggcaacatactagtatagtagtagtggtgtagtaggagt

SEQ ID NO: 51020 - DNA, 10234 bp, Oryza sativa
acgaaagcaactactggtactagcgtttttttctacatctcaaaagttacactttggcatgacatctccttaatttggagagacttgagtagaccacgccaccatttaaattaaagtgcgttgatcgccggtcaactaaacagtgtatgagtatgacatcagacagcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatcatccggttaaaaataaaaacaatacagtgggacccacgctatcaacccatatctttcccttttatcactcttcctcctctctcatcctacccaaccgtgcgcccaaacccgcgtgcgctctttggagcgtcggaggcgacagtggcacgcccctggggtgcgcctgaccggccatcgccgtcgcgctcttcggcgttgggttcctcctccttgacccgctcctcgacagcatccactcccgtgacgcgctcatatcctggtgacagtgactcgtccatccttcatccacactccttgtccacgcagtacatggaggaaccgagcgagtttgtacactaaccgtcaccggtggtgaacgagtagaggttgcttgtggcaaacgcacccttggcagcccatccaagcgtcatctctgcggacaacatcgcaaagaagggcacggacaccacatatgtgtccctccagtagatgtcggggtcgtagttgagcgcgcgggcacggatgcgaccagtagaggtcaaggaggccttagttgggtgcgcgagcgagtttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaatctcgctctgcttgcttcagatggaaggagccaccatggtctcgctcattctgtttgcttcacctactctctcccgctgctcccctttttcacttccacgaccattctcctggggctttccatcatgaagttggatgtggacaagagcggcgacaacgcgggggcagctggtcttctgttgcttctagtggcgcccgctgtgtccgtcataggtatactgctttggctcgcgcgtgcgcggtcaaacctcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttggaagctgaggagacatgttttatctagtattgcgaagttcagactcggcgacaacttgaggtacctgaaatgaacttattccattgcaatatacgggctgaacacggacagatgggcccagaaaaaaaaatatcccacactccaaacggacatccgcctctcattctccgtctcctctccccaactcctcgcctcgccatggcgccacctcccctgcacctcttctccccgtccccgcggccgccgtcgccgaccccgccgccgtggctccacggcccgcatgtcccctcgacgtccgtctccccgccggaccccgccaccgaggcccctccggctccgaagcagcaccgtgggcccagaccggcgccaagaaaccccggctccgccaagcccctcaccgccggcgtccccggcggccgcacccgccgcgcggtcctcggaatcatccgcaaggtccgctccctcgagctctccgacccgcgcacacccagccccaatggtggtggtggtagtagtagcagtagcaccgcgaccgcgcgcgtccccttccacctcccgatacatccgccgccgccggagcgggaggaggaggaggagaagaaggggattcgcagggcggtgccgtgggccgcggcgagggacgaggagaccaaggtggtgctgcggcgggagaagaagacgcgggtgccgacgcgcgcggagacggagctggaggccggcgagctggagcggctgcggcgggcggcgcgggggaaggagcggtgggcgcgggccaagaaggccgggatcaccgacgaggtggtggaggaggtgcgggggcagtgggcgaagggccaggagctcgccggcgtgaggatcgtggagccgctccggcgatgcatggaccgggcaagggagattcttgaggtgattgcttcacattgctatctgctgctacttgatttcctggacgatgagcttcttgttgtggtgatgcaaaagcatttgttgcatctttgtgaaactttggagttcatctttagcttcatgtacagcaatgtagctaagtaacttagtttcgaaaatggaaagggggacgatcttgtctctctttcttcaaaaaaaaatgtagagcaatgtagctagggtgggttcatttttggcatcatgaaccacaattctgctaggaagttgcaaatgtgaccagcattttctggcagataaaatgattgaattgatgcaggtggtgctacacccgttggtggactgctggtgcttgattcaagatttttattggctgaaattgttaggttggcttagctgatgaattatgtttggcttagttaaactatggttaaacagagaaactattttaacgacaccctctttaccttgaattatttaagtccaaatcattattatcaattcaaaacctttgatatttatttttttaattctcttttcattagattaaaacaggaggcttagttgtttggacaagagggggcatacattttgtgtacagaggaagcagttacctagaaaacgcaaagcggcatcgtgactttgttaattataatgaggaactttccccagtaacatctaacaatcctacatcccaagggaaatattggagtaaagatgaaactttaaccaatgataatgatgaagctgatgataaggacgacaaacctatcaagggaacactatatgaaagagaagtcaacagactactggacagtttgggccctcgatttatcgattggtggtggaacacaccattgcctgttgatgctgatctccttcctgaggttgtccctgacttcaagactccatttagacaatgccctcctggtgtgagaccagcactagcagatgaggagctgacctacctgcggaagcatgcacggcctttgccaacacattttgtcctaggtgagtttgctattagtccccatattctgcacttgtcagtcactttattgatagtttcaaatgaatatgctttataggatgatttaagtgttgattgtcactactatctattgtaacatcttatgcacacataacctatttccttaaagttccacaagcattattgtatattcataagtaacccatcataagatgtttatatatgtagcccaactataatcttgactaatttctggcaggtagaaatacaaaactgcagggtttggctgctgctatactaaagctttgggaaaagagccttatagcgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtgacactgaatcttctcagtgcagcgtcttacaggaggaactgtcatattgaggaacaaggattatattattatatatagaggcaaagattttcttcccggtggcgttgctgaatcagttattgaacgggagtctcaggtacatgaccagcaggcgaaagaagaggaggctcgattaaagatggctgactcacttcaaatgattgttggactatcatcggagagaagttatgtgggaactttcagagagtatcaggatttccatgatagccatgcacgtagaacaactgaaaacaacttcagaattcaactagaggcaaagaagcatcgattggaaaaggaactgaaagaccaggaatggagactttccatggtatgctttgatctaactcgtcttgtaccttcttttgaattcccgaacttccaatggtaatgtaaaaatggtacgtactgcagcttaccaagaagattgaaagatcaaaccaagtgctggcaaagcttcatagttcttggagcccttcaaagaaagatggagacagagaactcttgacagaggaggaaaggaggatattccgaaaaattggcctaaaaatggatgaacatgtgctgcttggtatagccttttgtatcaaactgcaatattccatgcctatatgtgtctctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatctatgatgcttgaggttgagacaggaggcacattaatagcaatagagaggttcactaccagccatgccataatactttaccgaggaaagaattatcgtcggccaacaaaatcagcacccagtaatctcctgacaaaaagagaagcattacaaagatcaattgaggttcagcgacgaggggtatgaattgacatataattctcccttctccccttaatttccaattttctggctgtctgggtatctcatttcctcattcgttttgcagtcaatgaaatacttcgctcaggagaggaaaaagtccattgatgaattgaagagagaactggttagtttacatgctgtttatatcaatacgacgaaatgaaacttcatatgcttaagcaactggaattttatgtacttgatttatcactcttgtgttacagaggaatgtgacatgggaaatcaggaagctaaaccatgatactgaacagtcttggacagcatgatcgctatcaacattgaagattggaataacgattcatcctctcttttttttttcgtttttaacatgataactacaaagaacaaagtacacagaggccactagatctggtaggtatggtagatatggccacaatgaattatcttgcaagtgtgaagatgtttttttttttgtttatgtacatgtgatacactaaagcacatgagagcagaatcattcaatttggctctgatactacgacgaaatacgaactgattactgggtgttgattaaagctcggggagtttgctgaatatgcttagcgctttcatgttctaaaagaaaacaagtcgtatgacctattgaagagaaactaagaagattcagaaggatgctgtactatctagttctacatcactgttacaaagttactataccttttaagggcgaggttacgagggtacaaaaacatgtgctgaaattctttccccaagcaaactacagaaaagatcctgcctagcaaaagcggtactagtcacctggcccctgaggaaattttacaggatttttggaagatttgaactaagtcctgttatccggtgaaaattctgcaaaattattgtgttcgaagatcccaataaactatgcattggtcgcccaaacgagagcactcaagcagaaggacacagagaagcacaagtgctgaagaatctcactggacggcagatggcaagctttgcattcatcagcttcattgttcttgccgtcccgtccttcatggtttgcgaggctctcccctgaactgctgctgctgctgctgctgccgatgatgatctctcttgggcctctgcggcgcgttcttgggattggtgaaccaggtggtgtagaggaactgcttgtgcggcccgtcgtggtcgcagatgaggcggagcttctgcttctcccgcatccaccgcatcatgatcttcatctgcctcttgctcgtcaggcccctcagcccaacgtcctggacacgaaaatgccaaagattttctcgctcgtcagggatgcatgcgatcagggtggcaatcagaggaacacaagatcgttcagggatgacagtttccatctgtcaagcactgctggttcattttgacactgtgagacattacgtcgaacaggtggcgcgcgccaccgggggggcgagggcgaacggtttgcgaggtgaggggtgggcgcggcggacagggagaaggagcagcagcaaggatgcggcggcggcgatcgagacgggtagcatgagggcgtgacgaaccttgacgtggtcccagacgtcggagatggtgagcgggccgtgctccctgacgacgtcgaagatggtgcgcgtgatggactgcgcctgctccggcggcgccgggagctcgatcggcgccatcttcggcttccccttcttcgccgcccaccgcgccgccgtcgccagcatcctctccgacgaggggacgggaagcaagcagcaaacacgcggcggcgccggccgacgaggtgaacagagcagagcttaccgggttgggggtgggatagtttggctctcagattcgagtgtacggtcctcgctcccatcaaacactccccgtcgaaaactacaccaaactcgtatgacatattctaatactacaaatctaaacgtatgtctggatttataataaattatatcaaattttgaaataataatttttcgatattatgtcaaattgtcatatttgtaaaagttaaattgctagatgcagctacaaaataggggcaaatacataactaataaataaattaggggaaattgagagtatgaatgtcttttcgccaaaaatttaatattgttaacatgtctatttaaaataggggcaaaacttagttttgtttgaaaaaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagcaacttttctagagaaaattttcgcaaaaaatggtaccgtctactgatagttttggaggcttgtacacgaaaaacaagatatgggagactgggaaagttgagagaagaaccgctccttgcccccgtgaaagagaagccatcctgtacaaccaccatcacaccttcacaaaaggctcactattcattagtcaactaatatttctggaactatctatctatatattggtgatttctaaaaaaaaacatacagattttttctacccttagatttacacccaaggtactataaaagaaaataacaaaaacatatttacttgcatattatttttatcaaaattactatgaacttacatatcatatcagctgaatttacaaatgttattttaatgttttcctttacaggttaaagtccaaattacctccggactattacgacagtttgaattactcccctaaactacaaaacagaacatttaacactcaacttttttggactggatgaataacccccagtacaaatttggttttgatcttacgtggcatagaacgtgacaatataatccaatttttaatcctaggtggcagtgagccagtgaggcccacccatcatcttgtccgccacctcatgacgcctgtcacctcctctaggtcatgttgggtgtgtatgagatagagagatagagagagagagagatggatatgggaggtgaaagaaaggagaagattggaagtaggttgtcaacaagccgagctcaagtgagctttcacgtctaggctcgagctcgacaaaagctggagccgagcccgaattgagcctaatcctccttcgagcttttaagcaggctcgcgagctcgaccaagtataggataatatataatttgatgataaaattttgtaaaaataaaaatttaattaataatattgaagaaaaatattaggtgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcaaccgagccgcccgcgcgcgccctcgctgccgctgacaggtgggtcccgcttgtcagtcgtcgtcttcctcgcgcagccgccgccc

SEQ ID NO: 51021 - DNA, 6658 bp, Oryza sativa
taattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcagagataagtccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacagctgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccagagctattgccaataatcaagtctatgctttaatgtggtccccttttatgcactagttgaactaagcatggctaagcatctcctaaaccaacatctagtcattttaatacccaagttatcaatggcataaggaaaacaacatatagctgagtaataggacccatcccacatgatattgtaaaacaatgcaatatttaatagaaatgcgggacatttgtaaattaggtacaatatgatcaattgtattgcatgacttgccttgctctcgcactgatggaaccacagcaacgtcttcgagaaaccacggatcgacgaaacggccgaaatctacgtgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaaggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcgacgaccgaaagcgacggcgagcgcgcgaagagggcggcggcgcacggggaaaaaaaaaagaaggaaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccatgccggccggagtcggaggggagagagaactcaccgacgacgcgagggaaatggggtttcggtggtattccggcgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggtgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccggcggcccatccgaaagaaaggaggaaaaagagaaaaaaaagaaaaagaaaaagaaaaaggattttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgattaaatagggattcatctctaggttaaattaaacaatttcttcggacgatttattttatgaatttagagcaagggaggggtacttcagggcgtgacacctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccttctaaaaatattggaaaagtagaactgttctcctccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttattcaaaagtacaaaatttgtaacctggtttccaactgtttcaacttatctcgcaaagcttggtttactttatttacttacctttttactttgaatttctaatctttattcaaattaatccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcagttggccgacactgagtatcgctaccatcctcgccaaccccagggaagtgaccgtggcagttaccttgagactgaaggaattgagaatgatgctaccacaaggcatttggttgagatgctgtgggctatggatgaaagccgcgcggagactgtgttagcagctcaagatcgtgaagattggaatcgtggtaagatttgcaagttagaagacaaggtggatcgtttggagaaggaactagccgcattgaagggagaagcaccacctcaaaaggccaggattcgtcttaccgcaaggaagagagctctatttgtccctcgctatcaattggcgccaaaggttcgtgtggtggagaaagaagttgctccaaccttagcagatcctccggttatcatcataagtgatgatgaagaagaagaatccaagcgcaaccattccaagattgagtgggtagctacccaagatgatgaagacgagccgaacgagccttcaatcgacctccgatgctcggaagaactagagtgccatgtctagccgttgtcttagatcgttgtgttagtttgcttgttttaagtttggttgtgtgtgtgtgggtcttgcatgtgatttacatcagtggtgggatgtaagtgcatgtgtttgtttgcttttgagtgttaggaagttggtgagtttagtggtgtgagagtcttcagtttgtaataatgaaactcagttaagatcaataaaagttaaagtaattatctgtcctaagtagtttcccccggtttctcttcttgtgccctgtccatgccagatggtgaacactcgcagcaacgggaatggccccaacaacaacaacaacaataacaacaacaatgaagggaacccaacccttgctcaagttcttgctcaacagactcagttaatgaacatgatgatgcagcaacttcagaatcagcaaaaccagggaaataaccatgcacctccccagaacaagttagcagaatttcttcgtgtgaggccgcctattttctctagtaccactaatcctgttgaagctggtgattggttgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgttcgcaatgatgaagagcgccaggagaagttcttggaaggacttaatgatgagctttcttacccactcatgactggagattattctgatttccagaagttggtggataaggctattcgtcaggaggacaaatacaatcgcatggagcagaagaaacgccggattgctcaattcaagacacaacaggggaataatcagaagccgcgtcttactttaggaccccagtctgtgccacaggggggttcttcgtctgttgttcgtccgcagcgtcagttcttcaacaacaatgctggcaacaacatccgcaa

SEQ ID NO: 51022 - DNA, 12304 bp, Oryza sativa
  unsure (1)..(12304): unsure at all n locations
attctggtgctacacattcattcttatctatgagttttgcgggaaatcatgggatggaagtagaagatcttagacgtcctttgatggttagtaccccaagtaatcaagcactctccttgcaacgtagcccctctgtcagaatagaaattcaaggagtaccatttctggccaatcttatactgttagaatccaaagaccttgatgtcatcctagggatggactggttagccagacataaaggtgtgatagactgtgccaacagaaaagtaactctcaccagcaatgatggtcgagttgtaactgttcatgtattgtcttctgagtctttaaggtcaagactgaaccaaataactttggaagagattcctatagtccgggagtatcccgatgtgttcccagatgatttacctggtatgccgccgaaaagggatatagagttcagaatagatttggtacctggaacaactccgatccataagagaccttatagaatggcagccaatgagttggcagaagttaagaggcaagtagacgatttgcttcagaaaggatacatcagaccgagttcatctccatggggagctccagttatttttgtggaaaagaaagaccatacccagaggatgtgtgtggactatcgtgccctaaatgatgtgactatcaagaataagtacccgctacccagaattgatgatttgtttgatcagcttaaaggtgccaccgttttctccaagatcgatcttcgatcagggtatcaccagttgagaatcaaagaggaagatatacctaagacagcttttaccactaggtatggattgttcgaatgtactgttatgtcttttggacttaccaatgcccctgctttcttcatgaacttgatgaataaggtgtttatggaatacctagacaagttcgtggtggtatttattgatgacattcttatctactctcgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgacctagtaatgtggaatccgtaaccaactggaaacaaccgaagacagtttcagagatccgcagtttcttaggcctcgcaggttattatcggaggtttatagagaatttttccaagattgctaagcccatgacacgactgcttcagaaagatgtgaagtacaagtggtcggaataatgtgagcagagttttcaagagttgaagaatcgcttgatatcagctcctatcttgattttacctgatccaaagaagggttttcaagagtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacagaggtgtataccgatcacaagagtttaaagtatatctttactcagccggatctgaacatgagacagaggagatggttggaattaattaaggattatgacatgggaattcattatcacccgggaaaggctaatgttgtagcagatgctcttagcaggaaaggctattgcaatgctacggaaggacgacagttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcatggaggatgagcaaggaactgtatggttgggcgagagaatctgtgtccccgacaacaaagatttaaaagatgcaattctgaaagaagctcatgatactttatattccattcaccctggtagtactaagatgtaccaggatctcaaggaaagattttggtgggcaagtatgaagcgtgaaatcgcagaatacgtagcagtatgtgatgtctgtcagcgagtcaaggcagaacatcaaaaacctgccggtttgttgcagcctttgaagattcctgaatggaaatgggaagaaatcggtatggattttatcactggtctacccagaacgtcatcaggccatgactctatttgggtgatagtcgacagacttaccaaagtggctcatttcatcccagtgaagacaacatattccggaagtcggttggcggaattgtatatggcaaggattgtgtgtttgcatggcgttcctaagaagatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaatttccgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggcccagtctcgacataagagttatgccgacaatcgccgcagagatttgagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtattttggaaatagatgagagaaggaccaggaatcgagttatccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcagccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaatgatcctcgggatctcctctaccttttctcctttggaaacatcggctaaatcgttttggaagttcgtggaatcgagttcgattcggatcggcctctttccttcaagccacgaagtttcctcctcgtcgccggccgccgtgggccttcgtcgccgcctccgagcccctttaaaaggaccccgagctcttctctacccgccgccacccttgccttcgcctctcgtcgtcggaaatgccctagcgccgtgtgccctagcgccgtcgtcgccgccgtcgctccagccgtgcgccgccgccgttccagacgtcgccgtcgctcgggaaggacgtcatcgtggtcgccaagtcgtcgccgtcctcgtctgccgcttcgccaccgtcggagaccgccggagcatcgtcgccgccgtcgacccgaagagcttcgccgcttcctcctcgtcgccgtcgccgtccgttgatcttccgccgtcgctttggtcgccggtgagtccgtcgtgccgtccgctacccgttggtgccctccgttcgtgccgtagtgccgccgttcgccggcgagcgtgcgccgtccgagccgccgagccgccgccgccggtggtgacatcaccgctgacgtcatcggggccgttcgtcgtagaccggtcgtggaccgatcgatctcggccgtccgttttggatcaagtcgatctcggccgtccgttcgtgtgaaccgccgccgtgcgcccggtccaccgcaaaccctagcctgctgacgcaataaatccccttttccttttcaaaaataattcattattgcgtcataattcaattaaaatcaatataagtgttttaatccgattaaatcttcaaaaattcatatctaattcatcttagctccgatttagttggttcaagtctctaaatttttctaaaattgagatctacatgttaaaaatatccacatgtactgttcatgcttgtttatgtgctgttttggtgtttttgctcttttctgtttagattccgtcttttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgaagcccttgtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacattaggagaacttaagattaatatatcatgccaaaatacacaatttttttcacatgaatatatactaatttatccttgagctactaacttatcatataaaagataagctcgagctcagctcgacaaagctcgtgagcttgcagctaggctcgagttcggatcattaagagttcgaaccgcgctccaatctagtatgagcctcacgagctcgagcttttttgacagtcctaattggaagtagcaatgataggtcagcctcactgacttatttttaactggactgccacgtaggttcaaaactactccagactaagttgttgggggactgtggggtaatttgcaccattgcaatagttcaagggtgtaatttggactttttcctcttttgtatacttccttttcttttttaaaaaatacagtacaaacgcaagcctttcactcccactgggtgatcatcgctaccactgccccaaccaagtgtgttgccacactccgtctcgacgacaccataccaccgccggctaggctagtcattgtgtgatcccatgtcccgtctcctaaccacaagacatgtctcagcctcaccgccaccggcgccttcttactcactcatctcctgtcacacccaaagttttcccttcccttaggtttcaaatcactaataaatggcttcaagaatttgctttggttaaccactagaaaaccctagttaacaatacatttaatagtcggaattgtcagggagaatttttttcgaaatctctttgctctaaaaatcactaacaagacttaaagagtcaatatcagatcacggaggcaatgttgctaagttaaaagtggcaagttaattcttcttcctttgcctttggtcgtgaattgtgcccaattcactcccctctcagcccgtggtcttgttttgcatgaggaaccatatacgtgtcagtttgcggaaccatttcctttcctttccgtataggtagtcgagttgtctagccgtaggtgcaaccctaggttcctaccggccaatcgtttgccgtaccggggctttaccgtgaatcgtgtctagcccgccggtttagctgcagtcgttgttgtgtcgttcactcgttcatttgaacgaggtgttccctgtggttcgttcgttcgtccgtcccgagtcgtcctttaggttagagccgttcagagccgccggctcctttcaccggtttcgattgatcatttgggtgatcctgtgtcacgtagaattgactcgttgagtcggtatcacgtgaggcacgcttgccaatcaatctatcctttgatcctatgttctttcgggcttaaatccctgtcaattgattaaggtttttctgttaatagtaatagcacagagcatcttctaaaattcataacttaataatctgagctccgttttaacccattcaaattgcagtgaattcgttaaatgtcaagaatccattaaaattggtttcttttgttgtttcagtagctttttagcatgtatttattgtgtaccttgtttgtcgtttagactccggcacttctgacgctccggtttattttgaagtggtcgccgaggtcccgtcaattgaagagcaaggcaagtcatacagatatcattgatcatattgagcctatttgcaaaaacccctgcttttctctcaaaattgcattacttttataatgtcatgtgggatggtttctacccatactcagcctttgtttaccttaattcattgatattctgggataaaaatttgactagatgattggtctaggattgcttagccaagcttagatcaactagctcacaatgggattcactataatttagtccttaatttgattatgctatgccttcttggcatatggttaattaattaaaatatgctttacttggtgggtcgtgggcacatgcatgatgatttatttggtggttgtgcccatgacaattaaggaccggttctcgggaatccctggaagatatactcgtactaatcataagccatatgggctctaggctgaatcttaagtatatattttctagctagcacaccatttgcgaggatagatgtgatggagtatggatggacctgnattttggtctatgctgcttccggatttacctaggcacgagcggaggctgcctgctcctggatttggagtggggcgaaactctgagtggcatgctgttaggggtgtatatggagggtttgtcacgatttccccctttgcagtatcgtggcggtacttggngcatggtttcatgtgtggaatcgtgtcttgtgggtaaagttgtacacctctaatcagagtaaaactattcgaatagccgtgcccacggttattgggcggtcaaccagctcaccatgattagtctcaccttaataatttgccttaatgaactagtgtagttcaggtggttttggtttgggcctgtcgcaacgtggtttagcgttggacagtgatgatgttaatactacttaattatatattgttttactgctttcaacttatgatttacaaatgatgtttttactgcaaaatatcctatgagccaatcctttgttttatccttgcatcataccttccccttggtatgacttgttgagtacggtggttgtactcagtcttacttctttttcccaatcccctagaagcagaagttggttcagatggtgagttctatgaagtttaggattgtgccagccgtcaagagtttgcctgtggagttatggaggaagcttcgcgttgctgtgaagattaaatttagttctctagttttttcgctgcgtatgagtttattttgttatttttgtaaaacgtggaactatatcaaattgtcatctgtgtactatagttgatgtctggacagaggttaaatgcacagatagccggtgattcgggttattaaatccttgggtgagacatctccaccgcccctaattgttcttccatcgccctagtcatcactataaagccgccctgaaccccctcccccccccccctccctagtaacctccaaccttgaaaccctaatccggtaaagcctatcggagttcgttagggtgttagtgatgaggcttgccaaggaggttgtggtcgccattgtcgtgactgccaccatcattgtccttcacgctcgctgtttgatctgatgacattcatcatagtctattgagatttttgggaaatgtaagtaaaccaatgaaagatacaattactttggtaactctgtgaacatatcctatgcacataagctttccgtgcacaccaactagcaaatgttacgaataattatacaaaaaaaattgaacatttacttataatagtattacacatatatgcaaagtcttattttcaaattaattatattttaaccctaaaaaaagtgaaaaatctgacaactttttgagttaaaatatattagaattttgttttttttttgggttacggctaaaatataacaaatttgaagataagatttcacacttaggtgtaatactattgaaactatgtgtctaattttttctagaattttatgtgacatttgttaattgatgtgtatggaaaatttgtgtgcatagtatatattcctggtaagtcctatctacatttatcattgtcatcattcttgaggctcttgataccatccatttggccttgtttctttctccatgtcttatcttatgtttgcactgaactctcaaggtttaaggtcatacctacaacaaacccagtgaacatggagtgtggtgagctaacaagccgggttggttgtggtcacatggactcgtcggctcaacgagtaaccgaaccataaatgcatgcagtagctaagctaggcccagccacccagaaattacgccggtcgaatgtggtcacatccacagctccagacctgaaccgccgatggaaaactctgaaaactgaagcgaatagatgaacatgctgaaaaatcccagcatcaggcatcagcttcgtgcctcgagcccgtcccgatcccgaccggagtactacgagctaccactacctcctccgttgactccggcggccatggccatggctgcaagcacgatggtacaagtgtgtactggtagtagaagtagtaccaatgtacgagcacagtacattcttggcaagtgagcagtacagtggtagtaatgatggctttgctgctgctgctgctgtgctgatgatgatgatgacaagatcatcgtggcctgtagcagcgtagcgtgtcgcagtttgaggagaggagaaaagaaatggtgaatttgtgatgaactgatgatgcatgcagagtaaaactagagcgaatttgcaatttggggtcagattgattgattgggtgatggtggtgatttggtattccatattcacagcggcaaatctcctacaacaagaagtggatcaaaactaatgaaaagaagaaaccaaagagaggaagaagaagacgcaagaaacagagcaagaagatgaacaagatggggacagtggaggaatccatgtcctcttcagggtttcttgatctcttctcttccgtcgttgctgctcctgctgttcgttatttattcctcgatgacggcgagctccggccggccctcgccttccgggatcgccaccagcaccggccgccagctccgccgcatcagcaggctccgcagcccgccggaaccgaacctcctgcctccaccgccgcctccgcctccgccgccatgacccgacctgaagccgccaatgcccccaccttcgtcgtcatcgccgccgcggcgtcgcgccgcctccggcgacgcgacgaacagatcccgcagcgtgcggccgccgcggcccacgagcggcttcctgtactcctcctgctcccgcgcggcggccgcctccttccccccaccaccaccacccccgccgcagccgcccacgccgacgcggcgggacaggaagcgccgcagccggccgtcgacgccgccgcggcgcctgcggcggcggcggaggcggtacccggggctggccccggcgtacgacggcgcggggctgcgcgacgggctcggcgccgccgcccccgccgcgcaccgcgtcgccagcagcttgaaccgctgcggcagcgtcgccatggctgccgccgcctcgccccccctctctctctctctctttctctatctgtttcagtgtgcgtgatttagatgggacttggattccgtgcgggtgggattcccgtgtgcggtgagcgcgtggagattcgtgcgggatacgatgatggacggctgcgatggagtggactggcactggacgggggtgatcaatggagggggagggtggatcgggttgggggcttttgtttgggaggggtgaggcggaaatgatggctcaacggtggaggatgaaaggtgtggtctacacatgcaaagcgtggaatcgattcgatgggttgatgattggaattgggttttcttcgaggagattatgcctttcatgataattatttctaatatctgttttattagaatataagcttttttttaaggtgtagctatatttatggcgccgtatttttcaccaaaaaatagtcggcgtttatttatattgtaagtctctaaattacgtatataattttagtgtatttataatgtaaatatcaaaattacatatgtaaatcctaaaattacatatgtaaattcaaaaattacatactaattatatatataagttaggtgtaagcgggtgtaagtgaggtgtaattactgtgtaagtagctaaaaaaatcgactatagcatgtgtcgacataattttagctaatccgtttttaggttgtttagcaaatattaaggtttaagccaatttaccctatttagtcaattgcgtctacagtaaataaatttggtaggtgggtgcgatctagttcaaaaacttgaaaaatgagtatataggtacaacaacttggctagtgcatgcattttggttaaaagatcaatattccacaccatactttttatacaatataaaaaaagcagctaa

SEQ ID NO: 51023 - DNA, 1620 bp, Oryza sativa
aaaacctgaaaatagattactataatttttaaagtaatttttctatatattcttaaaaaaaacacgccctttagtggtttgagaaggatgtgcgtataaaacaagtgagtagaagttagaaagatgggggtaaagaatatggtatagatccttatcaaatccacgacttaagatgactacaactgagcatgtggttttttctttcgaataccagatatataaaggttcagcctattctaaactgatactgtaagtctaacatcggtgtgttaaacagaggagagaaagttcctcgtttttcacgcgcgtgcattttgaactgctaatcagtgttttttgaaaaaaaaaaatatagaatttttttgcaaaaaactatattagtcattttctagtttaaaatagttaatcacacgctaacgatatacctcattttgcgtgcattatctttttctcttctcctaaatgcaccttagtcccctcacccaaatgccctatggttgaaaacagtatggaaatttccggctatcatttctggtctgcacctaccgttttagtcggtatcggcaattatcagtgttggaaatagaaatggtaatatcttctggaaatgatagcggaagtgggatggaggttttttcaaccgtttttattggtaatcgtatttatccggtaatttccgtcaaaattctgagaaaattctgaaagttctccaacggctcagctagtccaacccatcggaagctcatgaatgttggaagcctggcggacttgtagcccattagaaaagggaagtggctaggggaaaacacggttaaccctagggcgtggcatgtgggctttgttgaactttggtctcttcaacttatcgatgttaaagtattattgaactttgtttatattattcgtcgaacatattatcatatcattaatcatcatataatggtattatgtggagtgtaatgatgtaagaataaagttataaagttatcttcatgtataattaaatatgtgattatgcctcactttgttgtttccaatatgaattttcttccaaccaacatcgctaggttctgtttcgacgtttccatttccaatatactgatatcgttatcgtttttttataccgtttcgattccgttttcggaaaaaaagaaatatagaaataaaaatggtagagggtttttccgaccattttcatcctaaacaccaacagcaccatctctctccaaattgtactagcatcgtgttattacttattccacgttattatggtaaaaaatttcacggcgcaaagcatctaggctagtccttaattcactacgtagactcgtggtaccgtttgtaaaaaaaaaaattgctccttggaaatcgagcgattttacaaaaaatgataaaaatcctagtatgtcccaaaaattgtttagagttttaccctgattccaaagtagcaaaaacttataaatttccttttgttatgaaggaggcccaagttgcttagatgactacgtacgtggtataattttcaataaaaaatcggtgcgtgttgtatacgtgagatcctttttgtttgactatggcaaatgtcaactaaggaggtcccacttgcaagacgttgatgtt

SEQ ID NO: 51024 - DNA, 10315 bp, Oryza sativa
  unsure (1)..(10315): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcatacagaacggtcagcacacaaaaatgcaagttttgagtaatcatcaccaaggacctacagaaagatgcaatatgtgttattagatagaaaatatacaaaaggaaagatacagaggttggcacctacaagcatagtagacaattttgagcagttaatctccaatggtttgtatcaatgtggaaatactttaaattacatcccacgacaaagcatgaactcatagcggaaagtataaaactctcataagcaaaataaattcaacagagatgtactacagtctaagttaacaatctaatttgttacacagctaatgaaaatgcaagtttctgatttgtggaaaattcaaatgtcttctccatagtaaaagaggaatgagcttcactagagcctagtcccacctggaaatctacaatttctgaaatcatgtgcctctcaaacttcattgataactccttcaattcatagactttaacttgtggggggtaaatacctgacatcatagacagaagaattccacttacatacagaggtgtaaacaatctgatgaaagtgacaatactgaaacacattaaaggtgaagattaaactaacaagtgatattacaaactaaagaaaaaaggtgtagagcatgaattacatggattgtttctgaaggcatgggattattcaaagttggactcacaataagcaaacataaacgcaagcttctccaagaaacgccttagtggtttaaatgttttgactctgacttcaaatgaagcacaagccaaggacatagtagggggacgatgaagcgcaagccaatgacatagtagggggacggcagcattccacgataattgtgtgatgctccaatgccaactcgcacccagaacatgagctttcatcttaacttcgctagactatgcgaactcatctgagtgaggcaaggatgaaagctcaattataggtgtggacatggacgcagaaagacactacagactaaagatattgttggacacctattccttcagcaacttatgcgaactgactcctgaaccaccattacgttatattgacgcactgccttttattccagggtatatgttagttatatgcctttctgagtatgcactgtggagtttaacctgatcaaagcaacgccggtgcagaaaatggtggattcagcgagctcgcatacctgaggcgatcacatactgctcatccggtgtcaccttgatcttggtggtggcggtctcgaacctcaggtcatggatcaaatccagcctccgctgatactctaaaaagacccccaaaaaaaaaggacagcaacacgacaataaatgagaaaatacatgtcatttgcacaagaaaaaagaacccaaaatagagagagcagatgagcgtgaggcgagttaggatgcctgcgtccttgcggagggcgcgcttcttcttcgagaggacccatggggcgacgtagcggttgccggtgatggagtagagcttgacgccgttgatggaggttgacctgagggtccccgcgccgttgttcgacgccatgctcccctcctcctctgaaaccctgtaccgccgcacttgccctagctctcgtcggcgaccgacgccggcgactcgtcgtcgagcggcgccgtcgggggcggcgggtgctagggttttagcaggttggagggaaaattcggcgggtggggtggagcgctcgccggctataaccggagggccgcctagaaagcagctgccgttggattaagcctctgggttcttcaccgttggatctagtctgatcaactcggtgggccacgttgccatgggcttatcagcccattggtttcccgcgctgggcctttcgtgaatatctgggcccgttaagtatgacttctatcttcttttcagattcttgtagaaaataataagtgaataaaaattcacaaaactatatatattttgatcaaactatcacaaaactatatatttaaggtgttgtatcgcataactacagatttagcactaaatttatcccaaaactatagatttaaggctaaatatcacaaaactaaacaattaatattaaagttatcacaaactatagctttagagtttaaatccttagcatagttgttatgttggagctatattttttttgactgggataatttagttattactaaatatgtagttttataacactttattttaaatatatagtttgtgataatttaatgttaaatatgtagttttgtgatacaccgagttaaatctgtagttttgtgatagtttgatcataatatttgtagttttgtgaaatttactcaaaataaattttgcaaaattatcaagaaagaaggaaacatgagaagggaaaaaaacccaccctcatcctacacatacaggtcttgttacaagaaaatacaaccaaaagcaatctcatccagtcaccctacacatctttattgaaagggtcaccctacacatttggctacttattcttgaaaattaggttattgggttgtgttttagtgggttctctagcctgtgtgtactggttatttaatagttggattagcctttttttaccgatatttataacatttatgtgtgtattataatcttgtaattatatcatactaatatatcacaacaacatagtataaaaccatataatcctaatataacattacaccctctccaatgctaatataacattagaaccaactctaatttttttttctaatgtagaagtatagtcagtgtcaaatgcttttctatgaagatgtgccaacttagcggcggcacatggccccaaaccggagagagaaaaacccattagcacaactttattataacattttttttagctatttatgtgcaaaagtaagttgacaaaaattcgatgatcggtatcatgtgtcaggtatgtgctttgatgattcatcttgttagtgcgtcgcatgcctcatgcccacgcacataaaaaaaaaagaagtatgcccaattcatgttcccttgattttttattcgacatagaatgaagtaaggattatacatgtagtttttaaaatttaaccctaaattacatttactctagactctaaatttctaaagacgaaactaagacaagtccttattgcttaactttagaaacaacttgttttcccaccgggaaaaacttgaaaagagtttgtttgaaaaaaaaaggttgtttttcttttatctgtttttttttgaaataacaggaaaaatcgtttttcgtgaggtggatggagtatccgggatccctgaacaaattgctgcttcacaaaaaaacaaaaaacaaaaaacgtagcaccagtagccgccttttccccatctccactggccgccgccggcgacatcgccggcgccgccgagctccaccgctccgatcccactccgaacagccgagctgcggtttccaaggaaccgcgggcgagccgagcccgacccgttatcagccccgtttttttaacggggcagtgtccaagtccaactccgcctcttccacgcttcggcttccatccaatcatctgcatcgtcgtcgccggcgagcgccatgaggccgacctcccgcatactggccgcgggccacctcctccgcggctcacgctcacgctacgacccctcgccggtcgccgctgccgcccccatattccggcggccgccgaccgtgccgaggcctctcccgagccctctgctcggaggcttcgggccgaattgttgggtttatcccggcgacgggaagtatgccccctttggtcgcctcagctgcttcatgtcggactccacctacccgccgcctccccgcgatgtggtaacttgtggttactggcttactgcattgtgcttattgcatttggtttagtttcgatttggggatggttagaggcagtagtggttgattatgtattttgtattgtatcaatacttcagtcaaacaagcgagtttcctagcaaaacagtcggctgtagactgtagtagatgtgattagttactagtttgaccgatacaggaacttaaaaaaggattattaagcattgtggatggcattgctgggcgcatttggttttgtttcagtgttattctcagtccttgcaaaaggataaatttatcagaaatttactatacccttgtttcctttgtcattgctgacattcgtgcgttcaagttgatatttgttatgcttctgatgattttttcagacttaatccatcagatcacaaaataaagtacaaacacgcttactcacattttttcatatatatgattacaagcaataatatttgctacgcttgtgatgattctgtcaagcaattttttggtatttaaaatgcattgttttcatctttattaaatgttcttcaagtatctcacggttgatttcaactctagtaatcaatatccaatacagaaaattgagtctgagtttggttacttggctctgttgttttcctttgtactatgaaaggactcatttgttgagtttgtttttttgtgattcttgccatgtttgcagagaggacatgcattttccacatctgccaatgctgtggcagttgggaaatcatctgatgacaaagtgaagaaagatatctccaaaaaggatgttgatgatcagatagcagatacacagatactgaaaaaccttgggaaatacttattgttgaatgatagcccggatttccgcttcaggcttatattgtcattgggcctcttagttggggcaaaggtaatgctacacctgaaagtggtaacccatatgagcagagtattttgtggctaagataaacctgcagcctaattctgttgttaagatatttcttttgttattaattagtcattaatgaataataacaaggtgcacattatggcaattccttataagctgccacttatctcatgatagagtaccattgaccattatgctggattgagatcaatactaatcttcctggctggagttctatacatattcacttcttattctgcagtgacattttttacttatagaaggaatcattttggcataatatgatgcaatctagtagctagatatggcctatctgttggatgtatatcctcaaaatatttttgccaagttccgcttgttagatacacaactattttcaagtactgttgtcaaatcaaaggaataattatgcaccttcatttagggcatataagaaatgataaccacagaagttggctgttattacagtttacatggaactttcaacttatttatctgaccgttttcatttataatgaacaccaggttataaatgttcaagtgcctttcttgtttaagcttgctgtcgattggcttgcagcccttgctggtgctgaaacttcacttgcatcattcacagaggctaatgctaccctattggctctctttgcaagcccagcagctgttctgattggatatggaattgcacgatcgggagtatcagcctgtacaggtaaactctttttggttagaaaaaaaagcatggttgtttctttccctgaaaaaatgagttcctttcgtgagcttggagcaacatgcattgccaggcccctctttgaaatatatactgattctactgatttattcgtcgatttctgttgccagaactgcgaaatgctgtcttttctaaagtgacattgagagccatccgttcagtctccagtacggtaactattgaaatttccttttttattccaatgttaccactcatttgtcatgtttttccaaccatctactaaattcctctattatctagatgttccagcacattatgatttatgaatcttttgtttatctcaagttttatttctttctacgcattgatgtacttgtcttatttatgtagtgttgctagtattgtaaacagtactttccacaacatttatatattaaaaaaattaaattcatggaaaaaaaagcttgagaaaaaatcattaaaaaatagctattactatcttgacatctgcatcctcatctagctgttcattgactgttgatcatgctactggcccgatgtgcactcccatctgtaatgactatgataattctttatcattttctgtcatttttaatcatatggaactgtttatgctaataaagctacatgctcctttaggtagtgtttggtttggggacgaagtgggatgggtcagacctatcctagttttgtgggatgggatggttccagttgtctgtttggtttatggtatgggatggttatagttttttgtttggtagaagggattgaggtgggatgggatggacggatttgtactcaccgttagtgccgtctaggggcagaggcactcggcggcgcccggatctgagaggaccggcggcggcgcttgcgaaggtggcggcggcggtcgtagacgaggcagaggtggcggagtttgtggagatggcggtcacggtgctcgtggaggtggcggcagtcatggaccaagcggaggaggcgccgggcgcggaggcgaggcggcggctggatctgagtggagtggcggcggtgctagcggaggtggcggtcacggatgagcggcggcactcgtggaggcggcggcggcggccgtggaggcgaggcggcgctcgtggacgcgcggaggtggtggtcgcgggcaagcggcggcgctcatggaggcggcggcggtcgcggacgaggcagaggcggcggcgctcaaggaggcggcggcggcggagaaagacgtgtggaggtggcggcgggtgtggacgaggcggcgacgctcgtgggcgcccggcggagctcgcgaaggtggtggatggcgcggtgacgccgtcgctcgtcccaggtgggacgagtttgtccgccagtttttggcggatcggttggtcccggatctgagaggaatattcctctccagggaccaacccatcccacccacccctaaaccaaacacccctaaaagtgggttcgtcccatcccatcccatcccatccttgcaaccaaacactaccttactggttaaattatgggttatcttaccttctgagctcttgctgttgcaggtattttcgcacttgcatgagcttgatcttcgttatcatctaaggtacttctagaaaatgcctcctattcatcttatatgtttgtttatcttaaatttatcaaatgatatatttccgttaatgcacacatgcacaatacaatatatagaaaagcatcacagttaatgtaggtggcttacaagttgtagcaaataattgcaaggaattgccaaattaggtagcttgactgcatgtatatatttcagcatttacgcatgggagatgatgagaaacctagtctagggctgcactattttggtggttatagcctatatcccactttgattcttctgaaaattggtgtggaaacaagttataagaaacaagcaaataatcagatatttcatgagttttagaactggaaagttgaaaattatctgagctcttatatgcctttacctggcttctatattttcagccggcaaactggtgccctaaatcgcataattgatcgaggtagtcgtgcgataaattacatccttacagtgatggtgttcaatgttgttcccacaatattggaggtactcagattattgtcattgactgttatatcccatcaactatgcatatacgcgcaatgttggtgtttctaactttccgtaatgtatgccagtcacattttacatttttgtctgatgtgtgccttctgttttttttctttccatttacagattggtatggtgtcaagtatacttgcatacaaatttggttccacctttgcttggattacttcagtttctgttgctacttatattgctttcaccttggctgtgacgcaggtgtgaatgatgtgctctatcagaccgtgtctgtcatccatgcatagtctaacaagattttttgctgtttttttgtcactaatgccttgactcgtaatgcattattatgacagtggcggaccaaattcaggacagccatgaataaagctgataacgcttctagcacagtggcagttgactcccttctgaactatgaggtaataccatgattttcaattggcctggcatctagtctatgttcttaagctttcatattctaattgtattaacctttttttttctaacttcctttattgggccagactgtcaagtacttcaacaatgaacaatttgaagttgagaagtatgacaaatatttaaagagtgagtacatatataatgttcattctgggaagaaaccttgttaacgtgtagacatgcatatgttactcgatacacttttttttgaaagatatactctatgcatttaattcactggttttaatgttattttcatcttctataaaaactaccaaaaaaacttatattgaggcatgaaatacatgtggaaaatgttttccatgagaaacagtagggttgatattgcatcttggattttttttttcaatcttcacaaacaattaggagcttgtacacattgatttatcaagtgcttagttatatgctatgtaaatctgatgaatcctagctgacatgttgctttggcatatatcgtaaattggtttataaaatttgatctattaattactatttctttttcacaatttggtcagagtatgaggatgctgcactgaaaacccaaagtagccttgcctacctgaactttggacaaaatatcatatttagctcggctttatccacggctatggttttgagttcatacggtgtaatgagtggtgctctgactgtcggtgatttggtaattttttatgacatccgcttatatattatttgatgcaagtatttcttatcccgttttgacatgttcggttagcaccatatccatttcatacagtggcaaagcatgttgttgcaatattatgtttattttatagtcaggaaggttgtttaagtgaaaagggctaactggaaagttttgatcatatgctactcctttagagtgtcaaattgattatttgccactcatgtttctatgacatgtagccccagggtccatgtatcaaaggcagagcggtggcaaatcatcaaatgccacttcgaggggtgtcaaatgatcattgattatgaactaattatgtggatttggaacaatagttaattttgaaccatgaaccatcagttccagatgttgccagttttctgcttttcttctttatttttgactgatttttattaatttgattaaattttgatatctaggttatggttaatggtcttctattccaactttctttgcctctgaacttccttggaagtgtctatcgagaatctaggcaaagcctgattgacatgaagtctatgtttcaattgcttgaggtaaaaacttcgtgactatctgttgggggcctaaatggcttgcagtttcagtttcatacctttcacaaccccagaaacttcattgctgttatttcactttgttcaggaaaaacatggaataaaggatgaaccacatgcacagcctttgcagttcaagggaggacgcattgaatttgagaaagtgcattttgggtaaattttgcgttctgtttacttattacatgcttgtaccacttccttaaaaagtcacgtctctcagagcatctgaacaccaaagtgaaatattgaagcactcctaacatttatctccgtagagatggaatttctttccttgttttgctcaagttaatttgttatagtggttctctttgtttgtgctctcctgtaatatttaaattttatcttgaccatcgcctcaattctcaatcaagttcaaataggtaaaatattctcatgttgttattttttaccatctggcatctgagtaaaacagtatcagatactgctgccttagggatctacgttgctgtcacgatttgaatttgaacaacctttaattacctcatatgtgggtcaacaatttatgtgcatattgggatgtaaatgactggcaatatatcattatggaatctatcaaagcactaagtacaattaagcaaattttatgactatctattatgtagtctaacttgtaaagtagacttatctgagttaatgttgtagtttacctgaaggaactgatttcttccaggtacgtaccagaaaggaagattcttaagggtgccacgttcactgtacctgcaggaaagagtgttgcatcgttggaactagtggcagcggtaaaactttttttttg

SEQ ID NO: 51025 - DNA, 1334 bp, Oryza sativa
ctttatctgaattttgggtacacttaaaaaattaggggttaggtgttctttttggtctataatttggacaaacatgcttatggtctgataaggtcatttcaaataaccatctggcatggttgtacgttttgtctatttatgtctgattcaaggctgactatagtgatttttttggggttgtatggaatgagatatcttgttttatcaatattagcaaaattcaaatttatgtgatcaacgaacaattcattaactgtattcctctacaggaaagtcaaccatacttaggcttctcttcagattttttgactcctcttcaggatctgtaagaacaaagaacgatctatttccattttgattccctgatgatgaaattgatatccgttttatagcatgtatatcttcagatgtgtatcaagcttgccattcttgtgatgccttttgtttgatctttgcagattcgaatagatgggcaagatatccgagaggtgacactggatagtctccggaagtgtattggtgttgtaccgcaagatacggttagctatctactgctctaaatctgtcaatgctgcattacttttcttgtcttattgaatttactatgctaaatggataaagcatgtagactatacacaattggaacattctggtgcccttgtgcaactttagttagcatatgtaaagttgttgagtaaatagaagtagctctatcaacatgcttttcacatatcagttaggagttaccacagttcactccaagagctcagtagctcacactgttaatgcattatccaatgcaggtactttttaatgacacaattaagcataatatacaatatgggcggttatcagcaacagatgaggaggtactgtgttctaccaatacatttacattatgaagttatagtactccccccataaatcccttatattttgggacggagggagtagggtcatttgaccttgttcaagctaaagtttatttgcgtacaggtttatgacgttgcccgccgggctgctattcatgatacaattatgaactttcctgacaagtacaacacagttgtgggagagcgaggattaaaggtgagatgcagtgtcttatgacatgccaaatccagaatagtcagaacctgttggtcctagcaataatgtctcaaaatctgtgattttacttcctttgcagttaagcggtggggagaaacaacgagtatcaattgctcgtgtattcttgaaggaaccttccattctgtaattccctctttccattttagccttaaaaagctttagattcagcgttgtctgactagcattaccatgcttagcaattg

SEQ ID NO: 51026 - DNA, 788 bp, Oryza sativa
agcgtcctcgtcctgctcgtcagcgtctacctgctcatcaactaccagcaccccgacgacgccaaccaggcctacttccccaagctcgtcgtcgtcctcggcatcaccgtcgccctcctctccatcctcatgctccccgccgacgtcgccaaccgccaggcctgccgccgcgccatctacagcggcgcctgctccctcaccctccccatgaagaccctctggctcgccgtctacatcgccgacgccgtcctcgtcttcctcgtcatccccttcgccatgttctactacgagggcgaccaggacaagtaagtagtatacatatacatttccactctttcctctatcccattgcgcatctgctgctaaactctcactgaatgttgttgattggatccgtgtgttgttgcttcctgcaggtcagtggggaagaggctcacctccgctctcctgtgggtcgccgtctccgcggtggtttgcggcctcatcctcggcatcctatacggtgcggatcactgctctcctttgcctatcatgctaaaatttctagactagtagtaatattggagtgggatttttgaatctgttcgaatttgctatgtgacctgttctacctgaatcttgagttggttggttactagtgttaattcttctggcttcacttggagtgactagctcaagctttgagcttttcaattagtacttattttcgagcaatcaatgctgtacaaaccaggaaggcagctgccagatctgaattgtcctgtttgagctttgcacttgttgtgtag

SEQ ID NO: 51027 - DNA, 11796 bp, Oryza sativa
  unsure (1)..(11796): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgattagtcctcctgccaaaggaactccactacccctgatcttacttggaaaggtatgttgaagcttgtattgccttgtaggaactctgagaacctaaagatacgttttttcacttctcattgtatctttttgctttgtgccatccacagtcgaagaatgcactgctatcaactttcctctttctggaccaaattgtatgggctggaaggacaggaatatacaaggtttgattttctcttcacatcattactgatatacataagcaccatacagcatatggttttatcatacctagatgttgacagtagaaattaatggtaggtaatctaattgtttgtacagaacaaggagcgagcagaattcctcagcaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatcttgcttttgatgacataatggcgtgtgatggtattggcagaacgagcaataccagatgaaactgcagaagtgcaacgagaggcgtctcgctctcatcaaatcgagcctcgacatagttgttgctatagggctgcttcaactggctcccaagaaagtgactccgcgtgtgacaggggcgtttggatttgctagctcactcattgcttgctatcaggtaccttaactctcacatattgtcatgtggactatcgtctgtttagagttagcaactgcaaaacctgaaactttcattttgatctgcttatttcctctgcagttgctcccagccccagccaaatccaagtgatccacctgaaggggtgtcagtgggcagttccaatgttgcaaccagtaagaaataaaagtggagctgcttgattgactcatgtggacttgaaaatcctttgtgggttatggttaatatgatgatctagtggattgctgcagctgtaattttaaggtgcagtacttgtgacaaaaaataagaaacttagcatgggaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagctatttattgagtgaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaaactcacacgtaaacttaacatgattttctagacatatatatccaagcgaattctcacagtgaactataataagattaaaatagcattcacccgttgcaacacacgggcatttttttaagtaaaattaaagtatttgacatggatagcaaatataatatattttgaccatacaaaataatatttctgtgcctcccttcgcccctccctgtcttcgcccttaagtgtatcgactcacgaatccatccatagatcaaatagatcgataacctttatgtgggggaggagtgcgcgtcagctggtcgggctagcgagagttaagccatggccgatcgaagcaagcaaacagccactttgatatgtaatgtaagcactgtacagtattttaccatgaatcaaatgattagaaaaaaattaataattacttaaattttttaaataagatgaacaattaaacatgttaaaaagaatcaacgcgcgttaaattttagagacggagagagtattatattatcattattgtatgtccacatgttcttttttaggggatatgtccacatgttatgaagcgatactgtcacaccctaaaaattcaaaatatataaattgttgtttaattggaatttttagaaataattttaaaagcctagaagagaagatctaattttttaattaataaattccaatataaaatggggccagataaaatttcattaaatactttgcttaatcctttaattcctagatttttctgggatttatttgagctaaggaagtatttttaataaatggaattgcatttaaggaataatttaaattgaaaaaggttttaaaagtcttcttttggctttgggccgaaagtcggcccaaaacccttctctctctcctcggcccagttcggcccagtccgcagccgccgcgcccacgcgtccgcccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatcttctctaccttttctcttttggaatcatcggctaattctttttggaaatcgttggattcgagttcgaatcggattcgtctctttcctccgaaccctaaaccttccttctcgtcgccagccgccgtgggccttcgccgtcgcctccgagcccctttaaaaggttccccgagctctcctctacccgtcgccaccctcgccttcgcctctcgtcgtcggaaacgctctagcatcatgggacctagcgccgccgtcgctccagccgtgcgccgccgccgttccagtcgtcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcaccggagaagagtttgaagagttccaaggccagcaaggcaagtcacacagatcccaaacaaccctttgagcatgttgatcccatttaaagctatggtttctattcaactattgcatttattttcgaatgtcattgggtggaattaacctattgtttgttatagcccttttgttcttgattactttattccttgataccttgggttattataattggactagttgagctttatatatattggttcaactagatattaggtatgattgcttagccatgcttagaaacattagcacactttcgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgcattgtttataagggggtgattatgattcaggaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattaactcctggtttggaatggtacattcctggtttggagatagaactgtgcagccgggatggttgttcagaatggttgggcctatacaacaaggtatgttgtatagcgttggattaatattgtttaatacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaataaggctgatggtgtggaggattaggtgtaaccttggtcaagctgcctgtggagtggagccgtctgcgccgtttatcttatttttccgctgcttagatctttattgtttgagaggaactatctacctctgtaatgacattttattcgcttattaattaaagtaataattgtactctattatcaatttgttattgtgtgcctcggctgattcctagacgagggttcacacacatgtaagcgtttggaattttggatagaaattccgggcgtgacagatacggcgaccgcttggctggtgctctcgcaaaaccaatcacaaggacaacaagagtcgtcagagaccgacggccgtagcatacgccacgtggccaccggcaggcgacggcgtctcacctggaccacggacacgtgtcagtggcgttgtacacctgtgagctgccgctgccgccgtcagcagaaacaaacacaaaaggaaatggagaggccgtccggaggagcgacgagcggcggcgcgtgggcacaccggccaccgccccacgtactactactactttcagcactccatgtgtttaagtactccctctgccccgtaatattgattttgattttttcttatgttgtttgaccattcgtcttaatcaagaaactttgaaattattatttattttatttatatcttactttattatccaaagtactttaagcataattttttattttttatatttgcacaaattttttgaataagaagagtggtcaaacagtgtaaaaaaagtcaaaatcacttatattatgggatggagggagtatgtgtttacctaaagtagtactctattcatattatttactaggaacaaaaaaatgccgtcgactttttattaacatttgatcaatcgtcttattcaaaatttatgtgtaaatataaaagtatttatgtcatgctttaaaaacatttgaagataaatcaagtcataataaaataaatgataaaataagacgaatggtcaagcgttgtaaagttaacggcgttatatattaaaatacgaagagagtactgcatcagtatcatactagaagaagtaataccagtactaaacagctttgatattttcgctagtagcccgcatatatcctcagttaatttgttgctttagttaaattgtgttaagagtgaattgcaccttgatctgagtatctttttttttgttatcgtagttttactttagatcacctcttaattcatggtttttactttaaaactagggaatgttacattttctagaatagatggtccaaaatgaagctctggaataaaatatagcccaatgtataattcattaataagaatagtagtataaaaatctccatgtaaaattattttcagttgattagtactcaacaaggtatattgtgtcacgtagaccataagatattgtcttgtagggatgtaagtggacaatctcactacccatataaagcctcacttgccaattactttctcaaaactttaaaagaaaaaaaattaactagaacaggtaaaagggaaaaaaaatcccgcttgtccgcttcccttggcatctggatggtcacgtggcaggaaagaacttgtacagtagtagtacgtgctagggtttgaagtaggagcgcgtgtcaatcaccaaaaaaaaaaaacaaaaaaaggcacagcagcgagtggaaaggagtcgatgggattttatgcccaaaaccgcgagagatccaccgctgtttgatgggttcgttgggacttgggaaggaatccatcggcgaatcgccgcgcggctccgatccggggcgcaagcgcaaggccaccggcccacgtactccactactcctactccgtagagaggcgacgcgtttgcgcgggcggcgccgcggccgcccaacccaaccgtcgctgcctccgtctccgtagtccgtactgcctgtgtctgcctctgctactgctgctgcctgagagcaggtaccatagcatagcaggctacaaaccagctacaaacatattttaaaaaaataaataaggagagagaatggtagcaggctacagatttatagccagctgtagcacggacttcaagacacagtgtgtatgacagatgggaccatatattaatagtgtaatatgtaactattatatgaatgagctattatattggctatagatgaatggtagttattagttggctatactattgaacttgccagagaccaaccagctactccctcacgtgcggctggattaaataaacattaatcaattaattaattatagagacaatcagttgccacttgccaattaaggaagaaggcataagtactgtagcactgcagccgcacactccacgtctccattgggaggaaatggaaaatagtttttcttttttttaaaaaaaaatagaaaatagtgctccttccgttttatattataaatcgtttgatatttttcttagtcaaaatttattaggtttgatcaaatatatagaaaaaaagaaacatgtacaacatcaaatttcattaaatttaacattgtatatattttaatataatgtttattttatattaaaaaacattactatattttgcttaaagtttgacttaaaaaaatctctactattataaaattgaagatgtttttgccggtattctagtacatcatctgtgtatgagtcggtttttaagtttgtttgcttttgaaaatatatatccgtatttgagttggtttgtaagatcgttcacttttgtatgatacaaaaggaatcatataagaaatctgtttaaaataactcacatgctaaattgagacgatcggattccaaactttagctcatgattttctaaaaatatatatatccaagtgaactcccacagtgaattttatcttaactaaactatataattaaaatagatttcacccgttgcaacgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggtagaaatatccgcatctcatacacacacagaagtggtcagccgccgcccaaaagcttgcctttgtcgccatctccacgtggccacccccatatactattgcttaacgctgtcacctcaccctctcgcggtttgagttttccacttccacggttccaccccgacacctagcgaagtactcgtagtaatccgaatcccaccgttccatccgtcgcggacgccacgctctcggctctcagctcacgtgacgtcaaccccgccaaaacgcgttattgccgtagtactacgcctcttcttccacctccatctccccctccgacatctccagccaattccagctcagctctcgccgccctcccctctcccgccacgtgcgcgccgcccctcctccaaatctccttttcttttccttttctataaataaatcaaaattcacacaccaaatcctatataaacttcttcctctccatccccttcccgctcaaactcaaacaccaacaccttcttcctcttcttcttcttccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttttgagctcaaccagctttgctcctcctatacagctaaatactgtaggagaaattaatggagattttttccttctttattttttttatattttttccaagataaaatggctgagctggtagggagttctagaaggaggaaataaagattacgagatttgtaatactactacgagggacagcatgcaaaaaagaagtataattgctatgctctctctctctctctctctcttttgtgtggagtggaataaaatgccagctctgcttatggtcagattttcacttttttttggagtgttaagacaaatgaaagctccagataaattagtgagtgctactgcttatctgaataaatgagatcattcatcatcctataaaagaataattaagaaaatgggtgtaccatatatgctattggcagacaaaatttagcagtacttgtaagtactagaatttggtttcactttattttaagtgagattgagcacttgtttatcatgctatcatcggtctacaattagttagaaactgtagttcgcagctcagttattactggatcaaaacttcgtcctttttttttattttttgagataagggtgtttttactcggcctcatatatgcaacctttttaaattagcaaattagcctatcaatcagaaaacttatttcttaaataacccaatctaaaattcgcttctatatatatttaaattcaggacgttgggaaggtcacttcgtccttttttttaagcttcggatcagttcgcactagctggagaagcagagatagttgcaccagattgatggtggttcgatgcctacgcctacgagaataagtactatatactgtatatgatattttcctcgtactagtatcatacgagtactttgcaaaaacacctcgtatctatacgtccgtgcttatatatatggctgtatatatacgtccgtgcatacgatcgagtactcggcaatggcacgtgctgagtactaatgtaaccctaatagtaaagggcacatgttgccgagagcttaagatactcattacggggagccgtgcgagtgattacatcatgtgacgacggatgattgcacggtctaattaattatcaattatagtaggtaatccatcgattagattagtggtcacacacgcacacacacaccggccctaatcgatcgctgaattaagacgcgtttccgcgggcggcgcagcggacgacgacgacaagatgtcacgaagcaggaagcaactctgcacgattgacaccagaattgttgtttaggtggtaatcctaattgtaatagattagacagtagagtaaaggttaaggtcttaggggggtcggcgctggcgctagctagttaggaggagtaggattctgtgaatcttgtgcacgtcgctggacggctggatacggatatggtccagccagccagctagcgctcatgttgagtcaccgtcacggccaaatggcagcgaccatgtcaactttgccacgtcactccggagaatactcttaacagtggtattttcaatccgtctcaaacaacccagtattagcactatgaatttaaacaaggcatacaagggacaaatgatgtgtctgtaagggcagtcccaaccctccacctaggatgatgtctatgacattaactacattgacatgtgggacttttagcttatgtggcactatattaattaagagagagagtgaagagaggaagaaactgggtctcatgcaagacacagcttcaacacgagaacctatgtaccagacactatcaagttttttgtattggaagagaatattgtcttcataatagatgaagaattaatatggttggtagagaagagagatgatgtatttattaatggcccactttaagaaaccataggttgtagagtgtagtttctattgtgatgtcttattgacataacaccatagataccgcttatggacactatgggttgggactgccctaataggttagtatattttaaaacagagattattatagtttagaatagagttagtagcgaaattttagtcttcagcagcatagttattaagagaaaaggacttacgctgtgtttggaggtgggtgctgggaacccattcccatacacggaaaacggagcggcccattaacgcgtgattattaaccattagcctttttttaaaaaatagatcaatatgattttttaagtaacttttgtatataaacttttgcaaaaaaaaaacgc

SEQ ID NO: 51028 - DNA, 3210 bp, Oryza sativa
atctactaaacctaattaatccgtcattagcaaatgtttaatgtagcaccacattattaaatcatggcgtaattaggctcaaaagatttgtctcgcaatttacatgcaaactgtgcaattgtttttttcgtccatatttaatgctccatgcatgtgtccaccacatttgatgtgaccgaaaagttgacagtttgaagggaactaaacacaaccttagcactccctccgttttttaatatatgacgccgttgactttttctcacatatttgaccattcatcttattcaaaaaaatttatgtaattataatttattttgttatgagttgttttatcacttatagtactttaagtgtgatttatatcttatacatttgcataaaatttttaaataagacgaatggtcaaacatgtgaaaaaaagtcaacggcgtcatctattgaaaaacggaggtagtagtattttatagtgaggttcacctctgaaagtctatgctttgtacttcaatgtacagccatacattctgaattagttcatcagaagacatgaagcattttattagtagtagcaattttctgtttcttaattgaattagcttctgaaaaccaagaaataatggctacagtaacacacgccttttcttttcagtaaaatcactgaaaagggttacgctactactacagaagaaaacagctgaattggtagcataactattggctatggctaacggctgtaatttagagagcatgaaagggaaatgcgcacccgatgagatccttcattccttgctttctttagttctcttcttttgacgacagctccagaagatgttctgcctccctcaagaacaactttgtcagctgcttttggcctctgcggtacactatgcacgtcctaatatttacttttgacttggtctcgttgctctcgtcacttctgtgaaaaagacaatgagagtaatggtgaaacacaaaaacaagaggtgtacagatggaaatgtcaagcatgatagtgctaatatgcagaaaaaagtatccattaagcaacgtcaaaaggccctacgtccctacctcgttgcgtcttctgaatcactgagatcgaatttctcaagtagttggctgtcagatgcttcagttccagtgccctcttcaagttcagtcattcttgcaaaagagaagggcttgatcaataaattattgacaacgccatagaaaaaatacaggtacactgacatcgaatttctcaagttgtgggtgtgttacttgactctaagaagatccacaagcaaactcagtgctccattatcaccactgacctcccatatagcactccggagctcatcatctctatcttcattagatccaatctacacgaacagattcaaaggatttctacaatcaatttaccatgaaataaatatgctcatacagaataatgctgaaaactagggaaaataaataatatgtgaatattaaggtcatatcagaaaatgtgaaactagatagcctaaatgcttcttgagaagctttcttaatccttttagatgagtaaaacaaccttttttatatcaccaagaaattatgattgatgatgctgccaaaattagtaccatgtgtgataaaattttggactcatggataatattttagtttgaaagcaaatgcgctaattttcataaatactgtttgccagcttacagtacaagtacaggaggatactggttaataagacaactctatggtctgttgagaagtggttaatatcttattaaccagtatccccaggcattagtcccctttatgaaaaagatattaaccacttctcaacagattagatggttacgaacaatgtcatgtaaaatttggggtactaaaatgtcccaaaggaaaaaggaaaaaaaaaaaggacagggcaaggcaatgtcacatatgcaactgatgcctttgaacacatggtacagagtgtgaaaaacactaacctctccaagcaatgaagcggtatgctcaagctcatgttcttgcagagcaattgtacgcagggtacttataaattcctgagagaaaacaattttctcgatatatgatggaaccttgcgttgaccactccagctataactagaaaaaggacttgtattatttttgttctccttgttttcaccagaacagctaccaaaaaatccattttcaagcaaactacgaggtaaaagacatcgcaattcggcattctgtaaacacagaagatatggaaagtgagacccgtgatgtccaaggatacttgttgggcctaaatttttcacaacattcttcatatcgtaaataaaaactagagctaagaaatgttgctacctgtatctccagtagcttcatcttaatatcagcagattgaacctgtcgaagagcttctactggataatgaatctgcatttggaacgtttgttagctctagtttttatttcaaacaagtagctactttcttaaggaagtacgccaaacggaggaaatatcaagtataagccatcttatcactatgaacatgtggagcacttcaaacaatcagcaactttgataatgaaaaagggtgggtacatacgatttcataatttgaactaaaagaaaggagatattctcagtgaataatggttttcttatcttttaaaatgttaactaaaagtttggtcctttatgtatcccagaacaccgatagagttacacttacaatatttagctggagaacaattaagtaatggctacctacaatgtttcaagacagacaagtgctttgccactataatgtttgacagaaagagaatatctggcagggaatatgctaaacaaagaaaactgagttgacaaacacctgttgctaaaagtaatctcttactgagtgttaccatgagataatcgtcaggattgttgtcaattacaaatccatagaggtatagtagttcctgcaagtaaacaaaactatgtcatttcatcagcaactatatttcagtaatcataaacggtatgaatatttgatgacatttgatcattttgtagtttctcggaacaaaagactgcagcgctgcagcttcttttcgttgactattgagtctcaaagtcatctatcagttagaagccccaaagtaagattattttatacttcagaacattagcaagtgtgtttaatgcaaatccataaggaactaaaggatatgtgaatccatgaag

SEQ ID NO: 51029 - DNA, 7108 bp, Oryza sativa
tagcctagtggatcccccttgtttattactgctgcaattaacaaaaccacaacttataatataaaagtcatttccctgtttccgtgttataatatccagttatgcaactagtttgttcaacagaaacatattcttgcccccattcagtttctttttttttttttgtggcacataccttgagaccactatatgccttcagtaacagaatttctctgttggtatgaaaaattttcagggccaagaaaggtcctatgcgatgttcctctctcttgacaacaaaattccattcaaggtcctatgctactctttcatgacaagaaaaagtcatgtaaccaatgtttaacctctttttcacttttcagataggttgtacatgagcaaaaaagaaacctaaatgaccacatataatcgaggggaaaaaattaagccacacacaataagtaaataaaacaattgagaagaacctctgaagctaggatctgcggtcagaaaaaatgcaattaacctgaggggcactgagactagaatcaccacaatcatcaccaatgttggcccgcttttcgtctagtgattccggaaaaacataaaaacgaggcaatggtatattcaatgctcgagtccagaatattgagtttgccctgccatagagtcgtgctgctgagttacataaaacaaagaaagcagggaactgaaccagcaactatgtgaaggaccctgcatcatatgtgtatattgcatttttcatttgttgacataaaactgttgttccaagatatttattgaaggagctgcaaatcaaagccatcacccaattaagtacaattttcttatgaatgagctaatttccaccttgatggcttgaaaattgtaatagtagcaaaggttagttgatgctaggtacaaaaacatccccaccattttgtaaactaatgcctaatttgtccaaaaaaaaattagcacactgaatcttttgcacacgaaattaacatgatatgccatgtcaatactatgaaactacagtatcagtaaggcttatattattccccccaaaaaaatgtaagccttataatatgacattatcactgcaaatgcaaagcataattatacataccaaaggaagtcttcgaaccgcacttcaattgagctgcaaacaatattttgatagtattactgttaaataaaacgaatttctttgtcagtaaacatatgatagggagtcatgagaattagccatattggtatatcattgccatactagacagtaaaaatcacaaactcggtaggtgggcatacagatgtataacagaacaatatttgagtgatattgcttgtggattcatgggttttaagtacgcacagaatcaataaacaaaaatcatgctggatacactctacttagcactagaagccttcacaagaaaatattcatttaatagggttggctgaaaagaatattcagatcaaaatatttcaaaggtacacaaagcccagtatacagtgcattaaaatgatttctaacgtatttataagttaaacctatgccatgtcaacaaaattcataaatgttctgtaaaataaaagtagcaatttatctcatagtgcagcattgccatcttggtgattctcatttctataaaattaaataaaaacataggcgctatcccagatgacaacaaatggtgcactcatacacatgaagatatggaacatgcgttaccccaaatcactttatatgagaagctattcttcatatcatactttggggtgcaatccccatgtatcgcagaaccccagtacagaagtgtatactaaaatgtaaaagaaactatgcatgtgtgcttgatacagaaatatagtgataaagttgcagcagcgctggaaaatgatgcgaaatcagtacaaaccttcctgattcatcgacgtttaagagctccccaaccagacctttaaccttattatcgaataaggtttgcaatgacttcctctgaaacaaaattgcagcatgttcgtttaaacgaatttgctcttggctccccaaaatatccccaaggaactgaaagaaaaggtttgcactactgatgaacctgcatcacggttgcccggtgaagtgtggtcccttccaactcagcaagctcatcttcggtgaaccaaatggagcttccgaaggtgcttggaagcatatccaaatacctagagaaattaccaaaattcaatcactgatcaagttgtttaacatggagagatgtggattgcgaccatacggcttccagagggagctagggcggagtcgctcgaccatgaggaagagcatgacgaggaggcggtcgtcgacgccaccttcctcgaagagcgcgcggcaccgcggcccgacgagcgggtcctgcagcacccgcatcggagtgatggcgagatcgagcggcaccaccatcaccacctctgcaacgagacacagccaacgcgcgagtcagcgcggaggacgagctcctaaaacctccgagagaagaggtggaatagcaaatgttaccgtcggtggcgccggcctcggcggcggtggagaagacgccgtagccctcgcggccgcagcggcggatcgtgcagccgcggaggtcggcgccgttggcctgcggagaggagccaggggtttagggatttggcgtgcacgcgagtagaaggggatgtgcaggagggacgaggagcaacctggagccattggaggaaggagtctagcttggcgtcgccgggtactgctgctgcggcggcggcggcagccatggtgttcgacgggcggcgccggcgcgggcgaagtggaagaagcggtggagcggcatcgaggaagacgacgacttggctgggccgtgggctgggtcagcgaccaggcccaaaggcccataggatcacaaatttgtagatactggaagactggaagaggggacttgatcataaattggtaatcacttgatccaaatatatcatctcttgagccatattttttctttgctttatagtagcaaatacgtcatctctatccaataatcactatattattcgatcatcttttcataatgaggtatttgaaatgtttcttgagctaattacatgggggtcaacttcggtttaagtttgtctgcaagcattcaagagagagcatggcaccaagctgatgttgatggatggtattagtgataagtagtgacaagtgcacaaaggagaccaaaaataaggaacacattcaacaaacagaaagcaagcacactactcggtaatctactatagcattatatatcatcaggtccacgttacattctaccactcacactctcatctcatctcatcactcatctcactcttatctttcagcttgcatcgcaggtgcaaggaggaaggcaagagactagcgaagcactctcacagccacaggacacatggtgaattgcacagataaacaaaatgctagcacaccagcgaagcccggagcgagtgcgtcgtcgacaggttggtgcaggacgcccaccgtatcaccgactcggcgaccgccacatccaggtgctcgcgctcgccggcgccgatggtgtggttcctcctgctgttcatgccgatggcgcgcgacgggttcgcccttacggcggccctcaggacctccgctgtcctcggagccgaggacgagacgagggccaccaccgtcgcgtcgcagtgagctttctcgcccaaggcgtcaccatcaggcgacgactcaggctcgccgggttcttggccgcagaagaaggagaagctcggcatggaagcgaccggggacgggaacacggcgttgcagggttcgcagacgccaccgaaggagaaccccgagagcgcgcacgacggagcattctcagcgacaaatgcagagaacgatgatctgcaggcgaatgtgggggagcacgcttcttcagacatgctttggcaggcgaccgggccaccggtgttgaagctcacatcgcggctgcatgacgccagcggcgtcgagaacgaacatgagccggcgtcctctcctctgagattgatctcatggcaatgtccacaagaatcttgggattggtcggcatgatcttgtatccaggaatgctctgtgtaacaacagttgtttagattactccacatggcaagcattacaaaaaaatggggaaaggaatcattagcagctgatctgtacagtaaggtccgggaatgatgcaatgacaaccaaacaaaagattccacgaaggatgacagaatgaaccagcacaactaaaggaatggctacaatagacaaaaggtgatgaagtgccaagaaattttaaagttcatctgtaccacagtggatctaccagaacatgaccctacaacaaactgtgatgcaacccagctttttcccccagccgtgcaagtttaaattagaccaccaacttaagctggcactaactcagtacttagcagccaagttttgttaatttattcaatatgtaaagtaaacaaggctaacctcatcaggaaaattttgatcaatttcgatttacaattccagttacatgcatgtattaatagtcagtgagcattttccatcttaaaaaaaaaaaggcagttccaagttctcaatatgatgctagtgatgtagaacaaggacaggaaattgaaagtgtgtggtttctgaaaagattgaggccgtgtctcacctaggacctgcttggctgtgagcctctgtcgaggatcgcgccgcagcatctcggttattagctccttcgctgaatcggaaaccttgtcccagggatcagaaggaaaccgcagctcagtcgacctgatacattcgaaaatctttgatttggttttcccccaaaatggggggatgccactcaggaggatgtaaagtatcacacccgcgctccatacatcggcagcctcattgtacccaccggcgagcacctcgggcgcaatgtaaaatggactacccaccatgccactcaagctccgacctgacaaaaccgaaacccaattcagcttcgaaacaccagccttgacagagagcagccacgaaattgctcaagaattcccaattataccaggctggatgtaggttgcgaggccgaaatcggcgagcttgatcggcgaagaaggcgatttgctgacaaggaggatgttctcgggcttgaggtcccggtgcacgatccccttgctatggcaatgcgccacgacctccatgaggtagcggaagagcgcggcggcctcgtgctcggagaagcagccgcgctcctcgaggcggtggaagagctccccgccggcgcagagctccatgaccaggtgcacggacgcctcgtcctcgtacacggccttgaggtcaacgacgttggggtggcccgagaggcgcgccatgacctcgatctcgagcttgacccccctcacgtcgtcgggggacacgaggcggtccttggcgatggacttgcaggcgagcgcctcgccggtgaccatgtcggagcacgaccggatcacgccgaactggccccacccgagctggggccccagcgcgtagcgatcctcgaggcacgacacgtgcgccgcctccagtatggcgccgcgtagccccgccgccttgtacgagttgtacttggcgtcgccgccgccgccagcggcggccatcgcccggaggtcccacacgctggaatcagacgagattctccgctgaaatctctcaccgactccccccccccccccccccacctcagtgcatcatccttgcttcttcggccactgaatctgggcacgaacacaaaccgagcagagaaaatccaaagctttttagcgctctcgaaaccccaaaatcgcgggcttttccatacaaatccccaccgagatcattccccggaaaaaaaaacaaaacgaataaaaccgcgtggattcaggagatggggggagcgccgcgaaattcaaaattcccaccagggagagaacccgcagaccacgcggccgccgcaccggaggaggaacccctcctcctcctcctcctcctccggtgagagagcgctccccacgagcaagtctccccgcgactcgagcccgcgcagatcgagcacccacccacccttgctgctcgacgcagaagccaaaaccaaaaccgcccgacaaaacgtccgacagcacgtagcggaggggggagagtcgacttacccgcgcgcgctggctgctccggcggccgagcggagtcgccggcggcgaggtcagcctccggcagcgcgaggcatccgggtggggcgagagagagagagagaggggtgagggtattcgttggtggggggagggggaagcctttgctttttgataggtggtaggagaaagaaatgagcatccaataacaaggccattaattaattaattaaatcattgttcatcttaaccctaggttttattttaaattgctctaggtttggctttggagtttaccttagagacttgttgctcttgtttgcttttgttactaactggagcagtagcagggtttcccaacggttaccgcggtaaccgtgaaaaaccgtacaaaaccatgcaaaatttatcaaaattttaatttattttttaaatttatttgaatttaaggaggttaccgcagtatttatattaccgtaccctcgcggtaagcccggtaaccgcgcggttaccggcggtaagtcgaaccctgagcagtagtactctactcatccctccgcataaaaattgtagactacgaatctggacataataatcttaggatggagtaagacgatttattaggataagattttgataaacaattgttctactaatatgttggttgtttatatagtaacaaattacgatcataagcaaatacttttaaatgtagatataataacatcaattttatgttggttggttaaatgattgttctaacagagtgaatagtatttgttgttgactctagaagaaaaaaatgattttcgccagactggttagttaggaagaggtatgaacgatgatgtatgagactttgaattgttctaatgtgtttggttggtttgaattaggtgcagcagttgtggtaaggtcttgtctttttttcgaagtacaaattatgcgtttcgggatttgt

SEQ ID NO: 51030 - DNA, 1802 bp, Oryza sativa
cctggtacaaatcactcaaagttattcattctataaaaaaaataatcttatgtttataaaaaattccttctgttttttccaatgtcgacccaattatatgtcgcaaaaggagtcccaaaaaactgcaaatgcaaagtaggacagaagcaaaagaaaaaccagaaagaaagtaaacacaaaaagggcccaatctcctaaaaatttgttgtttagttaatgtggtgatcatgccgatgtgtgatggttgccctctttgctggattggtttaaggagcactacaagttgtgcctctagtggggctacaaataattgttcttaagcaatgccatttgcatgcctttatttttttttttgcttattattttttgtccttgttctttctgttttgcaagtgattgatcaggggaaagaaagatctaatgcaatgttgtgtggttggctggcctaccagagtgggaaagcgacaggagggcgaaagagagatgcactgcatttaatttgcttccttctggtttcaacgggttcgtttgcttgcgtccatttcggaggtggaaaaatgaattagcacattccctagtcagaccagctagccgtagccaaaaattaaaatttgaaacttaaatttgagttgattcttaaaagttgctaagtacacatatcttaaagatttacgcataaattatttttgttgctaatcatgcttaaccaattaagattttttttaacggtcagacccgttgctgatattttatataaagaagaaggtgccccattttaagaggtaagtgggactaacctagtgctcagttaattagagaaagtgagcaaaaaccacaactgcaacaccacaccaatatatagctaacttaagctaccgcgacaaaacccaacacaaggcaattaagatcaaggatagagtaacctaacaaggataatgttgaagtgcatctacatatgcgtgagtatatacgacagttcaaaggaagaaccatgaaaagttgaatttgatgaatgtgtcgtttatggatgggatatgagccgttagccaaattaactccacaacatggctactaatacaagcaagaagagaacatatatggaacaaacaaatgatagcgacaacactaggtcttattcatgaaagaaacggcatatatagcatactcaaaaaggagaggaatcatgcaaagtttcaacgtagcactagtgttttcaagccggagaacaattctggtggtgggctgcaggatgatggtgtctctaagatcctggacgttggtgagtgttggtcggggtccaaagtggagcaacaccatcattatctcctaaaccgttttttgattaagaaattaaagatagagaggctcaatgcaatgcaaggaatctggaccctggaattatatggccagtgtggttgcaatttgcattgcattttgcactaggtgaaccactagccgaagcttcccacacgagctggtagctagctttgcccaaaaggttagcccggattctttgttgctccaaatcaaggaggctttccgtgtgcacggaaaaaaaaaaaagctagtaatgggtacgcgtgtgtgtgagagagagttattgtttatgcccgtttgttaaagctactccatcggataatgtgtgtatctttcttcgtgctctcatggatggattcgtatcctctggcttgacgtagcaatgtcactacgtgacattatttctatctaaaccatccgtttgaaatcaacggataatatatttgagcggtaacatgtgttttgttgataacattccgttaaag

SEQ ID NO: 51031 - DNA, 2271 bp, Oryza sativa
acgggaattttataggattttcagagaaaacagtttaattcctccaaaatttctatgaaaatcctacaaaccgaatagatccttagtattgaagtgtgaaaaaaaagagaatttcaccacaaaatttaccacacattgtttcatcaatggaaaatgaaatataccgtttgggatacctaggacgacattcatgctaacttatcatatgctttactttgcaaatactatgtcgatctcgtgcaggatatatttcagcaggtaacatgttttcttttttaatacactttgttggtgtgtggatcgagcgtatttgataagggcattgtttagttttccccatattctcaactttccatcacatcatatcacaacaaaaactttcctacacacataaaattccaactttttttccaaactcctaactttcttcaaacttccaacttttttcagaaactaaacacacccaagattattctccttctataaattctctgtccaaaacctcatgacactagtttgtcctaggtttaactttggcaaatgatatgtgaatgcaatgctctaactaaagagtttgtaccttgtactctaaacaaaccatttctcgtttggtagagtagacgacaacagctcagaggtatccgtacaatcatcagctccgctagccacgaaaccacaccgtacgttgaccactcatctgtcgccacctggcgcttagctggtctagctgtctgtgaacacgcagtgggccccacctgtcagatcctcggagtaagtgtgtaatgaatgatcttcgctggaatgtcaacggtggggagtaagtagatgatcacggtcggttgtggctgccacgtgatgtgattagatggagctgagatgctgatgtgtgtgattagtgggtaggattagtttgttcatcactttttgaaaaaaaaaaaacacaccgtaagttgtggaatggatccgttggccttggcctttgggccgttgacctactgcatctgactttcctatcactcattttttttattttttttcacatgtttacttttgtttttggaaggttttatactcccgttctaaacaaatcaatctatccagatttgctgtattaagttttatcccattaccatcatgattgatttattttgaaggacaattttactatcattgagaatgtgtcaggaagtatcatactttctaatgtaaaatttgatgcatccaggtactacagctactatgtactttgaggtaaaaaaaatataaaatataggtatctcgagataatttttaaaggattatacaatttctctattttgaaacagagggagtacgtgccttgtgcttagtaggtcatgcttatgtcatcaacatgcatgcatacagctcggcccaggcggcaaggcctatctggagttgagatgtgaagcccaaagtcatatcaccccttctttgctgtttgaaattaggcctgcttatcatgggctgaaattcttcggccacttcatttttcttcactttgcaggcccaacgattggaagcttctaactagagattttggcccgtttgtgaaacgagaaccaccgtcacatcttacgaaaacgctaatccgcgacaagtcgcgcggagcggcggacggcgcgtgtacggtactcttttttttttgtttttttctgttttcttccagcgcgtgtacggtttcttggttttcgttttttctgttttcttccgtatttttggtttctttttctttgttttcgttttttgttttcttccgtatttttggtttcttttggtttctttttcttttttatcgttttcagtttttttcggtttttataaagtttatatacgtgtatataaagtttgtatacgtgtacataaagtttatatgcatgtatataaactttatatacgtgtatttttttatttttatatgtacgtatacaaagtttgtatacacatatataaagtttatacacaggtatacaaagtttgtatacgtgtacataaagtttgtatatgtgtatacgaatatacgtgatgttttttttagtttttttgatttttttaatatgtacgtatacaaagtttgtacacgttatataaagtctgtatatatcatatataaagtttatacacgttgtatacaaagtttgtacacatcatatataaagtttgtatgtgtgtatttttttatacataaaaaatatacatataaaattatatatccttttatagtagtatactagtagtagtactagtaatagt

SEQ ID NO: 51032 - DNA, 3302 bp, Oryza sativa
aggaaatttgtggaattaaaatgagtttgatacgttccaaaaggtacttgggctcttagggttgtgaactaacggagcagcgattagcacgtgattaatttattatttgctatattttaaaaaaatggattaatatgatttttttaataactttcgtatagaatttttttaaaaaagtattatttagcagtttgaaaaggaggagagttgtgaaccattggtggtatagaacgcagccttaggagacgatccaggatttcccttgcgcgtttactggtcttgccgctgcagaacggtaactacaagtgcccgaaaactatatcaagcattctaaaaaaataaaatatatttttataaaatttactcctggttatatccaattgttcacggatgtcgtggtaaggtaaagggtccatttgcatcttagcaatagaaaaacggaggaatagagaaaacataggattttgacaaaaatacaagtgtgcagggacctgcgtagtaccctaaggtcctgagttcaaatctcctatggagcgaatttcagattgggttgtttgcggggctaagttccctatttcaatggccgtatatatccggttggatgtagaggccgggtaaaaaatacccttctctaaaaaaaataagaaaaaacaagtgtaaaatactctctccgtcccaaaatataagaatttttggacctgacacggtcttcgagatgcttctttgaccaacaatatctataaaagtaagatgttttaaataaaaagagttgcatattatgatagtttatttaatgataaatatggttgatcttcttttttgctattaattgttaaagttaaaaatgtttgacttgtcactatgctaataatgtttatattttgggacggagggagtagatgattgaaaaatacagaaaaaacacaggaatgatcgtttgattgcaccacaggaaaaacacaggaatgagatgagaaacatagactcaaagaaatttttttaagaggttaaacatcttgctaactttcctccaaaatctctgaggattacccattacatacgaatttaaaaagataagataggattcaatcatttatttcaaatgcttccatagaaatatttttcatatgattcaaatcctccaacttttctacttttcatacaaatcaaagggccctaagacagatgcaatctggaccgttcatgcgtggtgcgtgcagaggagcgctgagtgcagcaccaccagggtcccgaaaagcggagattccccccttcctcctttggctttctcccccaacacgtcattccttcctttcctttccttctccactccgccatccgcaaccgccacgcaaacttcctctctctctctcttctcggcgcgaatccagaaccttctagaaggagagggagaggagaggagggcccccgcccccacgggtcgccatggccgacgcgtactggaggtacgccgccgccgccgacgccgcgcgccaccaccaccaccaccagctgcccctctccgccgcccccgccgccgggatgcccgccccgccgcctgctgcttctcaggtcgccgccgccgggcagccgctcaagcggccccgccccgccgacttctccggttcgcctcgccacacctcactccctctcctcgctggcagctgctcgtctcggctctgaacccggcgtcgggtgttcactgtttatagggttttagggtctcgcagttgcaatgctcggctgttcttcttcggtcgtctctgggttgtctcacttgcgtgatatcgcgtgtgcatatcgtatcatgcatttcgtacttactgtttcttcgctagactgtagtggatctcccgacgatgcagtggcatttgttcgctatcactgaagctgtccatgaaaaattgcacgctctctcggttttggtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcatagatgtacctggtgctcctgaaatggctggctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcagctgacacttttttcttctttttgtactacagcaaattcaatcctatggagctggagctggagctggacctggtgctgaatctattaggcctgcggcaggtggcaatgctggatacccagttgaggatcgtccaatgatggctggtgggggcatggaagccagaaatattggctttggtggtgggatgccagagcctccccttccaccagatgcatcaaatacattattcattgaaggaattcctactgattgtgcacgtcgagaagtttctcgtatccttaaatcccatgcctttttctgtctatctttaatctttcatttgcacaaattgtgggtgtaaattattcataatatgcctccatctcttagctgctggtccttcaccttcccccaagatatcttccgaccatttgttggttttcgtgaggtgagacttgtaagcaaagaagcaagacatgtaagtgagctttttggtgctgtcacgcctggtctcttgtttcgttcttgttcatccatctaagtgctttgctgttaacagcctggtggggatccaattctactctgttttgttgattttgaaactgctagtcaagctgctattgctatggatgctttgcaaggtgagtcagtgaactatagtttgttgacactgagccatttatcaccttttgatctcaaatttcttttggctgcgtaatgcccaattaaatctgacagctgtgggtacaccatgtgaagctgttgatccatctctcctatcagtgtcttatgagtcatgatattgaacttgtgtgttttcttctctatctttttccctgtttttagttatctcattgtcatgcatgcttatatttggatgctttgtttaccaagatctgatagatgcttgtgatggttggtaatttggggt

SEQ ID NO: 51033 - DNA, 25549 bp, Oryza sativa
gcgcccccccccccccccccccacacacacacacacacaagatgttattgcgttgtctggggactaggcctgtggaaacactctggcagaaaatggcatagatatcaccatctatctatattactagtagctcgctggtgcttctcaaatggtaatttccccttcacttgacaacaactttagcaagctatattaattcccagtacggttatgatccacttatgatgcttgtcaatgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaaattacatggtagttgactggtcattgaaccgttcgtttgattgcttaatttccatgttttaaatcatgaaaattcatggttaattttgcaggctacaaattcgatgaacatgatcgcaattcaccccatttacggctccagtttgctcgttttactggccccaggggaggttcaggacctggtggtggtcgtgttaggcgttaagttgttcgtccttttatcaggtgatttgacaactctggctgctcaatgtttttttagaaacaacttgacctcaagttcttcggtggaccagataacatgagtcaatcgcttttcctaccttgtaggcatgatcacatcgaatgttcaagtgaaatgatgatagttcgttggtcgctctagatatattactccatagtgctaggattggtaaccttctgttgttccaagttccaactttggtgccttggctttgtgagatgctttctgacattaactagttattaaacatcaaagctgaaaacaattcgtggcatcgtgcagatgtgatgcttatggccggttatattgggatatatatatatacttctggagacaattttgccgattaatgcgtgttgggagaattttggtgcacatcacatatttgtgtacaacatattatctcccttccgcgtggtgttatatttagtagtctgttctggtttctgatttgcacgactcggcatgcttacattgttttgctacttgtaatcctctcggagattctaaaatgcctcctctggagcgaaaggtagaaattttacagctgcttccatgactcagaaatttcacatgttttttgctgaaactagtttaattcccacaaaacccctccaaaattatgtggtaaatttagatatgaatacctttgaactattttgcttgatgtgggctatgtggcctaggcctgtttagattcaggggtataaagttttggcgtgtcacatcggatgtacggacacacatttgaagtattaaacgcagtctaataacaaaacaaattacaaaatccgcatgtaaaccgcgagatggatttattaagcctaattaattcatcattagcaaatgtttactgtagcaccacattgtcaaatcacggcgcaattaagcttaaaagatttatctcgcaatttacacgcaatctgtgtaagtagtgatttttttcgtttatattaatacttcatgcataagtccaaacatttgacgtgacagaaggtaaaattttgccaatgtgacggaaggtaaaattttgccagaatctaaacagggcctaacagcatggagcaggacgatcgcatcaatcaaccgtgttatcctgtacataataaataaataaaagataccatcgagccataaaaaatgctgaaagagacggcccgcttgcctctattgtaaggcttgtagcattggatcgaacgaattgtcctcctcacagcgacgcaattctcccaaatctgccgtttcattcgtccattagctgaaaaagaaactctacaatctatctataaacagaaggttaggtacctgtgtctcaattttctcactgatgcctacaggtccggagtaaaatttgccgcaccttggacatggactgaaccaaaactttgcagatgcaggcagatttttgcacaaaaagtcaagagtccacataagctactccacggctactagctacaaaggcaggcactctggctctctggcacactggcacagctcccaactcctcccattatccatccatggcgtcctcccatcaccaagaagtacaagagcaaggccatggagatggagaggaagaggaacaagataatagccaaatcacctctccactgtgtaagcacggcaaagcctagtcgtctcagctgttttctttttcccgccatggaacaccactagaagaaagcaaactgttctgttgcctgatgagttcttctcgtgcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtagaggtgacatcaacgtgctgcagtaataacagtacaaggtgtcatgtacactcatgttcatgaacttgagcttcattttgtaggtgctgggattcgggtgggcgggaatattccggcggtatctggtggagccggcggcgatgtggtggccgtccaacctcgtgcaggtctccctcttcaggtaataagcaaatagtaattcacaataatttactctccacatgtgctataaatctgattattcagatatagcttgcctatgattggttaaaaggagttgaattgccacttgtaaagtaatctttccaccagtagaatacattttttttgcgtcgcatgatgtgtgcagccagttgcttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaaatatcatatcacttcaattatagacgaagagcagctattaaaactataacaagatttttcgtcccaaaccaaggcataacaattttccatttacgaccaaggaaacaagatcagttacaaccagcaacaagcatcaactaaaccttatacaatatcaagattcatttgagtaaacccgactagacattttaaaacaagatgtttacttccctagaggcttcaatgatttgtcagaaaaacatggatacaatttgtctgcaaataaaaaaaaaggttcagcattttgttgagatgacacttataaatcataataaggcataaatctgtgttgctctgccaatgagtgaattcatctaaaactttcagtggcaatctgaaaagtgagcttaatagccatactggacacacttgcaaatgcagaatcaaattagcagtaaaataataactttctccgtagtcaaaggatggctaaaaaaaaactaccatagaaaagtgaataacagatttgctgcacatgttcatcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaaggtatcctccccttccttctccctctaggtctattatgtaaaattagatacacagataaatttgtgacacctgtgtccagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccaggtaagaagtaaaagcataaaggcaaatgctaatgcacacatccaagtgtagcacttcagcttattatactgtatgtgacagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtcagcttcactagtcacatgaataaatgggtgtattgcttgtaaaaaaggaggataagcagattatcattttattcagtgttgattatgtccctaatagcaattcaaaaatagcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatagccaagtttcttctcatccacagtaccgccggcaatggtatctcaatcatcttaaggaggatgcaaagatcaaagaaccatgcagagaggctttaaacaactcaaaatgaagaccaaaaagaaaatgtccatatgttacaaggaagatgatactacaaggtgtaccgaatacaaaaataagtaaagttatttggtgcatgctaaattgttgccggtgacagaaaacagattatgataatagatgaactgaatttctgaaaccaacactgaattgaaagacagtagccatcgtccatagaaatagttaaagtctgaacatgattccacttacctgtaaaggtaacatcaggatcaccttagcctttaatcatcacaagaaccttgcaggaaaaagtaagaaattcagatgttacttttgctttgagggaaaatgaaacaatacggtcagcatgtaatcctgtatgaaacatggataatataaactgcattatatattgtttcattggaagtataaacagttctgattcatcgtcatgagctagcatatgctactagaatatggtgggaagtgcggtgctgttcacctactatcggcattccatgatttctcaactctataatacacacacacacacacacaccacgattgcaccagcttcagtgcagtatgactactcttacggttctcgctaggaaaataacagagaatgtgaatggacgggtgaatctacaaacgtactctttccgatccaaaataaacttagtgctggatgtgacacatcctagtacaataagtctagatacaaagatattcagattcatcatgtgtgacatccggtacgaggttggtttattttggaacggagagaggaacaaatacagcaagggggaaatcatggagctgttgcccgaatatacttaccacttgccatctcccgcaacaataggtgtactctgaggccttgagcaacacctggtggaatactggagatttggagtgcgtgatggcatcatccagggcgtgctacgcgccagcaagccgggtaggcatttggacgagcaccgtgtgagcgaaaccgacgccgcgccaccagtgtaactttgggaattgggagcacctcgagcgagcgaggccgcacgccgccggggacgaacaggagccagagccggttagcggaggaaggtcttcgcctagggtttaggaaccagaggcggctgccggcggagggcaaggggtgcgcgcggcgcaggagctggagaggtgagaagcgcgtgggcgtttggagaagaagcggatggtgaccgcgccggccgggggcgtgtggagcgcggcggcgaccgacgaggtcgccggcgcctgacgcggcttgccgcgtgtccttgaagatgggcctgaccgggccggccttttagagatgtgggtgggctggatgggctgcatttcgtgaggcctaatagcaccgtggaatacaattcagattagcggacgccaaaactgaagctcttcagagagagccaaaaaaagaagaagaagaagaagcaaactataacatctcttttggacgacacatcaaccaatgcaattcagttttgaattggataccatcaaaacaagagcaaaataacagatgaaagatggaagtataactttcagatgacacaaacttcaccatccatggagaaatataacacatgtttcatttcattctgattctgaacagagattacatgtagaatgaatgatgaaagaatttgattgtaataataatgttgtataataacagccggagacactaatagtgactgtgagagatgctgcccctgctaatctatctactgcttctttgctttctttcttctacatgcagctacattttgcaggggactctctctcaacagccaaaagaatatttataaagaattacaatctaaaaattgaattgaatttgatttaattgaatctttccacctatcaatctataaaacaaaaaactacacctttctttcttctttcttttctctgaatgtataaaagaattgtcatactgtatgaactaatcatcattaacaaaagaagcactgtaaaaaaaggctttgttctttctttctcttcacctaatcaccattcatcgtcagcttagctttgctgagaatgtgatgctgttgtggacgccgacacggtgctgcctcccgcgccgtcgcccgccggcgtccacgccgtcacggtgtacagcggctggtccagccaccggagcgtgagcgcctcgccgccgccgctgccgccgccgccgtgcgcctgcacggtgtacttgtccggcccgaacatcctcgcgatcatgcgcccctgcatcgcctcgcgctcgccgatgccggcgttcttgaacccgccgccgtcctccatgcgccgccgccacccggcgaagctctcgtggcgctcgaaccgctcggggccctcgaacgccaccgcgttgcggatctcccgcgcgaacatctcctccgccttggccctcgcggggctcgcctccggcagccccgccgcgtccaccgcgtcgaacgccgcggcgtagtaccgcagcgcgcgcgcgaaccgcgcctcccacctccccgagttgaggccgccgccctcgtgctcgccgaggaggaggatggtggcgcccgtgctgcgcgctagccccaggaagtcggtcagcgcggcgtcgtcgcggagcaggcggtgcatggcgaggacgcagttcacggccacgcactcgccgcgcttgacgtggagcatccacaggcggacgtcctcgagccggtcgaccacggcgtggaactcgaacgccaggccgagcgcggcggcgacgcgcgccagccgcgctcccgtctcctgcagctcctgcctcgactcgccgactccggtgatccgcacgtgcgccggaggcaccgcccgcgcggccaggctctggagcaagcccggccattggagcccctgcttgatgtcgaagtcgatgacgtggacgcgctcgtgcccctcgaactcgcggaggaggcgctcgttgagcgtgaagtgcaggaacctcgggatgggcgtgatggcgttgagtatccgcagcgccatggcgtcgtcgtcgccgccgccgaaggcgtcgtcggtgagctcccgcggcgggccgatgtcgaacatgtgcggccacatgcgcacgacgcggagcgcgagcgcctcggtgaagtaggcggccacgcggtgcatcggcgtgggccccgccggcgaggccatctcgccgagccgggccaggtagtagttggcggcctcgtggttgccggcggagagggagtcggcgcacgcggtgagcgcgcgcaccagctccagcgcctcccgctccgcctgccccggcgccggcacgccgttcctcgcgtcgaactcgggcggctgcggcggcggcatcatcgccgacgagccgccgtccgtgcccgacgaggacgacgagtcggacggcgacttgctgtactcctccttcttggccgcggccagcgatggccccgcggcggccatgccgtgcgggaacgccgccgcgctcggcaccaagaagaccttctcctcctccgcctcctctccttctcccgccgccgtcgcttgcatcgtccctgcaatggattgatggaaccatacctcatcgccgtcgccgcccatccgcgtccgcttggcgcgaacaatggggccatactcctcgaccgcgtcctcgtcatgcgcccgcttaacggcgcggtgggcgccattgccattgccgccgggctccggcttggcgccccaggacacggactgggtgaccggcggcgcggggtgcgtccggaaggagcaggtggtggcgccgctcctggcgtcgccggcgacccgcggggcggcgccgtcgccgcggctgccgcgcttggagaagccgcaggggaggatgtcgaaacgctgcgcggtgctcatctgatgcctcgacgacgagaacgagcaacccgccaacatcccggagacacgtcactcgccggaacgcgacgtgccaagaagagacctcctcctcctcctgctcctcctcctcctcctcctcgtcttcttcttcttcttcctcctctgtttctcactctgatttctctcacactctctctgtggtatctggctaaggctttggtggaatggaaatgtatatgattcgatgtacaaaagaatgagcagataaaaaccagatgatcttgttgttcttccaaagaatttggtcagtaaatcaacaaagaaaaaactgagaaaaaaagagagagaaataatgtttgtgagatcagatgggggctatgtgtttgtaagtatatatgcaggaaagaatgggtggcttcgccttagaatgcttagtacaaaagaatcaaagaataggatcaagaacaaatgggccctaaaacatgtagaaaaaacaaatcacgaacgatcggacatgccggggcagagcccgcacggcctcctcatcggcgacgacgacgacgagcagcaggcggcgaatcccaacaatacctccattcgtcaaaacaacaaaccaaaagaaaaatcaagaaccctagtagaacatcctaaaatgatggatgcaatgcgaatcaatggcgatggagatggagatgcagcctacaaactacgctatcctagtgatgatatgaaatggaacctactcttgttgcctcaccattaccactcctctctcactaacctctccggtggtggtggtctctgctctcactctctcactctcactcacctctccggtgtggtggaagggaagggaagaagaggccgggaggggcaacccaaggggaggaaaagagtgcgggaggcgcgaatctcgaggcggctcccacgccgtcggatcgcgaccggacggtgcgagatggggtggtccgggatgtgaccgttgcctgattgcctccccccctctctggtcaatgtgaccgttgcggtcaggtgcgacgcacgtgaccaccccccctaacgctgtcacgcacgcgtggacgcggtcacgcagcacgcccccgttcttttgttaccgttgggctcccaccacctgacacgcgtgtctgacgcgtgggcccccgcgccgaaccgacggcccagatcgcgtgagccggacgccacgcggtgcggccacgtcagcgcggcaacggacgctgagctgtacgtacaggctagtgtacagggtggggtacggtgtgctgtacgacgtactacgtggctgtatcctgcgtgtctggtgatgatgatgtttgtgtgtttgccaccgtcggatcgggacacgtacgcacgcatgcgtgtcccgtgttttggcgtcaatgcggggctcagttaatgatgtgccattgctgtcagaaaaaaaagtgtcattttggtacgtgacaaaataccgggtgttttacttgcagacagctattgtcattagctgggttagctgctggtatatttgttttggctactaagtaagctcgagttttgggtttgttttgatcttgaaatgcatcattgtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttccccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctgatcacatcgactgccatagtagtattaaagtagaaatacatgttctcccaaagtgttcgtatggtttcttgttttatttgttctggtttgacatgtactcctgtaatgaatcaagtaaaaagtttctcaatacatcaactggtcattgcctgtatgcggtgtgttcgacgaaatgcttattagaactcatgccattctgggggcgcaaccagggcgttcgatgaaatgtctctgagcataagatgttccaagcgaaggagattgtgttggggaaatggattatggatcgcttggctccagccgcacgcgcgtcgcctgttccgtttctgttcaccaatccccttcccttcaatccttcccgaaagacgaaacgagcgccgcgccggcgactccaaccaaccgtccaacagaaccaagagttggagacttgctgacagctgactttagcattcgttttcccctgttggcctctcctacacatgaacacatctgttttagagctaggagagagtttaagagaaagggttcagatcggcgattcttgcagacaaccatggtatgattttcttgattattacataggagtacaatacaactaagggtgtgtttatttcacgccaaaattgaaagtttgattgaaattggaatgatgtgatgaaaaagtttaaagtttgaacaaaaagtttggaactaaactcggcctaatatatttttttgctgccttgcaaggttctaaagactatataatatatttttaggtgtttttttaagagattagagcttgccttcttcatgtttcgttgacacgttttcagattccagccgatttgcaatttgcaaatcaaggtactactatattgtacatttgtactactgttcttggtattatgtcagtcaggaagtatttatctagaagtgaaaaaggaaaaaaaaaaggaaacgagtagatgagttaactgaatcttaatgggagcaatcgagaagttctttaggaataatactgattcctttagaaatcccgatgaattggctttagttgttttcaacgagcaaattaatgacagttctagagaataccaataaggcaatagcatcaatcagaatgaagatgtcaataacttgagtgagcatgaaacctaacatgattcggctgatacaaattctgtgggtgttgatgaacaaccaacttttgctattgaatttttgatccaagaaattggggtaatcttgataataaagcaggagatatctaaataccgatttcagggtgcaatctctaccgaatcattgggccacgtggccaaagctaaaagcaagctcacatctcgttaaaatgtgccatgtgtccagaagagcacgttccattccgcacgactgtgaagactctagataaaacaaaggaaaaatccagagcattccaaactcggttgaaaatcacaccaaaacacggaaagaactggtgaaaaagattgcataccgaggaaacaatggagaagaaaaaaaagtgtctaaaaaagtgccccaagttttttaaaggaattttttttaaatctaactataatataattgtaatataattccactataactatactataacaatattataacttgtatataaggtcctttttagttggtgaaatgaaaatttttgggtatcacatcggacgtttgaccggatgtcggaaagggttttcggacacgaatgagaaaactaatttcataactcgctggaaactacaactatactatactatatattgtagttacactgcaactatactatagtaatatttgaaagtttttttttccaaaaaatataaacagcgagccgatgttagctgtcgtaaaccggcgacgaggaagacatctacaacagtattttccggatccacggaagctatttccaacgagcaagatccactcactcaacggatcaagcgaagggcgtcgagccgtaccagctgtgatggtccgcgagtgtggacgcatcaaccagccggtgagcgtcgaggtcgaacacgtccacgccatccacggtagcaacgaccacgacctcgagctcgaccacatccaggagaaagagagagggatgaagaagggcccaatgaggatacccagatttggaggatcaagggacgagggcgatgttgcctctgctaccatcatcttcctctttttctccttattctcgcaagcgtcatcttcctcaattgctcatgcctttctcccagcaccgacgcggcaatccggccttgttctcgcaagcgacatcttccccaacggttgtcgcctttctcccagcaccgacgtgccaatccttgttctcgcaagtgtcgtcttccccaaaggttgtcgagctgagaggtaaaaagaaaagaaaatattaaaacatgaggttttatcaacacttatcataaaacaaacaaatgataaccgtaatattgataagtatatgttaaatattataaaaataataggtatatttgttaaaatattattaaaataatgtgagcgatgatgattagatatacttacatgttgatttgtagaattaaataaattatagatgatgttatacgctagcatgagtttaaatatataaatattgcttttatctgtagtgattgggccacgtgtcctctctcacatggtagataaatctggagaacaccaaaaggggaaaaaatgataccaagagttgggcagttgtgcgtcgagtgcgaaggaaaaaacagggttgtgggtccaatcaatggcgtgcccacatataacttaccggtgtcacaggacaccgggtaaaattgttaaattctaactaatttatgctattttgattagtatactagtgaataattagataactactatgtagtggacctcgagtaatgtagtggaccccgggtaatttttattctagattcgccgctggctccaatcctcccttgcagatgaaaggataatctaaaaggatcgattaggcaatcagcaaatgcctctgtcaatggagccaatggtggccacctgctcaaaatgtatacgttcgctgtgtgtctaggagtacgagggaagagcatggctgtggcagctccagtcctctcacgcagaggaaggataatctggaagtatctatatatcaggggaaggagcaaatgcctctgtcaatggagctcacttgctctacatgtacatgttcaaagatagagtattctatagtacatttgcaaaaaatgttagaatgcatatacaactactcatattcatatatatctctataagtattttcgaaatattgagctgcatatcttaaatgaaaaaaaaaactattttatctcttcgaaccaattcaatggacactactaaaaaaatctatcatgagttaataacttaattgtaatttaaaaaaaacaaaggaataactaatggcatggatggaaaaagggagaaaatttgatgattttctcaacaatatgatctattacgttaaactggaactcaaaaaattccattcaactaagatttttttaaacttttatgaacaatgtgctaattaataacacaaaaataatatatacgggctataaatcatgcgcgccaggtgcgcatgattttctagttttagtggaaatggggcctacaagagaagaaaatattgttttttttgttgtgttcaacttatgaaaagtattattaggcgattggaaattggaatgacagttagtatgacttacggatgtttttgttcaataatataatgaattattatattcactattgcaaaaaaaaaagttatgagggcctctatctttatttcacccaagggcttccaagaagttaggactggccctgaataaaaccttcattggaatgaatggatgaattttcagtgtttgttttgtgagaatcgaactaatttcgatgatgatcctgtgaaatcttaaactattttctcactaattacttcaggctgtgtttagttcacatcaaaattagaagtttggttgaaattggaacgatgtgacggaaaagttagaaatttgtgtgtgtagaaaagttttgatgtgataaaaaaattggaagtttgaagaaaaacctttggaactaaacacggcctcaatcttcgtaaaatttctccgaaattcgtcaagtccaaaggctgcatgccttgctgaattctgtccacacaacaaacgctggtctcgtgtcatctccacatcgccggagaagaagacgatgatgacgtcgacgacgatggcgaggcccacgacgttgctggcgtgctgcaagctctacatctccgagagccgcaacgacgccgccctgcgcgccatcgagcaggcggcgcgcggcggcggcggcggcgccgtcgtcgtcaaccgcttcaccgacgacgcctacaaccgggtgggctacacgctcgtcgcgccgctcaccccctcaccggcgccgccgccgctccggcacgccgtgctcggcatggtcagggcggcgctggaggccatcgacttcggcgcccacgccggcacgcacccgcgcctcggcgccgtcgaccacatctgcttccaccccctcgcccatgcctccctccgccacgtcgccgacctcgccggagccgtggccgccgacatcggagacgagctccaaggttggtgctgctctccactcctcttctcctcaattttcacttcaagaaacaatctaatggcgagctcgccgctgccgaggccgcagtgccgacgtttctgtacggcgcggcgcaccgggaggggaggacgctggcctccatcaggaggcagctcggctacttcaagcccaactcctccggcgaccaatggcggggagcgccggagacggacgccctgcccgtcgcccctgacgccgggccggagaggccgccgagatccaagggcgtggtggtcgtcggcgccaccagctgggtcgacaactacaacgtgcccgtccacaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgatttttcccaggataaaatcgtcgacttatacttcagatcagcagccaacactgagggttaactgcagcgcgagtgaaaagtaaatctttacagaaataaatttgatatgatttcacagaaacaagctctcaaccagtggatcactgatgagttctaagttccaactcaagaaatgcaatcacattatcatgcgtaaaatttaccaaaaaaaacagaacaaacgaattgattcaacttaaacttcggtctctgctatatatatatatagagattacatctcaactgctggccagttgattgaactaatcatttgcatatcttgggctacttaactcctgactgattaagctaaacctttagtttgtaccgtgatggccacttgattgaagcggctagctatctctctagctaggctcagtgaagattttgcgagggaagctgagattttagaagaaactgagagtatgtctaaattttcagtgaaattccacgtttctctccattagagttaagtgagttttttaaagaaaattgttactatttccactagcaaggtatatgagacaatatatcgttttccaagtgttgtcactagttaccaattgtttcttacacttgccatctcataaacccactaacctcgcgttattaggtacccatatataaagaaaaataagcgatttaagcatataaactccattgcttagctcttaacattatagcactccctctctctctctctctctctctctctctctctctctctctctctcttataatagttgtataataatatgaaagggaagaagtgttattcgagttctcactttttcttttttctttttacttcaattcagcagactgatttttttatgacacatgatgtatggtatctcgttggcgtatctcagtgaaaactatcatgatggagaggattagaaaagtcagaatatcattggtagtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggccatgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggttagttacttttaccgcgtttacttctcagattaacctggtgatgatagtcactgactggtgggcccagtcccgagtggagtttttccttgttggttgactggtggtcaacgtaatctcgaccgcacatctctgatctgacggctagtggtagagtttgactggttgaggttgatattttacaatcgagtccctattttattttccaaaatttgtttgcaattcaatccctatgaaattcgggctgctatcaatatttctccaccacagttgtgttgttttcatgtttttttttactgtttcttgatcatcagcgcgtagatcagtgtacactttttggagcttgtgttgtgtaccagcgagttaaacacccatgattgtgtttcctagtgctggtttgtttgtagtgaaaaatttcctgatgtagcgagttaaacacccttgtttttttctatcgtatttttgccaaaatgtaggggaaaaaacccttttttttagccctgcgaaaaaagtatggttttttttctactgggtaaatgcctgtggatctccatgtagtcatctgtgattaacaccttcaccagttatccttgccttatctgtttgttaattgttggattaaaaatgccactaggatagttgaatgttcacaactagtactagacatagagtacatggatgcttcgaggacagacagcaaaattagatatatttggatcagcttctggatgtggatcaaagctggttttatgttaactaagtaccctctccatgtgtagagtcggtgtgagaaattgaaaaaagaaacaatggattaattgatgttaggtctgagtcggtgattgatatctagtttggtaggagagttcgatagaagtgtgcacatggaattgtgtactgatgagagcttatttggataagaaaatactaatcatagtccaactaaccagacggcagatagctttatctgaactcaactgtgcatctttggatctggttgctcgtactccctccgttcttaaaaaaaataatcaaaaatcaagtttttaaattagaaattggttttctttcaggacgaagagcttaccttactaattgatcattcttgctacctttgtgttcactgtaaagatggtacaagatgtctgatgcgacatatatatccagctatcaacactattgaacaaaatgtccaagacatgattttcttcccccttgttgttggcttgtgtttcttggctaacttcaaccggagtacgacgagtttaacactagtatcgtttacccttcggcctgtaatttaatcatcataaataaaacgatggttgtataaaacgcgtcaaataagatttctcgtaaacaaagttttttcatcagacaaatcatccttactcgggaaacactcatgcatgagtcaagctgttggctatgacaattgatgagaaatgcccaggggttttccggctagctccacagggtggtgggctagacgacttgggttcagagcttcacctcttctaattatttgatattaggtcatttcctaatatccgtgtcttctttgctatgacaattgacaaatcaatctgatgctaatgtgcactgtctactactctgaactctgaagtgtgaacgaaccacatgtgcaggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacagtacgtgctttgtaactccaccacctcaaatttcacccctgcaaaatcaaacttgtgcttaatttgatttggaagccaccaagttgacaggctttttcgaagttaaggacgagattcggtcaaacttttgaaattccaaccatccatggataatacctcaaatgcttattttaaaaacgaaagaagaaaaagtactaaagtagtatcattgtatcatacttattataataaaaaactagcatggtggcccgcgcagattgcgcggctagtatcattatattttctctcatataatagcatatatgttttctcattatattattcaaatatattaaaatgacaacataattttaaattttgcaataactttacaaaactactaatgtgtaatattcatattatattttatatatgtttagttattaattatttttaatatcaaattttagttatttgtaaattatatatattcctatatggactctagacttgtcttttaatatttattttttctaattccgaattttctgtaaattatatttctatataggctctatgctcttcttccaatattatttatttttatttttgaatgttcatattatattttatatacgtgttagttattaattatttttaatatcaaattttagttatttgtaaattatatatatatatatatacatatatatatatatatatatatatatataaaatttaaaaataactatatatatatatatatatatatatatatatatatatatatatatatatatatatatatatatatatatatatatatatatattcctatatggactctagactcgtcttttaatatttctttttttaattctgaattttccataaattgtatttctatatagactctacgctcttcttccaatattatttatttttatttctgaatttttattatttctaattgtatttctatgtggactctaaactcatctttcaatattctttaatttttagttttgaatttcagttacttctaaattgtatttctatattgaccttaaactcttcttcccatgtttttcttaatttcgaattttagttatttgcaaattatatttttatacgaactctaaactttacttttaattttcttatgtttattccaaattttatttagtttaaaatccctatatggactctatactctacttttaatattccttatttttaattccgaatttcagttatttcctaattgtatttctatatggactctagtctcctcttctaatattccttatttttaattccgaatttcaactatttcctaattgtatttctatatggactcta

SEQ ID NO: 51034 - DNA, 885 bp, Oryza sativa
gtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaagggttcgcaaaaatggcattcatcatgctgatgatcattttgagctatagattggaacattggaggcagatttatagaaacagatagtttcagttgtcccccctcttctagtacagatagtttcagttttctcctgtcttctttccatatataggttctttattttcttaaaattctctcatattgttttagttttatcctttccatttcatgccatatggagtagcttttttttatttacattttcgttttctcctttctctttccttccatatatgtcttttcttattattttatctgtcaatttatctgacgtaaacggatattaaagaaataggcaccatttttgttaaggtgtgaacagtcactggatttcggattaacatgatacggagtatacatttattacgttcagcttctttacggtttagaatgcggttaaccagaattgactttcatctggtaaaattaaacatgccgctaaacaagggaccataacaaatagagtgaaatttggaacaggacagccaagtttgtccccaaaagctcgattggttgagcagtctgaagatgagaagcaaatgcagattgacagaggacagatgatcaagacatccttaatacaatctagaagttcgtatggtaatcacagtatggtacatatgaaagaaatcaactgacctaactcgatacaacccaacaaagaacaagggg

SEQ ID NO: 51035 - DNA, 2722 bp, Oryza sativa
cgatgagaaatgtgtacattacaaaggcagctgggttctgcttttagcaaccatgtccgtgccctactgaaatctcagttttctccttatacttcatggttgctaatttacatggataaactctccagctctttgagaaagcggtttcaaagatcatatacattgctaaccaatctatcactcgtgaacaaatatgtttgtagttcaattcgtcaggcttccttacagaacaaaccacaaatcaatttgagagctggaatcttcctgtcggtttcctctttcgccatccctgaacaaacagttcaggacaaataagcaagccaacatttttccagattttcatacgaattgactgaatactttggaagaatgcacttacaaatattgcatagtaaaagagtgtgagtatcgcaagagccacaaagccatactggaaaacattgtacctgcatattcagatgttaaaatcagaacattttcaaaagtttgatgctccaatatccaccacatggatatatccagcttattcgagcaaacaactgtaaactgactatggatttgcatgctagatacatacttgtagagatacttaattccacggagagattgcagtgtgtggccaaagatctcctgagctgcagttgcttgcgcataataagcaaaagctgtggcacagaactgaatcacactgcaaaagattttagatggcctcttagtggagaaaattaacagataatcagcaggtatgcatatgttatggaggaagcaaggttgatgaaaccaacaaagtcgcatgtcaacatgttgaagcgatttttcagctgcactaggcacaagctaagctacgtcaactcaatgtttgctctacaaaagttcttcatttacactactgctaaccgctaaaggacacactgactttatattactagaaacaatttcagatatatgcaacaaattcacaattaatagacgctaccttgtcagcatggaaaaagttccaatatggaagatggcatcataatttacaaaaataatagcaataaacaattacatctaaaagaagcctcagtagcacacctgatggagcaaagtaggatgagtccaacattaaacaggaacgagttcatcaaagttcctccccatctgaaaaaaaatgcgttatcaatgattccaaaaaagatactacatagaaaaggaaatgccatgggatatgtcaaatacttcattgggtgaatggtgatgaaaactaatttcaaacccagcatcatttccccagcaatcactgctatgaggagatagaaacagaagaatgcaaaggcagcagtcccaagcagacctaatacagaaaacagaatattggtcaagctactgtcatcaataggacgagttcagaacaatgtaatgaacagaaatataccccaaacaccatccaattttacgaagatttcattcaggaaggaggacaaaggagggtcaatcaacaagtatatgacgatatgtgcaacccaagcaatcgatataattaacctgagatcataagtagctattagaagacaattgcagataggttggactagaatagaagcaaagtccgtacaactatttacacatacccgacagcaccaaataaaagttttccaatgtaaccaagaactgtcaaagcccaggtagcctcagcctgcaccatgatggatgttaagccagcaataaaccaaaagaaacaatgtaaataggatttcatgttcagttacctgttctccttgagggtacatctcttcaagagccttcatgtcatcttctaaaagtactaattcctgatgattaaaagggcaggcaaaacataataagagcattaatagagcattacagaaattattggcatgtggtacacaaatggacacgagtgttctgattagaaaggaaatggaacacaaatgcttcttactccacactaatctcaaaaaggtaagtttgttcactgagtgaggctaaaagtttgaatggcaatgctcaccttcccaagggccttgacatttttgcgccattttctgcccttcttcccacttttctcttcttggtgaagggcttcagctgctttcttcaattcccgagccttcttacctagttcagttgcttcctgcagaaaatatgttcagtctcaatccacattgaaaatttcaaagtgataattatatgtagtagaaaaatatggttctaatgaatgctcataattgaaaagaagtatgtgagaatataggcacctttatatattgtgagcgtgtaatgacagcttttgggcgccggacaaatgagaatataagtcccaatggaaggcaagcaattccaacaccaccaaatatctaccaaacaggaataggaaagttgtaaaaagaaaccagcatgattgcagcagaattggatgttggaaaggatccatatttcaaattgtttctagtacagcttacactcaataaaagacataaagctatcggtcacatgcagaccagtagagtgaatagatgtagctatacagaaacggtgataaagcaaaacatgaagattgaagtaaaactcactgtgaagagaacagatccaacgatggtagcaagagcaaccacatattcagggaaggtagcgcgcattgtccaagttgtttgagagttagcaggtgcagtgtaagctgcgcactgaataaaacaaaccgtaaagcagtttagtcgta

SEQ ID NO: 51036 - DNA, 1810 bp, Oryza sativa
gggccggtgggcagcgtgggctaggctggcagtggaggcattgccaacgacgaaggagacgagacggccggtttggttgggttggcttgggaaatttggggggttttggccctccaggctccagtcctgggaggacgtgatctctgctttgcttgctgttgcagacttgcagtgttgctggtaggcaatttattattattattattgttattgttgtttttttttaactttcttttaagttttaatttcaaaaggagctctatgaaaattttgaactaaatattttgtcgcatcattttaataggtgtgatcagatgacattttcacgctcataaaatatcgtggagtataagataaataattgttgccatgccacgaacaatggcacttagtttgagttcgtttgttttacgcgcatactttttcaatttgctaaacattgtattttttttgcaaaactaaatgtactaaatttgttttaaaatatcttattaatctatttttgaaaaagctaatacttaattaatcatgcattaatgattcattctattttgcatgcgcgagggattagtttctaaaatcaacaatcaaatacagtttaaggggttgtttgattcgtgactacatgttgccatactttgctacacatcaagttagctttaattaagttagctatgtattcggttcattgttacacataaccacgattttttttctctctcatcttgatctcatatgttatttgtcttgtaaagtgcggtaagatcatagctttctagtcaaagcgttgcgttagattcatagtctaaccttagctatggttggtgaagaaatgctactagcaacctaaaaacacaaggtagtagataaactaaacatcatactgctatctgatatgatattgtcctaacatgttaactcaaatggtgtggtcaaaaaatttattctatgaaaaataatattatggatgatttgttttaaaaattttaagacaataaaggttcacaataaaaaaaattatgaaaagaaaccggcagcggagggtcgacacaggcatacagtgcagcacgggcaggttgggtttctcagcctcatccggtggtattgcttgtctggaactaccgaagctgaagctgacccggggaaaggtccatttggttggtagatctggtgatggcactcatcaatcactttcgtttcaagttttgatgatttataattaacgtaggtcggagtatatgttttccccgcttttcttggttcctttttaccttcgatagatggcaacaatttgtactattgaaaaccacaatatcggctggtaaaacataaataccatatacgaaaatcatgccgtgttaagatgtctaaattaatactattgtgttgtgtaaattaagtagcacagtactagctaatcacaatacatctggctgtcacatgctacgagtacgaaggtcataggaggcacctagcagatgacatagaataatgttcccattggggaatgtccaatgttccttgtctgctcttaagcataggctaggcatatattattaaaaaaaatgcaagacaccaatatatccaaggaaataaaaaaaaagcaaaacaatgagtatatgagcatcctggattaattaaactactctattcgcttaatctcaaacaatatacattcagacaggacaagtcagtatctatgggcttcttcgaagggcaattttgccgcagcgctacggctgcagcagctcaatttgctgcagctttgccgtgatatttaacagcatcgatggctgccgaacgctacaaa

SEQ ID NO: 51037 - DNA, 7026 bp, Oryza sativa
  unsure (1)..(7026): unsure at all n locations
nnnnnnnnnnnnnnnnnnnnnnnnnnnnnnnnnnnnnnnnnnnnnnnnnnnnnnnnnnnnnnnnnnnnnnnagctagtacatcagtgatcttcaagtattccagcattggacattgccttagcttcaactgttgtagagcaggggtataactcaacaagctctctaaatcttctgtggttatacatacaagggccaaatcaagagtcttcaagcttcttaggccactaaaagttggtaaaggcctcaaattcataaagcaaagcttaagatgctctatagaggttggttctggagcagcaacattagaggatggaaagctgtatttgacatcacgaggatgagcataccatcgtggacttaggtcaatagtcagttcatttgcaccagatcggactgcaaagtaaatccaacggtcaatatagtgtgcgtacttgtgattgttgaggttgcgcttcaaggtgaatgagttaatccctgttccagcgtggtgccttatgatggtgttaacacacctgacaaatttagccctcctcccttgtttgtgcacccgtttattcaaacccaacgccttcgaggtgaactctaaattaggatagagcctccaagattgtagccacttttgcgacaccatgctgacacgcgcagcattagtcagcgaaagcaaccggattatcaagaacaccacatcctatacatcaagaagaagtcagttgaatatatatatatatatatatatatacagaactccatactcacattcataaaaagaaaaacagcacagtcagtataagtggacctatataacgtacatagaatggaaattgacactagattctactagtatttacctcaggaatgtcatcaaactgtaatatggctcttttgttcttggggaccagtttcccatgacatggattcattcgcttagccattagaccaaaaaaacactgatctgcagtcaactggaagttaataaactgtaaattgtaataggccattattagcgttggatgggtgctactgatgtcagaacagaaagaaaacaagagagagaaaagatgggagctttaaacatctactcaccacagtattgcagcagcagcacgcaatgctgacgaaatttgtggatttgagtctcccaagtattcgatcgatcccctctagatacaaacagaagcagcgcaagcagtggcgaagccaggataaaaattcacctatggcgaacttactacggactaagtactagtctagtactctagtttgtataagaaaacatacatatataataaaataatggactgaatttcattatcatctcttgcttctatattttcatttccatctcctcctgatatattagcagtgctactgctaaaaaatctctttatactgacaactaacaaacataaaaatttaaaataagagatacgttaaagtgaataaataacagtaccaacaagggtagattaaattctcaccttttatttttttcccaatctgggtagcttctgaaattgggcgcagtcggcgtcggcgattattagatggttcttcctcttccatggcgcaatctgggtaactacagatattacgagctagtttaacattactactcgtaacaactgattgtctgattcaacaggatatagttgctaatgtgcgagagatggaaccaactggtgtctcggagtgattactgtggcggcgtccagcgtggcaacggcgtccggcggtgtcctggacctggagtcggagatcgggcggcacgcggcaggagacgagtcaactgtcgacgagaggaggcgaacagccgatgcgatgaggcgatcagccggtgggcaggtatggcggccgccatacctcgccatactggtggcttcgctactgagcgcaagatccccaaacaaccgggccgatcgatgccaaagctaggagtggccttggttttttttcccttcttgtataaataagcaatccaaatcaataccgaatcggaaccagagaggacggaggggtgaaaaaaaggcgataactttgagacggactcttaccacgaaactgatttcaccgcatgggcatgacgagaaggagttggcgccagatgttctacgtggggggtggagcggagtgatgatacagagggaggcgaaatgatatgcgacgccggccgcggccggaaggcgagtacacggcggcgccggaacggacgagagagaggaagggggggaggggtttgtagatttgggttaacgagagagagagggggtccgtcttttttttttgccgaatccttttttctgttttttttttgcttccggttttattttctttttatttcgttgttttattttggtccgtctttttttttggtgtttttatccggtttctttttatttcgttgttttattttggtccgtctttttttttgccggtttgttttttctttgctgtttttatccggtttctttttttccgttgttttttttgcccgattcgattttttttgctaggttcctttttcgcttttttcatccggtcttttatctcatccgatctgttgtacgttgccgtcgtcggaccaaaccctatagtggccgccacttcgatccgtctccatatgcgttttctcctccaattgatcgtttccccatgcgttttctccttcaattaattgcgaaaatcgattctccacctctctcatcatttttctcacatttcccctctcaattcggcttacagttcgccaattatgcccgaccggcctttttatcccattttgtgaattctttccgatttcgggaaaacagaaagaggagatcgagtggatcaaaattcaaaagaaaaggaaggaaataatgggttgtaggcccaaaaaaggaataattttcatttactttttcaattataatgaatagcgatcctaatgtttcttcattgctagcggttgtactactcaaaaaacgtttttgccccgatgcaatgcacgagtatttttttctagtatatctatatatctatatatctgtatacctatatgcctaataaaaaaatacgcaaggtttccggttttttttccgtctcttttttcgccttttttttatgtcccattagttcttttccatgtgaaacagtttttttcaggctcactttttttatccggcttttttcatcgtcatttttttctgctctcaatccgatcctatcgtcttttcttattgctctttagtccgatccgcacatgggcaaagcccctccagccgccgccacgatgttcattcatccgtacgtttcctcattcaatttactgcgaaaatcgattttctaaccttgttatattcctctttccatttggttttaattcgttggatttaatcccgaccgattgattttgaaaaaaaccttgttatattcctcatgatttcctctttccatttggttttaattcattggatttaataccgaccggttgattttgaaaaaaacagaaaaaggagatcgagtagatcaaaagccctcaaccaatttcggggagatcgagaaagattcagctggatttgctcctcggcgtcatgcgtggcatcttctagaggttgaagatgcagtcggttatgcaagctagatttgtttatgggccggaccaaggagagacaaaccgagcgaagggatgtatcgaactgggatagggctgaaaaataaggaagtttttctcaggcttccttttttttatccggttttcttcattgccgttttttctgctctcaatccgatccgatcgccttttcttattgctctcagtccgatccgctccacacgggcaaagcctctccagccgccgccacgatgttgattcgtctgtacgtttcctctttcaattgattgcgaaaatctattttctaaccttgttatattcctcatgatttcctctttccattcatttttaattcgttgtattcaatcccgaccggttgattttgaaaaaaatagaaaaaggagatcgaatagatcaaaagccctcaaccaattttaggagatcgagaaagattcagctggatttgatgccgaggatcggctccggcatcattgtaggatcgaggattcagctggatttgatgccgaggatcggctccagcatcattgtaggatcaaggaggccgactagaggggggtgaataggcggttttaaaacttaatggcacttcaacaaaactaacctaagttgctaggcaaggtgaggtacaaggttaactaagcaactaagttaagttttgcaaacctaagtgatatgggctcaaatatgtctctatgaatgtaaatttgctcaaatgtaaatgcaacaaataaatgagacaagagacaaggaatttttcaccgaggttcagaaactcgccggtttcctaatccccgttgaggcgagtccaactccaccgctcaaccatgaagccaccgcacgcccccttcatcaaggggtgggcaaggtgggagccagcccacggagaggactacccaagcctcgatcactagggtagttattccttcacttcgaaggtggtgaactccaaatcactcacaaacggcgtcgggcctcctccacaatctcctcggagagatcaccgggaaacacctccacaagccatctaggaggtggcaacctccaagagtaacaagtctaggatgcttgccgaggatgatcaagtaccacactagctataacaatgaagcaatgcacttggattggcttaactcactctctaacacctcactagataaactaagtgcccaagggtgtgagaacactttcaagggttcaagataatgcaatggagtgccaaaaccttacccttgctgctagagagtgggtatatatacccccaaccaccaaaactagccattgggattgaaatccccaactctttgctctgccggtcagaccactatagtgtggctggtcagatcggactactttgtaacggctaggcaatcattgagcccactcaacctggccggtctgaccgcagtgtagtggccggtcagaccgtccacggctcgaccagaccaccaggggctcggtctgactggttgcagctctagcggctttggatcgccaagacgagacctccttcaaaattaggatgagcggtcagaccgccatgggatgggaggtcagaccggacaacatacttctgtcagaccgcaggtcacttttcagctcaaccggctgttagtaaaacggcgatatctcttgactcgggtctcggaatttgacgttcttagactctatggaaatcttattcaaagggctatccaacccatgaacaattcatccaagaaacacaacttaattcagggagaaatggctcatctccaaaggatatccaccggacatacccacaagatgtcactcactcctattggacatacccacttctctctttgtttgggacatgagaaaactcatcatacttagctagacaagaccaccaaatgcacctacatgcatatgaactaatatggcacaagatcatcgacgtgctcgcttcatagacccctcttgataatacggcgcctatctagcaaatccggtctacaccaaacaccaagaccggggaaagactacgaaaacattcttatttcaattatacctttatcttgtgccatccaacttggggtcaatgcttgagccaagatcaacactcatgaccattcgcttgaaccatgtttatgccgaggtcttgaccatcctttgttaaggctttcttctcatcacaatcttgacttcattcttgtcgacatggcgatgtccttggcttggtgaccatcaacccatggtgtcatccattagcctcatcacaattagacctattcctttgcacatctcaaaggggaacattagtaccaacaaatcggttgtcatcctccacttggtgactaaccggttgcatatgaaagatatggatatgtttgttgagtattcattaacatcgcaaagtgtcatatactcgtatgcaagctcaaatgcaaagatccaatataaataataggtgaacaacgtggatctaaaacatgcacaataaatgtataggatttgctccccctaaatatatgcatacaaataaatatacaagagagacaagtgtatgcataagttatgaagaactaatagggtttatcctatacacatggagaaggcatgtagcaatgataaagataaacaaaaaacacataccttcatgatctccatgttctcaatgtaaaggagactaaataagataagactcaagtaaacattagtctcacacttatataacaataacatggaaatcatatatatgaacctatcaaaaaggatgagataagaagtgatacatatcgctttatctccacgaatttcatccttgtcatgattaaggtccatcaccaaagaatgcatatctaccacatcttattatcgggaaataaccttgttgaaaacttatgtaaaagagagattaatcccataaatatcggtttatcatctatcaccaaagcaacaattacacaaattatttaattcaagatctttcaatcttttctctcttttgtgatagataataatccgatataaacaatatggagagatgagatgaaagatgatttcaaatcaagatagaaatcttaaataaacaaaatatagagtaacctccccctcaagatgtgcatacatatggatataaaggaacacatatgcacataatcaatcaagatcaatgagggagctcacactatattttggatccacaggagagacaaagttagaatatgtgaagtttaatacatacctctcatcatttttactttcatatccaaatgagattagtcaaacaaaagctcataaaaatgttagtatcatattgtcggtgacatggggccgggggtatcgtgactagaggcttgggtagccgcggtcacccacgtggcctgaccccctcgggggggtcgggcccgagggtgacgtggccacccctccctctgtctccccgaggggtcgg

SEQ ID NO: 51038 - DNA, 1648 bp, Oryza sativa
gtgggcgtccccgggaaaagcgggcgagcggggcaggaggcgtgtgctctgcttgtcagatgtcacttccggctgtagactagccctcattgtaaaaagcatgtatccctccttaggcagcaggaggccaatgtggtgaccccggaccagataaaaaggaggcccaggtctaagaaaggggggggggaaagaagagttgggacgctagcgattgggttctagagcctgaactctctctcgctctcgggcgctctgtattccttcactcacagatccatcagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcacatataattagatttgtcattaatcaccaaaaccaaattaaggcacttgaacttacaatcatgcgtggcatcttccggaggttgaagatgcagtcggttatgcgagctagatatgtttatgtgctggaccaaggagagataagccgagcggccaaaaaaaccaacgaaggactttcattaacttcttcgattataatgtatagtgatcccaatgttttaatttattgctcggtttctaatagttgttgtatcactgaaaaaacacctttacccattgcaacgcacgggcatttttacgcaaggcatccgaatttattttcatccgtctaaatttttttccactatttcttttttattttcttttttcgccctttttctctttttttcgccttttttttctcgggtttattcttgtccgctttctttccatgggctggcacagctgctgggcctgagcggacacgggattagcggcccaagaggtaggagaggaagtgtggcggctgctgggcccgagcgaacagatggatgacggctcaagagagaggagaggaagcgggacggctcgggggtgaagaaggaagaatgggctagatttgatcccagatttaggccctgtttgtttcagcttataattattataatctagattattaagccagattattataagctgaattataataagctgacatagaataagctgtgagttatttgtttgtctggattattggaggcatggattattgggtttgaaaggataaagtctataatgctctcagctatctgttcggttgatggcataggtgggtaatttttctcaagtatgtagggatagtgggtctttagccactcaataatctgaaaaaagctcctctatagcagcttattagattataataatctggcttatagattataataatatgctataataatctacttgtttgtttcagcttactcctaataagctagattataataatcctaagctgaatcaaatagggccttagaagagggtttttaagttagttttaattttaaattaattattaaaattagcaattgagctttaaaaaattaaaaaaattatagagaatgtggttaatcatgaaaattttaataaaaattaaattcaagtacataaggcttgtaggtattccctccgttttttaatagatg

SEQ ID NO: 51039 - DNA, 4275 bp, Oryza sativa
tcatctattaaaaaacggaggtagtattattttggtccgtcgttttatctattgtcgtcatttttccttttttacgttgaggtattttttttatcggtgtcagtcttctcattatgcgcgagaaatccccttccggacgcgcgagtcccccccccggccccctctcttggcactctcttcgattgtcctctttttatttaaaaaaaaataaataaacaatctaaattcataatcacaaaaagataaaagatctaatctgactatatatatatacataggtttccggtagtatttttagttcgcttccgcttgcgttaaaatattttccatgtgcgtcgaaaaaaaattatgtatatcgttgctcagaaatccatgcacatgttatcgcatgggtcatttggggatgactagggatcggtcgcccgatccaaatctttaaaaatcggcatgacgtcaacgccgatttacgtgtaaaacaaattcaaactgatttttctcttaaattatttatccaaatcatgatccgattgcaccattaaattcgttgcaattaaatcttctaaataagaccacacatggatatattctgatgaaatattttttagcttattattgattttttttaatgttgcacgatgttccaccaggtatatcggaattgtttcaataagtagatcgaaaatgtttcactcgtttaaatcgggtgttgtttcaccttatataaaaacaatgtttcagcaaatagcgaaagaatgttttagttcactgcaacatttgatccatacatagtgaaacattgtgagtatactaaacgaaacattttttaatggaacaaaaaaataaaacgaattcccttaataaagggtttccaaaatatgtgggttttttgttgcaatagagtatctcagatcactgtaactttagatctataaatagtgaaacatcatgagtacactaggtgaaacatttttggttgaacaaaaaataaaacgaattcccttaatagcgggtttccaaaatacgtgggtttttatgttgtaacagcgcgttccataatatcaaaatccaatgcaacatttgatccgtacatagtaaaacattatgagtagactagctgaaacattgtaaaactactggttgaaacatcaaaagagaccatatgcaacattaaaaaaaatcaataaaaaactaaaatattttttttatcaaaatataatcatgtgtggtcttgttgtaaagatttaattgtaacgaatttagtgatgcaatcagatcgtacattagctaaatagtttatgagaaaaaatcttttgaagaaatgagagatgaaagcacgtagggaaagattctttgcatgcaaatggcagaccatgcagcgtctgatttttcttccctcccatcggacgcccgacaactagcattctccgggtcattaccgcagaaagattgagaaattaacccaatcctaccctattgtactattgtactgcttccttgccagcttgaactgaatcgaaactataattccacgagcgtaatttctactccctccgtcccaaaaagactcaattcctaagtttccgtatccaacgtttaattatccgttttatatgaaatttttttataattagtatttttatcgttgttaaatgataaaacatgaataatactttatacgtgatttatctttttaattttttttataatttttttaaataagatgaacggttaaaggtcgtaactatcgatctgagacacgtccccatgatcgtccatccgtgcgctcgtgcgtacgagattggaagtgcttttgttttttattatctataccttttttttataagaattacacagtacaacgcagacattgacaacatacgtgcactcacccctataaatgcacgcacgcaaaccgtacccctagcatcttcgaagactgggccggcaagtccttgagagacaacgcacgcacactcacccctatgaacgcacgcacgcaaacactacccctagcatcttcgaaaagactgggccggcaaatccttgagagtttgacgaagtcatcataggcacctcgctatcgaggggtacgtcgcccaccactgaaagcacaacgccgttaaatcctggaaaattcgctcccattgggagtcgaacccaggacctcaagtgctaataaggctcttgtaaccactaggctacatgccatttcgcttttattatctatatctaataaaaaatacctaagactttcggtttaatttcggtaaatctgtttttttttgttttttttccgattagtttttctcttacgtggaagttttttttttgggctttcggtttttttttctgactgaaaaaatacccgtgcgttgcaacgggtaaaaatatttttggatcgttatatattttactctttggttttggaccaaaagctcatttcattccttgtcaagtggagttgtatgtcctgctcgcatagctgactgtcctcttcaatcttcaaagacaatgttgtgtccgtacatgccaaaaccgatacccgtcaaatccggtccaatcttttacgatctttcaaaattggttgagggtttttgatacacttttttttataacaggcattcataatacccggcttttaaacaaagccaaagataacagaggtcttacacaacagaacgagaaaaaaaatccgacttaaaagaacaagttaacactggagcataggatcactgcagaggcccatcaatcagataaaaaacacacccacgaaacaccctaaaacaagacacctaacatgctaaaccaaaacccaaccccttagccaagatccagatcatccggcaacctccctagcgggcgtagttgtttttgatacacttgatctcctctatccgtttttattaaaatcgaagtgataaaactcgggataaaaacggtgattttttaaatagagattaaattcagtggattagagcagagttaaaagggaaaatcgtagaaaaaatgatgaggggtagcggggaattgatttttggcaatcaattggaggagggaacgcatgggaaggcagatcgacctagtgtttagccgggcgataaaaaaacatggtacataaaaaaacaaatccttaccgcgtgcgagaaaatacaactaaaaaacagcagcaaacatatgaaaaaacccggtaaaaagacctaaaaaaagtaaaaaacagcatagggtaaaaagcgaaaaaaaggtgaagagaaaaaaccagatggaaaaaaaagcgaaaaaaaaacaaacggaaaaaactgtgaaaaaaaagaaaaagagtgaaaaggacggaaagaaagaaaaaaaatatacggataaaaaaagaaaaaggaatcggacagaaagaaggaaaagaaacgggcggagaaaaaaaaaggaaaacggactggaaaaaaggaaaaaagggtgaaaaataaaaaaagacggacgaaattttttacggaaatagatccaatccccagcatcgtcacgacatagatatgcctcgccgtgtatttctactctaattgattgaaaaaagcaattccctgttcatccttcatttattgctcagcttctaatgctattcccaatccaataactaggatggtgtctatagcattaaataagctgccaactaaaatgaaaaatgatgtggtaagtgaataaatgaggaaagagaagaaaccatatcttgcatgagacatagtttctacacaatatcgaagacatcacatgagataagtagtattaaatttaagtattgagtagtggtgtatgcattggaagagtagcatctttagtactattttctcgatgacgtgaagtttatagaaactatgtctagtgtcttgggctgggaatggcctaatagctgttttatcaatgagaaaatatttttacccgttgcaacgtacgtgtattttttctagtttcataaaaagtacagaaactacataaaactaaggcaataattataaaactgcatatttagtggaaactaaaaaaactatatatttaattaaagcatattgtagagtttaaatctctatcaatattattattagggagaattggtcattcgactctattctgaagtctaattaacaatctgaccctacgttttcaaatttgcttattagatcctgtttttcaaaattggagttgccattagaccctgtttctattataccattctggtttcatttaagaaaagaaaaaaaatgtgttctaatagaccaaaatacccctgattac

SEQ ID NO: 51040 - DNA, 10092 bp, Oryza sativa
agcatgtatcggctaataatccgatatcactctatactaagatattaaaacaagtaaaatatatcaaacaaaagcctaatatactttattgtaataagatcttaatataaagggaagatctagcatatctgaaagtgtaaattaggcctagaggggggagggtgaataggctaattcaaaaattcaattaaaagcggaagcactaattttcggatatttctgaaattttggatatatccgaaaattttcggagtcagcacaaacagcaaagtaaatcctagatctagttgcctacaacaagaatatgctagcacaaacagcaactagacctgtagcggctcaaacaagcaaagctagtggagagggaggaagtaaagtcaccaaagatgaagctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagtccgaaaatttctagtaccaacaacatcgttctggatgttctcggaaaagtccaaaaataactttcggacaagtccaaaaatatacagaagcgaaattgactctactgatgattttcggaaaatccaaaaatcagattcggacaagtccgaaaatatacaaaaccacttttgctttcgcagtctttttcggaaagtccgaaaatcactttcggacatatccgaaaatttccagaagcgaaaatctggttctgtgtgttttcggaaagtccgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctattaactcaaggaaacgaaaacgtacaaaataccatttgctcatttgccgcattacatcacatcaacgtattcggcgggatatgtattacgctaactcattgaggacaaaacaaccttcacatttgcttaaataaaaatgttagtcctctctaatcgcattgtaattaatcaccaaaatcattaggggcctagatgcactttcaatatcaatcaaatacatgaaatataaagctaaatcaggtaagatcggttgaaaccccgatactaccctaatcggcaaccaaaagcaggctagagattgagattctaagacaacttataagatcaaactcaactgatgcagctataagtatgaaaagaaggacaatatctagacaatcaagccgttggatatttcatagagcggtagatatcctatataatctaagtcaacaatagtatttaacctgatcggctgccttttagcaacagatgttagccgatttgagggttagataacaatattgcctgagattatatagaatatctgataactcaacgaactacataaacaagattagagtatcataaagatggaagcactaatcccgaaaacgcaagccgccataacaagttttacctctagttgaagatcgaaaccgatgcagctcaatccgaaagcaagaactcgtcgaaacaaaaccaaagtaaaagggtggcgatgcgtcgagattgtattgaacgtgtgttgttgtattacatggggctcggggtctatttatacctgagattacaaaatatgtccgtgtcggacacgactcttatttctaacaaacttttaagataccataagtctttgcggcagacttttgcccaaacatatctttaaggaaattacatgaaatatcataattaatagatacaattgccttctcaggactctatccgtgcatggcaatccatatgaagcacattaactcaacccgacaacatgcattacgtcatattgtcggtatcggctcaatcggccaacctagtccgactcgaactctgctgatcctgatcatagccgattcggactttagccgattctcgctatgtttccgtaacgatctccatcttgaattccgcttcgattctatcttcatctccgatacttggattaccaaatttggttgttaacaggcgggcgaatcagacgaggaggggcggcagaggcccgacgatgacaaggacgagcagtggtggcgaggcccaggcagcgaagctctggctacggtggtggatccggcagtgcttaggcatctgggctacggatccgacattgtcaaggtgtgccggttgcggatccggtggcaacgggacaacgacagtggcacggcggtagcagctcaggctgtaattttgcgccggcggcgccgaggtgtataggcggtggatctggtagcggcgggttggcggcggcagggccagggcagcagagttgcgttggcagtggatgtagaggtgactgggcatgcgggctgcaaatccggcggtgctgaggtgtacgggtggcgggtcagtgatggtggcacaacattggcggaaatcagcggtctgcgacgatgcatgacgtggcgaggatgatggagtctaaaattttattgaagtttattcatatttttatcaaatctatgttaaatttgtcaaacatctatcaaattgaagtccattttgtcaaactgaagtcaaatttgaaaaatttaatataacaaatataggtcaaatttgaccaaagtctgagtcaaacttgtcacaaatcggtgaaacttacactaagtgcacaaatcattctcattattgccaccatacaaaactatgctaaactaactaaatgctttggtaaaatagggtcaaaagagcaagggcagaagagaaattttatgctccttttaagaccgttacatgcctttgatagaatagggtcctaccgtatcttcagttttgaaatgaagggtcaaatgagcaaacttgatataagatggttaaattggtagttagctttcaaaagagggtcagatatgtaattgccccttattattatgttggaactattaggcgttgtagttttgtacttaaattgatgcaaaacttgtagttattaaatttgctaatcaatctttatttttgggatattatattttaaatctctagttctatgaaaatttccatgctaaatttgtagttttgtaatacaagattataaatatgaagttttacgataatttggttgtagttttctgaaatttacttgaaaatatatcattactatttacctatttaaattagtgtacagtatggtatgaatccaattttcatattattgtagtggtaccatttcagttatacgaataatggtagtattctttaaaactgtcaaatttataatgatatgatctaactaaccctttaaggtatatcattttagttcatatattttttttaacagggtaactataatttatagctactccctccgggctgataatacatgtcgttttggacaaggctgaagtcaaactttagaatctttgattatgaatcatttttaaaatatttgtctttcaaatatggtgactacatgtatagattagtcttaaaagtactttaataagatcatatatttgctaacaattttatacatattataatgaaacataatggtcaaaattgttttttttggagaccgtgtccttatccaaaacgacaagtattatcaaccggaaggagtataagcgatgtcactttttatattataccagtaaatattttcttttagcccctgtcctttttcttcctcttccttctcttttttcctctatgaccaaattgcaatgtattctaccaatcatatccggaggagcccagaccatctattcccttccggtgtaaatctgtaattgccgcggcggtgaccagtagcaggatgcgcatttcggttggccatgatggcagggttaattagacacatgccattataaattcgaaggtttggaaaaatgccattactattcgataaattgtaaaattgccattacaaatcgcataaaactagaaacatgccacgttctacgcctgatccgcgattgtactcggttttgtgcataccgtatttatgtatggaccataatgcccttatgtatgactatgtagggaccgagtggaatcagtttgaccgcggtgcatggcgcattcccagtgaaccataaacctagccctaggcttctccggcggcggcgggatttggaggcggcgtcggcggcggcaaactttggcggcaatggcggggagaggcagaagagcataaggaagagaagtcgaggatgcagggtttggttgagccaaaccttagacagatgcaatccatatatatatcagcagctgaatgattctaagaatgagtgtgagcagctaaagaagatgttgaaagaagagaagtgtagtcatagtagacaactttatgtgatgttattcttgttggtcataattatgtatttctatatatgttctgtaaattttgtagccacatttggtgcaagtaggtaaatcagtgccattttgtgtaatgttaatcattgtctatgaattatgtggattcaatttcggtgcgttaattatgtggatttaatttcccactctaggtgctctgttcaggatatgtctggcagctcaaggtacaagctgatattgtgtatttgcagcaagagctgactcttgcactaaagctgactccatagacgccgtcgccgctgccgagccgaagacgtcgccgccgtagacgcagccgccgcagcccgtgccatcgccgtagacgttgtcgtcgccgcggccgccgtagacgacgtcgccgtcgtcgctggtagggttaggtctaaatcgaactagaaaggggataaaatgtgtgctgctcctgctgacccgactccagtggcggacgcaggattaaaataaagatgggacgaagatgctcgtctcaataagaacaactaaacataaaaaataccatatttatgttgtaatcatatgaacatatagtataattaataaattaaggcaaacaaaaaaaatgatattaaaataaagtaataatttttgcgccatacataattcattatacataaaaagatatatattaaaatcgtagacgggtgacaaagtcagtgacatataatggattctctaaaaagatactagtaaacatattaatttgcaaatatgagtcaatgtttgatagatatcttttaaaaaataaatatatgagaagatatcgcattaccaaaataagatgattattattttgtgtagaagggagagagagaaacattagacacctaactatagtaggggacggaggtgaccaacgacaacgaattgactcatgaaagcataacataagcaggattaaaataggacacttgggctggttatttatggcccaattgtgaattggatgtggtggtaggcggcccaagaaggatacggagggttagggcggcacgggccgcggctgggccggccgcccaaccccgcctaatgcgtggcggttttgctataaatctgttgacaaatttcttcctcagaatttgtcgatttttgaaccgcttgatgaaactcgggattcgtgcttttatgtcgacgctttaatttgtttctttcgacgttcgccggccgccggccacaggtgtggctcatgcacgcgtagatgtctagatgacagacgaagggcaaagataaagcggcagggcatagccgaacatgcatgcatgaatgatgacctccgcacgtatcgtacaaacatacattgcgagttcgtaatccctctttcacgtgggcagtgccaaacataagttttctaaagttacatctcacttatatgcaagttatattatagttacagtgtagttatactgtaattacagtgtaattattatatttacagtgtaattacatgtaaattatagtgtaattattatagttaccgtgttgttatagtacagttacagtgtaattattgtaagttacagtgtaattacagtacaattatattgtatttacatttgacaaatttttaagagaaaatttgtcgacaaatgtataggtagtccgttgagtcaaacgtggtcaacaatgatgcttctggcgtagagagtggcattgattcagtttctccaaatttgtaatgacatctttacaatttgttgaatagtaatgatatttttccaaaccttcaaatttgtaatagcatgtgtctaattaatcctatttatatccatatgatgagtaaacttgtttgattattttctttctttaagcaaaagtacaaattattaagctgattatggtttttcttttaataaattatattgacgatatacttatcaggtggtataataagtaaacatttgttttggtgtattaaattatctgatacatacgtgcgactggtacttgcaaaccaagaccaaaagcctacgatacggccaattcaacggcatgcggcatgctcttttctttgaatacaactaacaattcagcgacatacggagtacttcccaggcttctatatatatatgagtttcttataaatgtaattttaatttatgtattttttatggttctatgaatttttatttaagaataatagctactacgcgtacattataaataactagaaaagacacgcggctttgccacgtaattggctagctcgtaggaaacactaatggccacaaaggcaatttgatgggcgaatcatgtttctgtgtattgttgacattcttttttttttggtaatcatatggacaagagcactgggaaatttgacatctctaagtaaaagtgtggacgaatatcagagctggctaataagtatatcgttctataatttaaagatcttacataatttaaggttaatagctgagctatcagttctcatgaaggagagatcagagtgaggatgaaatccagatcaaattacccttttcatcgagtcatatgtcgttgacattgatctttgttaggatcgagtcatattctccttattcgattcaaccttctttagatatagaaaaatgtgtatggcttgttttgggttgatcagatttaaactcttgcaactccaacactggaatgtttctttgctttgtgggaccagtggctcgacaacgctatataaatatgctgtagaggtgcactgtggctacaatattatgaacgatagcgatagcgcacaatgcacttgttaaaatcacattatgaactattttgcactgtagcatatgtaatggaatatactccttccatcttgattgtgttgacttttttataatatttgactatcatatttaaaaatttagcataataaatatgtaaaagtgtaaattaagattatagttttcttgataaataaaataaaatgatattcatacaatattgttgaagacttttattgtcaaagttttattttgaactaccctaaaaaaatcttttttttggatcacagcaaataacttttttagcatccatcaaaaaaatcaagcaaatcagtctcagtacaccattaaatttctctatccatatatcatatatgtaagccatatcttcaccataatggaggatagtccaaacccaaaaaaaatggaaaagttactaagtccaaaatgaaaatattggtttaagggtgatccaaaataaaacattgctaataaaatatggtctaaaatgtaatttactactctttaataaaataaaagtcaaacgttatttgaaaagtcattagcgtcggatggaaggagtacaatcaattcacaaaatttagtgagatgcatgtaaaaatgatctaaatgcagccacaattgttcttcctctgcactaaactctgttgtactgcagaatcccaattcctgtttagagcgagatagtatgccaactattagctccaaaaatattcacgccaataatatattgttaacttaataatagagagcatgtacagtaatatgttactattagcttatctacccatatttacttcttaatattttattctaacatttttattgttagtcctatccactcgttcttttctgccgtgaaaactgaatagagcagccgtgtatcagggtggccagtagaatcttatgctgcttcactcgcgttgaagcccatgagtctacgtcgataaattagtcgcccgtttttgctctctcttcactcaatcctcatacatctctccactcaatcctcatacagatcaccacttttaccatcatatacagattatcgttgcgaaatggcatatagtctagtggttgcaaaagtctaaataacaccttaggttctgggttcgactctcatgggtgggaacgaattaaatattgtgctttcaatgataggcgatgtacccgttgacagcgagacacctatggtggcttcgtcaatctcaattttttagactttttggtgtttgaatctcctgaaaatgaagatggagataaagattaagtgttccacataaaacgagatggtaataatgtttgattaattgagttttaattattacaaacttgaaaaatgtatcaatctgacattttagagcaactttcatttggaaagttttcgcacaaaacacactgtttagtagtttgaaaagcatgccacgagaatccaaaatttcatctcctccttgatggagaaacgaacaaagacagctatactgtacagattatcgctggcttacaccagctatattgtactacctccgtttcagaatataagactatctatcattgcccacattcatatagatgttaatgaatctaggcacacatatatgtctagattcgttaacatatatatgaatgtggacaatgctagaaagtcttataatatgaaacggaggaaatacctgctatattgtacctgctcttaccattcgtaggccctgtttagatgggactaaaacttttaagtctctatcacatcggatatttggacactaataataaatattaaacgtagactattaataaaacacatccataatcttggactaattcacgagacgaatctattaagcctaattaatccatgattagcttatgtgatgctatagtaaacattatctaattatggattaattaggcttaaaaaatttgtctcacgaattagcttttatttatgtaattagttttataagtaatttatatttaatactctaaattagtgtttaaatacatgactaaagttaaatcctgatccaaacaccacaccaccgtagaactacagcaaaaagtcagtaacaccttcccttgaaaaataataaaaatgagaaaagagcaaccgctccaatcttcaccgcccacgtgtccacacctgagaaagcctcctccccctccaccaccgccgcgttcgtcgccaccgaccaccgtcgctatccaagaagaatagacgacgacgaccaccccggaaaccgagctcccactcgcggtgaggtcaccaatggcggactccctcctcctcctcgcctgccacctcctcctctccctcgccctcctcgccgcctccctctcccacctcctcctcgccgccaccacccacctctccccttcctcctcccacct

SEQ ID NO: 51041 - DNA, 2948 bp, Oryza sativa
gcggagatggaacattgccgatgaagggcgtcgtcggcaagagcattgcgcaggaataaattgtgttgcttcaattgtgcttgattaagtaggtacattttgatcattctcaagtaatgtgatatgttcacatgctgatcccctgaaatatttagccgtatggcctatgggggttttgggatgaacactgtggtaacctttatcttattgaatcagtcaatggatccaaatgtacgataggccacttgttgtaactcattcaatgatctcatagttctgtagtttgttcacattatgctattgcggtagctttataactctatcatggtgaatttactgctatgcagtatttcttttctattggcccccttggctgcaagcatgcaaaacccaaagaactattccggattgggatcacctgcagtttcgaattgtcctcacatttcgtttaaaatctgtgctttgcttcaaccttccgacattcatcccatttccttaataaaacttcatacacatgcgcattcagctgttgcatgcaggcacaactctttatcattaagacagtagtctttgttacagatgtaaaacttcatcatgattgcatgctgttagttgtgctaaaccaaatatgagctgcgttatcgctctcctacttccatactgcttgatattcatttcatggaatcttcttgaggttctgatatatatatattttgtgtatacgtgttgtaatttgcaaaaaattgcataccagttctcgatctctggtgaatatggggcctccatttaattcctttagacattttttaaacctatatttgcatctgtttttgggtgattcggacttaccaaagattcatcatttgggatttgaaagattcttaatccaatgtgtacgatgcgccaatgatgtctcactgtcatgtgggtctatggtccaatacacacaatgtgtcacatcgtggatatggatgaaactcagttgcatggatttacccttggatggaatattttctacaaaagtgagaaataactttgccggtggccccatgatgatactaggtgtttgtacatattacatttcataactcaagtgctacaaaatataggctattgtactgactggaagaagagaaacttaaaatggttttgaacaagaggattattcattatccaggcaatttgcctaatgcctaattcctaacttgacagcaatacctttatgatactcatatagaattgaaaagagaagaaaatggtgatccaactaagtggaattaattcattagagcattgacaagaaccatattcagtttgattctctgcaaaccttacaccttaactaatgcaagcgaatgtttcttctagactagacttgtctacatgcatctttggttcatttttatttgattctcttctttaaaccttcatactggctgcagatgataatattctttctcctagaatttatctgggtgacttttgcctaaagaaattattccttctttttggaatagagttccatttgtttgtagagttgactctttcttttctgcagtatttctatgacataactggatcatatactctctctgtttagaattgtaaaatccattcatgcattctttttcattctaactttttagttatgtgcaatcacttttacctggtggagaaatgaagtaaaacctgttagtggtggggccttttctaattctttcctaggttatagagctggaatttttccttttcttagctgcagttgatctgctataaacttttcagagatacggtgggcagcaaaagaaacccctggaacatactgatcgactgtctgacactgacgagtaaccacttatggtaccaattatcttccaaatctaacactttagggacctattacttagtgctactttgtattggtggacaagcctttggcttctctagtgtccaaagggtcacttgtacctgtaatgtgatgatcgattgatctcccagattccgttgtcaatgttatatgagaatatccagttcttctgcagctgaatgcggcttggtgagtgtttgtggtattgtggttagacttttgctgacaatatgatcaaaacttgttggtttagaacagtgtcacctgtgtatgatctgtacacaagtctcttagaattttctgtatggtgactggtgagaactatatacatatagctacttgtactgaacatttcagtctgaccattaacaagcttcttttatggcttttctaaattttggaggacatctatcctaagcaatttgatactccctccgtttcaggcagtggcggagctggacagaaaatcaaaggggggccagccggcttttgacagttcaaaaaattagcaatttctcttttttttcatgcattggcaatacataaaagcgaatagtttgcaaaagtcgacgacaaagatcagctacagatgtcagattttgaaatttaggattggtgggtacatcaagttcatagtgacgtaattgacatctcaaattggctctcttgttctaaaaaatcagcaggatagaactttgaagctagagagcacactttatcaatgttgaatgaactgaatgaatcacttggatccaaagacgtacacaaattgagaagctctattgcttgttcactgaatctgctatgatatatgggggtaataaaaaaattgtttttattgggaggggccatggcccctgccagccccccctcagttccgccactggtttcaggttacaagacgtttgactttggtcaaagtcaaactgtttcaaatttaactaagtttatagacaaatgtagtaatattcataatactaaattagtttcatcaaatcaataatcgaatatattttcataataaatttttcttgggttgaaaatgttactacttttttctacaaacataatcaaacttaaa

SEQ ID NO: 51042 - DNA, 7158 bp, Oryza sativa
  unsure (1)..(7158): unsure at all n locations
ctgttatgtgttaagggtgggaatcaattgtaaccatgagttggaccaattgttcggcatagtcagataccattgtccaaaagatcatgaaggaaaggtgccattgtactaaatgtaagttttctagaactaatggaggcaaagctctcctatcctcatggccttgtatctctttctgctttctaggcagttgagtcgattcttcattaattacattatcactccacaatacaattatctcccctttatttagtgcaggattctgttgtccctttagtttggtctcatttgttttatgtatgtatagtagctttgtggacactatatatactgccacaaacttatattccagtcattccactccatgtgctttgcagatacaaattcatgtgtctgcaaaagcattggttagtacttctacttactacattcaaagtgatgttaaacggcacggttttcttggatctctctctcccttgaaggctatctcatggaggtttgatgtacaccattgttgcctaagaaactgagaaagccttcgggggaggagagaagccaagcaagccacagtgtctaaatttacagcttgcatagttgcattagctcaagtaacaagaaatgctgcatggctactggagttaagcaacatactttgttcattgggtgttgggatttatttttcaaaaatatagattacctgattgttttctcgtaatatggtaagtttaatcttcatagacagatggattaatttctttggagtgcagtcaagaaatgcctacctaagtatttctatccaatcattttatgaatacatagaaccacataaaaactgccgagaatattttagacatgcatatatatatgttatactattgtcttggccatattgaatgggtgcttttaaccatctcccttacaagtccgcaggtaaaatagccggaatacaagaggactaataggttcccaagttttgctgctgatggatctgcacgcattgcatcaaggtgctctaaagatagtagcactctgcttccttctgttacaaggttgatcatgatcagtatgaaattgtaggtgcactacaataacatagtgttagttggctaattagcgccgactttctcgctaaatgcattaatcagtccctcacctcaggttactttatgcatatggggtgcttgttgaactgcatgctagtaaaatagccattctggggcaagtggtatgaaagggacaagctgatcgttggattcagtcagataccaaattgtgaaggcaacaagcagcaactctcttagttgttcattttagcccataatccagcgaagcaactttctgggttcatgctgttccttgttttggctatatgttctttcatgatatgtaaaaagattaaatgtaagttgaagtggcatagcaggattatgtatctctaccaactaattaggtcaacagaagtgtcaaaattatgttcttaggagctgacatactcataatgtctcatttctctctcccactgaaacagttgaataattttttttgtcaggcaacaccttctttgttctcattttcttccatccatccacaacgcctcattacacataattttttatgtattttgtaggattttttttataggaatcagatgtagaaaggccaaattcttgtattctaaagaaacattacttcctccatttcagattataagtcgttttgacttttgtcaaagtcaaactacttcaaattcgatcaaatttatagaaaaagtaacattttcaatctaagataaatatattataaaaatatattcaactattgatttatttcaatttaacggaactaattaagtgttgtaaatatttctatatttatctacaaacttaagttaaatttaaaataatttgaatttgacaaaagtcaaaacgacttataatatgaaacatagtacatgccaaaagataatgtttggataactcatgaacaccgtttatatatatgcacagtcctaattacacaaaattaaacccatgtgtgtgtgcatttgtgtgtgtatacatcaccttcactaaatcaagttaagcaagtagtactagaatgctatggaaaccactactccattagcaagcatgaggaagctgatcaaccaaagctactacacaacacacgagcagcggaagcacaagatcaccaaaaaaaaacagagaaaaattcgctacattaattgatcgattaattagctgcgttgcatcgtcgagctcccaagaaaatggcgccaacgcacttggagacgacggcggcggcgacgtcacacggcctcgaactccctcccgcgaggccggccgccgccgccgccggcggcggcggcagcggcggcgccgtagtgcccgaactccgtcgggacgtcgtcggccttcctgacgctcgtcctccctcctccgccgtcgccgccgaagatggagtgccgcggcggctgctgctcgccgccgtagatgtcgccgaagtcggaggagttggagcagacgtcgacgctggtgcgcttggcggagtatcctccgacgccgccgccgacgccgacgccgccgaggtcgaagctcgccgtggccatgtcgaagctgaggctcccccgcgtgttgaagctggccgccttggactccgacgagagcggcccgatcgagtaggagtagaagtactgccccgacgccgccccggcgccggcggggtagtagtgctcgacggcgacccttgaccggaagtcgttccggctcggcgggatcggcgagaggaagatctcggcgacgttcttggcgacgccgcggttgggcgggttcgccttccgctcgtacctgtcaaggtttaaaatctctcgctaaactgctgcttatctcccgctataactgtttgagaaggattcgagctatttgctctcgtgtactccctccatattttaatatatgacgccgttgattttttaaccaacgtttagccactcaacttattcaaaaattttatgcaaataaaaaatacttatgttatgcttaaagaatatttgatgataaattaagtcacaataaaataaattataattacataattttttttaataaaacgaaagattaagcgtttatcaaaaagtcaatggcatcatacattaaaatacggagagagtacaaattagccgctatagctcaatttagcctgctatagctgtttaagaagtaaccgctaaatgttttagcccgctatttaaaacattggtacctgtagcggaagttctcgtacgtggtctggttggtgcagacgaggtaggagtggaacgcggtgaggccgccgacgaaccacgccgtcacgaacgtgtacacgatgaggatccccgacaccggcgactccaccaccgcgcgccccatgctgcagccgaactgcctcgcggtcatcgccaggttcacccagcagaagacgaacacgtacaggcacaggaacgtcgtcgacgagatgaacatgaagaagaacctgtagttcctctgcgaggcaatggatcgaacagttggtcagcacgtcggagatggtcgccgccggagacggagaagacggcctaccttgccgatgcactggccgacccaggggcagtggtggtcgaagcgatcgacgcagttgttgcagacggagcagtgggagcagcgaggggggcggtagaggaggcaggtgtggcagtatttcaccttcaccaccacgccgttcacgtacacgtcgcgcgtcggcgggagcgacccgccgccgccgaacgccggcgacgacacgccgatgtcctcgggctccggcggccgcacgttccgcgggatgatccccgggtcccgccccgacgtcatcaccagcacgatcacgtccttcacgcacgcatgcacgcaaagtgatcggtcaattgcttcattttgctcgagcgacgcagaaatggtggtggccgggcttacgaatacgccgacggcgatggcgacggccgggacggcctggccgagcggcttcccgatgagggcggcgaggtggaaggagacgaaggcgacaaagagcgcgagcggcgtcatgatgagcgacacggtgagcacgatggagctggcgtccgggccgaagatgagccgcccgccgcacaggaatctctacacacaacaacaacaacaaaatatatgggctccttttaatgtggaaacgcacgaattttgtccgaatcgtttttgaaaacgtacgttcctgcccctccagacttggtagaggcggtgggtggtgacggcggtggcggtggcggcggcggcggaggtgggggaggacgcgtcggaggcgttgctgcgggcgagatgggtcttcttgaacggcaaccacctcaccttcaacatcccggtcggtgcgccggtgatccccgtggccgcgtccttgtcacctcacccgcatgcatgcatgggcccctcctccgtacgcgcgggacggggccagggttctnttnnnnttggggtgaggtggaaggaaggaggaagagaaaggggcggcaatgggggagctcgtgagagacattgcgctatccataggaggcgccatagcgcgttgtggttgttgttggggtgtgtgcaaacaaaggaggcggcaatgagaacatctaaaaatagatcaggagaatcccaacaaaataagggtgaaagtaatgatgatagttcaattctaagtgtggaagaaccataagctcctaacttctcttgcttgcttcttagattgcgaatgcttacccgcatgatcaccaccatcctgagttccgaattttttatttataataaacaattacccttaaattaaataattagtaaatcgttggggggatttacaggagtaggatggacgctaatacagaaagcatccagaattggacgccgttgtaaacaacgtccatacttggacgctgttggaaccaacgtccacctccctggtgcagccaagccacgaatagagtgagaacaatcaaaagaaaaccttgacaatcaaaagaaaaccctaactctagcgatgagcgctcgatcgcgcatgccggcagccggccacacatcgtcgtaactcatatacgagttcaccctctctacgactttgatccatccgctttgtcgtccaagccactctcgtcgtcgacgccggggccttcgatttgtccgtgttttacggcgccaccaatcctgcaatccagccacggcgccgtgtgcattggcagctctctcgtcgtgagcaacaggtttgccctgcaatttatatcacgcatgcatgtcttttcacttatagcatgtctttgctcaccctcatctaattagcattaattgatatgtactacattgttcatatctatacttgatatatgacatgagtgttttattgaatatatgtatagattattatccaactagtagacatataccatgcctttgttaattgttgagttcgtttggaagacacagccaggaaataaaatgactattgttcattgacatttttaatatgcaaaacaacattttttaaaacttgaaaggatatatcagcagattattatctaacttaaagttaattatataacttgttttgctaacttgtttagtttgttttgcagatttgactgagaaaaaatgattattgttctagtgtatgttgatgggagaatacaatatggagctaagggtgcagaatataatattcctccaaaaataacttttccggcagtggaggctacaacctttgaggaagtcaaaaaagaaatttttcaggcccttggatacactgaggatcattgtgcaatgaatatccaagctcggtttgatatcggaaatcctggaccacaatattttcaattgattcctatttatgaagacaggggatggaggatgatatttgagaagacatgtgggtaggttgttgagctttatgttgaatgcgcctatacggaagcaagattaagtcaggttaatagtacaaccttggttgcatcaactaggcattcggaaagggatggctcaggtgttttgttggagccaggtacagttcattcacaagcaaaggttgtacccactttagtagatggtctgcattcaacaacagttcagttgtcttcacctatcaaccaggataacctatcaaccaggataatgtggtttccaaaacacaaccaactatagatgatgacaatactgcagaagacacatatgttggtgaggatagatttggactggacgatgacaacgagcaggattgtgatggtgcccttgataatagtttagatgatgagccaccagaaccacgagttgttcattctgtcaatgcatttccttttatgcgtgcatctggacaaaatcctataaaagcatttagtgatatatctatattgagggagacaacagcagacgagagtttctttggacgtaagaatcaattttctaacccactagcagaaggaaagtcttttgattcaaaaaagcacctacaaattgctataggtgagtttcatatatgtaaaaattcagaaatcaagtacaacacaagtagtcaatctaaacttgtagctgaatgcacggataatagctgcatgtggaggctctatgcaactcccacaaagataggttcaggttggatgataaggaaatgtccatatgctcacacctgttgagcaccggctgatagatttgatcatgctcagttatcatcttctatgattgctaatgtgatacgtgatgcattaagggatgatctggaattgagtataaaaaatgtgaggtcactagtccaacagagatatagaaatgtgaagccatcttatagtaaattatggcgaggcagagagaaggcaatagcacaactttttggtagttgggaaggttcatatggcctcctcatccctttcttacaggctataaaagctaaaaacctaggtacaaagtatgtccttttgtcaaagccaatgactcaggaaggacggcgagcatttaaaagtgttgcttgggcatttggaccttgtatcgatgtcattccctacctacggccagttataagtgttgatgcatgctttttgtcagggaggtacaaggatagattgttgattgcttgtggatatgatgctaacaatcaactactatctcttgcatt

SEQ ID NO: 51043 - DNA, 2396 bp, Oryza sativa
  unsure (1)..(2396): unsure at all n locations
tttctgaaccgattgcaaaaggaaccattcctagtgcaatgaaaaaacttcgctgagtacttgaccatatatacttcatctccttacacatgtaaacatgttgtataaattaacctgcagaggtgctagctgctggccctgctgatgaaccagtagaaaactcctcaatgttccaggggtttcttgttctcccccaaaccatatatcatcataggcgagcgagcctgttacaagttttgctacaaggactgccccagttgacttcaatctgaaggaggacggcatacacataaggagacgtaattagaattgatcacatgactcacacataactgagaagaaacaaaccttttgtagacagaggcttcgacatcaagaatttggttttcaaaagttcttgagccccaggtagttttgtattctggtactgcaattatatccttaaggccatacggaatgccatgtaagggacctaatatcaatatttgtcaatgcaatctttacttttgagcataatgttttatatgtaacacattttcttctagtacgactcacctaaagagtaccctactaatggtataactgagagattttttaaaggcaaacaaaggagagaactccccctttgtaacacacacatggattcaactaaaaaaataccagttgtttaacatttcgttccacaggttctcaggctaataaaagtgattgcatcgcaaaatatgaagcttcaatggtgcataataataaaaaaatgtagggtaatttccacgagcatcaattatgacaggaagctgctatggccataatatattaccaacaaaaggagagaaacaagatcaagactagattgtattgcagtaacagatatatcactgagcatttcaagaagatttactgcataccaagatattttccttgctccagcaagtcatcagcttctttcgcttgtttgtatgctaaatcatcagtgatagtaataacggattcgattaaggccatacctataaacatacaaggagttacaaatgattaaaannacaantacttctgagccctcntcataagtccattctgaaagactgaaacaaatgaggaagacagaaaaaggggtctaacctctttaatctccttaagaacacagcagtaagttcacgcgatgtgacttgctttgtccttataagctccccgagctcaattatctgatatgaagatcagaagtttgaaataaatatatatgaagtttgtaaccaatgtataataacaattgttaaaaaataaactgaccgaataaaagcaatatcttcatctttactagggcgatgtactgaagatgtatggggatattgaaagcttttgttctcactgattttgctttcatcgctccatgatgatttaaagaccaatgcagacgggttatgcaatccaccattctctaacgccaccaatttccggttgtctctaaatgcaggtacattaaattcttttgcaccatcttccatctcccgaagctaacagaacagatagaagtgtagataaaaaagatattaatgcaactacttggttgtgaaaacttcaaataacattttgatagtacttttgaatcgttgaaaaaatcagcatcgaagtacttcatggaagccttcaatgcaatcacaccagtaattggttcttttctggaaacatcttttgcagaaacagcctcctttgtatcctgaaaatgaacagacaaattgctaaaaaaaaaattgtcgcaatgaaaataaactgaatattaaaaggagagcaatcttgccttccagatcttgtggtatttggaaacaagagtatatgaatggtcttcccacaggttggccagggtaaccatgtgcattttgttggccacgcctggtttaaaacaaaagcaaataaataaccatagtaataatttgcaacctaataatctatacaattgacatttggcaaagtgaatcccttaagaactaagtaacaggaaaagatgcagagttaagaaaaaaaatcaggagttcatatgaatatgaataactagttctgggcttctggccaaaggccattcctgaacacctctatgccattagtcaaacaatagtctcgaaagatcacacacctagtcagaaattccagcacacaagtgaaattaaataattaatctacttggtaggtaaagccacctatcttagtcagattatcactgtcctcacagcccaccgttttctttgaccgacaggatcatagaggtaaacccaaaactaggacagccaaaagttcagagaagaacactgaataccgatcctcaggtggtggggatgcaaagctagctagaggaatccaagaagagggggaggcgatacggtatacgagcgcgtaccatgtcg

SEQ ID NO: 51044 - DNA, 9726 bp, Oryza sativa
  unsure (1)..(9726): unsure at all n locations
tatgtttggacctcctgaaagatgataccctattcctatttgataaaaatgtccatataaagttaggagctctcaagctagcaaacctagttcatgttgattattgaaaaactaaccccttctaatcagttttgattgggcttttatacccaccatctctcactattagccgagagaaatgatatactgttgtaacatattcatgtcgaaaataagtgaaatagtaaggagagagaatatgaacagacgactaaattgtcgtcggccctccaagacgagccaaagctactgcatctaatttctccctgcatgtgacttgtgattggatggtgagcttcccaagacaacatgcagcagcagcaattggattacgcatgcaagcaaaatgtgatcatattatagtagtacatcttattattgtacaaaataattttaactcaaaccgtatttgaggcggcatgttttagagttatcagctggctgtatcattgaacttgctcttagcctattttctaacctttgagcttcgagccagtttcagtcgcctatgcagcctttctatgggactccacaccgaatccacctataaaggctcattgttttcaccgtagtctcaatgacactaacttcgttatctttatggagctttctaaaatagtgtatcgctttgatcaagtaaattagtgcttaaagggcttgttcggttgcttagtacaacggctgctaggcaacccaaggcagctgatcgcaagttgttttgctgcatctacaagcagctgcttggctgctaagaagggcgaacaaaccagtatgtagttttgtacttttgttgacttaaacagcaaagtgattagtattgtgataggttttctactgtttagattattatatacttgtaataaatatgtacttggcttgcacatttttaatatcctttgttctaagaggcaatcacaaatttgccaatggtttgaatcgttattacaatactgccgctagaaaattgcaaaaatatcaccagaactgatactcaagtggcattcttacaaaattaaaaaaaccaatggcaaatttgtaaaatgccctttttttctaaaaatagaagcaaactaaaaatttttaaaacccacaatagaagcaaaataaaaaaattaaaacccacatggaatccacatgacactgaaacaatatattccaccttgtttatctatctctcccatcatttggtcttggtagcggtggttgtggtggaggtgcgcgggtagttaggaggtgaggagacactaactagtgtgcgatgtgcccggctggcggcagaggaggcccagtagtcggcggagacgcgcctacaatccaggagtcgatgtcacccgctcttcccaccatcgtgagggcttgctcatagtgccgcttcttgcaccagcaagcagtagaagacaccacggggagcggtgtagactggcagaagtagtggttgtgccggttgcgaagcggcgcatagatttggaggctaggtggagtatggcaggagcggaggaggcccgcggtaccaaggcaatgccatgctccctagacctccctgctttcatcgagcccgcgcttcccctcatcgcattgctgacgacaatgactcctagcttccatctctctcctttctccccctatctttccctctctgttctctcctatcttcttggtgttgaggcctgaggcactcacgatggtgtgatgacaacctatgaggattggactagcagcgaccgacctgagcttccacatctccaccaccggtcaggctcgatggtgtagccgccaccgccacccaactcctcttcgttggtcgcctcccttctcctcatcagtcgcgtggcttggaggtttggacagagatgggaggagataggggaagagagggaagaagacttgtttaactgatatgtgggatctacatacctttttactttaggtttttattttttcctctggtgctttgggactatatttgtatcggttttaaaagatgaaaggatgcgttatatatatggtattgcggtttaaactcgactttaagataaggaacctaaagtgaacttattcaaagaaaagggaaaacataccgtaacattggggggcgcctagctggcgcgtatgcgccgctagcgcgcaccttccccatctaaccacctatactagtattagttaacattacttaacactaataacaataattaggaaagattttaaagatttttttggagatatttttactaacagattgaaaatttttcaagttagaaactttcgatttaagatttaaattttaaagttaaattttgaagacattcaactcagatttgaaaacattcaactcagatttaaaaacattcaactcagattcgaaaactttcaagtccagatttaaaagttttgaaaactttcaactcagattcgaaaacttttaactcgagattcgaaaacattcaagtccaaattttaaaattttgaaactttcaacttgagatttgaaaattttaaagttaagatttaaaaattacaaaaataggaaactaatataaactaattacgattttttttattcgtacggcaaggaaaaacaaacggtgaaaaaaaaatgaaaaaagaagaaacgcgggcgtaaaaaaaaagaaaaaaaaagagagaagcgcaagcgcacgtgcatgggacttgtgggccggcgtgcgcgccggaaacgctcacacgcgaattagcctttccggtaacattgcagcctatgacaaatcgttcatgggccgattcatcgtaggcccaactgacccattccagtccgggcccacctccactccccgagggataaacaccacgtgttcacactcgccccaccccccgagggacagcctggcacaactccccaccgtccgatccagatccgaccgctcacatcgccccagccacgtcacctccacctccacctccacctccacgcgggcacgtgtcccccgcctccccaaactttttgggaagatggcatttgcgagagaagatggcaaatagtaaaaaatccccgcttctcctcctcccatctcgccgcacgccgccgccaataaaacgacgcgacgcggcgcggcgcggcgcgacccgatgcgacgcgacgcggcgaggagagggagacgagctgagcagcggcgacatggcgagggggagcaggaggaaggggtgggcgcgcggggcggtggcgttcgcggcggtggcggcggcggtggcggtggggaggcggtacgggtgggacggggaggcggcggtggcggcgttccgggggcggagggacgcgctgggcccctgggcggcgcccgcgtacgtcgcggcgcacgcgctcacgctggcgctgtgcccgccctacgccatcctgttcgagggcgccgcggcgctcctcttcggcttcctcccgggtgtcgcctgcgtcttctccgccaaggtgctcggcgcctcgctctccttctggatcgggaggtacgggacgagttcctcctcctcctctttcttcgcttccgtttcggttgctcgtagcgctcgtggtggatgttgagcagggatttgtagacgtcgagatctagacataccgtgttcagttcgtgcgtgccctgatttgattcctgtttcgcacgatcgagaagatctgacaagaattgtgatgagagtcgtatgatcggagatgggttggaggaaaaaaaataggctggcatttgtgctttctcgtgtccttcgaggaggaacgttgcgagattctttgcttgtctgtgtagaattgttggaatttttttgctttatatggaatctggttatgatgttagagaaatactgcggccgaaggaagactgatttgtttgcacttttttttggggtgaaaggtggttggtaggttcaagaactgaaaattgcaaataaaattggaaactctcatccttagtctgttaaactgtataagaatatataaattcaggagctgctgggatgaaaagctaatcagctatgcaatcttgtgtgtacaagcgtacttttgtacactggtgatagttaatggagtagtaatgctaagtgaacttgaacatgagattcaggaggacaatttaatggttttgggaacagaaaccaagagtacgctgtaacttagcatatggcccattgattgattctggttgaaatttcctgtttggaacaaaggagttccattgaaatgctaggggatatggcctgttctgttcccaggatacattgtcatttatctttgatatcatacgatatctttgatatcatatgtttagttgcaccttgtttataactacagaacaatactaggttgatactttaatctttgatatcatacatctttggtaagattaaataagaaaatggatcctttgtgatataaacatgtgattgtcacacgtaactttaattagaataaacctttgtggtgaggaggcctctaatttggcagcccaacatctgagagctctcccgatcaacatnnnnnnnnnnnnnnnnnnnnnnnnnnactgtcacaattatattgttgccatgctatgtataaatgatggatcaatgcttattgtttataatactaactttttagtcatattgcacttgattggtttgtataattgaattttttcataatcaaattctgaatcattgcgctccaatattgcttacatcattccttcaaacaatccaataaacaattacttagaaaacggctccaattgaacatgttaattctgagtaagttaataaactaaccaaacctgaaagttatcttaaccatagatagtagaggtcaggttggttgttgagcagcctgaagagctacaacttcacggaaaggaccttgagaggtataactgcagcttgcctaagaactttcaaatatatgtagtgctggcaaagttccaccttttttggtaactttgtggctgctcatagacatgagagaagcaaactatctctcactaaggcaatgaatgcgattagtatcgaagagccaccctgtcaaggagcaagtcaagcaaaaaaaacaaagggttaaaagtcccaaatgaacaagtttaagacaagaagcggaagaatttttccctgatcaactctacgcggtcatgctgaccatattaggttgtgtttacaaaaggttacaaataattcgcagaatatgttccgttacgattccaatagcccccttcttgttctgggaaaagttcttacccttatttttcttaaccttgtggtccatctggcacttgtaagccttgttttgcttcacttgctccttggcatctatagctgctgtcatctcagtgatctcttcgatacttntcccgccattagcttagtgagagatacctgcttctgtcaattggcatctatgagcagccacaaaatcactcaagatggtggcaactttgccaacacaacacatgtatgaatgctctccagaaggctgcagtcatactgtcaaggtcctccccatggagttgtatctcttcaagttgctccaagaccgacctgccctctactaaattatacttaagataactttcagatatggttagtttactatgttcaattgaaccattttaaagagagttgtttggatagttttagaggaatgctgatgaagcaatatttgagcatattaaattcagaatttgattacatacatgaaaaaaaatccaaattgtataaaccaaggaagtaaaagagacaagaacttctgctgccttataaacaaataagcactgatattatttatacaactagcatggcaacaatataattgtgataacacataacaagtattactacaggttatgttgattgggagggctattggtagctaggggaaatcctcgcaggttcctttagctccatgtgtttggcctttgaggccagctcggcccaatggcctaaagcagcccaaagggcctcatgtcagaaatcccgatggatcggtggatagaactttaaacaaacacaaaacacatactatagatgattcgaaaaacaaggatgaatttttctgtttacaaccagaattaaccgcctagagcgattttcacgttgtgcctaatgccacgtccatccccacaacgcatgtcgtttgtctcaatcatggtgagagatgcgggcagccatgagctagcctcgaatgccctccaccaaaactaacatgcacgacatctacacaatctacacatctacgcacgacatctcatcgagatgaatgacgtgcgccatggggatggacgcggcattaagcgtggtttgagaatcactctaggccgttatttccttgtaagaatctggctttaaatgcagcacaaaagttcttccttgttttttggatcatctacagttcgcgtgtgctgtgtttgttcgaagttttatccgtcgatccatcgggatttctgatagggagcaataccacccacatgaagtggctgtagttgtcgacggtcagaaggaagtatatgctgtttgtttattgccataacatttagcactaacatgatttttgcagcaaatccagacattctcatgttttgcgaagtacgtaaactttttcgggttcacttgttcctctgtccatggaagttgaatagcccattatggacatttttgacacttttgctttttatttggatcaataaatgaggtcaaatttcagctaataagaaataataatctctttactctagcccatcctaatcacactatgcaggaatctagacatctagatataaggcccactatatgttgataacttgatattatgatctgctttattttgcagattgatcatcaatatgtcctggatacttttttttttctggttaaacaaagaaagtaaaatcccattttacatgttttgaataagtgaacttggcaactaaaaattagtgttatagtttgctttgtgatgccatgcaagtgggttcttgcagttatgctggttccatattgaatattgatacagttaaaagtggccatgcagtcagcatcttcaattatactgatgctctttcaggcacaataacatcattacgtcaacccgtctagtgtataacgctgtaatgggatttggatgtacatcctattatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttcagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaagaggtgaccatcacaatgtcttgcatattactgtgaggagctactacaaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaacaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatggttttactgatcatattgggttattcaatatagtagtagatacaacatggatgaaattgctagatggatgatgttttctagtttctatctgacgatttcagtcagtttggtgtataacagtgtttgtactatgtgatgcagttgattcatttctctagctgttgtggtcctgagtatgaaagatcagcatctcaccacacaaggattaagaccaaaattttttatatattatccccctacaggtggctaaaacatagatcttatgccttatctctatctgtctgccatctcatttgttcttcacaacttgtgaaggcaattgggcgcgatgggtacaggtagtgcctacccatacccatgcccatgagattatctgtgcccgtgggtatacccattactacatgacaggtaagaatgattgctcatgcccattgcccgcgggcgccttatgcccgcgggcgtgcccgtttacccgccacaacaaaagcagctgacaaaaagtctannnnnnnnnnnnnnnnnnnnnnnnnnnnnnnnnnnnnnnnnnngggctgcagga

SEQ ID NO: 51045 - DNA, 965 bp, Oryza sativa
ataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggactaattactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcatatttcaactcaactttgctttgtgttgtacttatgtttgaagtttgctctatacaggttgcgtgcggcaggccttctaccactttgtaggcttgttgaggcggcggcggacaaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtgctctacagtcgggcctagcaaggcttggttgctccagttcactgtaagtaaataagttgttattatcatacatgcttat

SEQ ID NO: 51046 - DNA, 5534 bp, Oryza sativa
tcctgcagcccctgctgcaccctgacgctaatgataactcggtccgacgctcccttgaggcgtacctgttgtggttgttcgggtgggtgatgttcactagcacccacgggcacgctgtggacttccggctggtccactacgcacggtccatcgcggatgctcaccacaggacgtgccgcagtgagctggggttctgccgtgctagcagccacgtaccgtgccctctgtgagcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattccagcgtcgttacgctcacgtccaggtgagacgaggttacccggacttcgtgttcgagtttgaccgtctccagccgagcgacgtcatttgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccatgtcgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggcgatcaacgagctcttcccacacacggaggagaactaccgtgactaccttcgctggtaccttcctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgctgcacgggatatcagtgccgatatcaccgcagtccaagtgaggttgaacagaggtttgcacttgactgacgttgagcagaggatgaccttcgaccggatgcaggagaagatgcgtgcggtcatgcgcatcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacaaaaacatcaccccgtcgtaacttgatgttccattctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacaacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcgttcatatggtgctagaacaacttatgctcatgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgatagtggggatagatgcatactcaagtcttccctcatgatacaaactcggggcaggagattcttccaatgcgcgaactttgatcaggtatgcttcatctattcgaagttcaaatggataaaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccatgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacgtaaatggtccgagcgtccaaagtgtgggtgcagagatcgctggcaggtggctacatcctttgctgaacaaacattttgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggtgccgataggttaccgcatgcttgatttgtcgagatcgacaaatttgtaccgtgtatcgatggcacttcttatctattttatcattacaatgtttaattatggtggtgattttttgtatgcgtaagactaagggcctatttggattgctaccaaaaacatgccctaccttaccaaattttgaatagtacttgtttttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaattatttttgtaaaacttttaataaaaaaattaaaaataaaaaaaattcactatcaagctgtgtatacatctgatgagtcctgttactttctcaaatgactcgcaactgagacaaattctgtaagttcatatatattacatctcatgtttctcaaggaaattaacacagtggtcaatcatctggaacttcagctttcatgaaaatacaccatcatcgtcatccagccactgcttaccgctgtatgtcatctcccggtcctagatcgtcgatcgctgggcgttgtttgtgtggtcagtcacagactggtacgccattgccagagctagagcctgctccccaatgcacggatcaaaatgacaggtcatcaactcatcatcactgttcttcatgtcaacacataaaatgtttatgtcctgagacgagaaagaacttacaacgtggtcatggtcaggaggagcgtatatgcccgtcgtcacggtggttcttctccgcgtgccgccttctggtgggttcttgatgctcttcaagcctgtcggcaccacagccaccggcatccccacaaggtttccaagacagacgagctcccagtcggtcacattgccgatgaatgcatcgaccgtgaagctctccctgacttctctgatcagtttaccccgtgctcgttgtgcctgttcatcgatcaaagaacaagaatataagttatggtgactcgcgatcctatagacaggtacactccttcagatatggttagtagagcacctgtatatagtcgactgcggggattaaccgtgcgcggcgaagctccactggccattggtcctgagcttcatagtcgtcgtcgtgtcgctcgcgttgccagttgtcgaaatgcgcaagcatgtcaacatccatggtgatgttcagtatggattggaccgattgaacggtgtagttcagcttgaaagg

SEQ ID NO: 51047 - DNA, 1253 bp, Oryza sativa
ccctccggtgactcatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcaccgcccaatggagaaggtataaacatgtcatgctcattttcatcttcctaattatgcgcaccacttctgtctgctgctgctccacttcctgattcttgctctccatgcttcacccaacatgtatagccctccatgaatcctcgttgtatcagatgaccgtgt

SEQ ID NO: 51048 - DNA, 3317 bp, Oryza sativa
tgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagttatctctatcgggccttaataaaagaccgtcaaaaaagagtgtcatctgtgacgggcaataaacttatctcaatcgggcctctagttggagcccgtcacagatgaccctcatctgtgacgggcttcttttagggcccgattgagatatggaaccctcatgtcaatggggcctgaactatagcccgtcacggataagtgtgatccgtgacgggctttacttttgtgccgatataccatggctgtgcgaccatatctcaatcgggcgaaactttgggccgattgagattacttccttgtgacggccccgaaattccagtcttgttatgggccgtcacagatggaacgatctgtattagtgactcctatatactactgctactatactaaacagtatatacctattgactaaataaaaaacggtatatactccctagccgatcaatttattatatattggatacttggaaaaacagttcataatccttaaccgatcgatttaatacaataatagatacttgaaaaatatagtatatactggataaaaaaatcagtatatacagataaaaacagtacatactgctagtaaattaaaaaacagttcatacctagtaaataaaaagaggtatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtgtaagcttggaaaaaaattggcctttgcaaaaccacctagtggaggccacataagctagaaatcatgaaacatgagaattatttggacatttatccaaccaatactttggaatatctaaacaaagatagttttgccaatgctttggtgcatggaaagaaaatatgttgataaggctgtgccagattgctttggcattttgcaaagttaagttagcagttttgtaaattatgagctaggtaaagaatcttttagaactgaatttgtatgggacttgtagaatgtgttacacaagtcacaacttacacagataacaattaagagtatgagtcattgccatatgtgaatgattgagaaggtaaacttggatatttgtaaatgtactttaatagcatacatacatatgcagtttggcatgtatttggagttttgttaacaagaattggaagtaacgaacattgctataaagggaaagaagtaaaggagaaacaaattttgggtccatcccaaaaataaagcaatgattagagtttggccatactctttgctatcctactttccatgtatctagtcctttatcttacaaataaagagaaatgaggaagtaaacatatttcatgtattcatattatgacgagacacatttcttaggcagacactactgacactatgcaagtattaagttgcattattttcaaatttaa

SEQ ID NO: 51049 - DNA, 2555 bp, Oryza sativa
  unsure (1)..(2555): unsure at all n locations
cgcaaaaataagcttatttttacaggcagacctctcaagagaccgcatgcaaaaatagattttcgcatgcaggcatcttaagagcaccgcacgcaaaaataccctcccccctcaggcatttttccctctcaaccacttcaaaaatttctatcttatcctctccaactactcatccttatcctcatttcttctatctctctcatctctcatgggcggcagcggagcggcctcgcactcccccggtggcggccgggagcggtggcgggcggcggaagcgcaacctcgcgtgcaagctgcgaccgggaccggcagcagcgcggcctctcacacgctccctggtggcagcgcccctcgctcgcccggatctagaggcggcgcccctctcctgcccggatccggctgtgggcgccggcggcgacgcagccgggagcggcggtgggctcgggagccggccgcggcggccgatcgcggcggaagtgtggcgacgctgacaacgacgatgacggatgacggcgatgacgatgacggcggatgacgacggcgacgatgacgacaaccacgaggagggcgtcagcttgggttagggtttgaatattatttttttggggttttttttcgtgcgggtgacataagccaccctgattttcgcgtgcgggtgcatcgcccgcacgaaaaaaaatcagatttttgcagacactttggtgcagacaggcaggagatccgcatgcgaaaacccttttcgactgcacggaaaaattgttttcgtagtagtgaaaaattcaaccccactccgaagccatacaacaactcacaaattgcaatcgggttcaatgtggtctgccaatccagatgactagattgtgataaatctagggttaaggcttcatagaagatagaactgattcatatgctcaagtgaagtattgttcattgcttgagtagataaaagttccaaggacatgattttcagtgaactggatggagaaaactattgcacatgtaagatcaatatattgctgaaacagaaaagatctatcggacatgctggcaggtaccaatgtactatgaataaaccatcctagcgagtacttatcttgttaacatgttatatgtatactaatatatgtatagtgccagctcattgaactcaaatacaacaactatcgtttgacatttatcatgaataccttcaatgtgatcttccctcagctagaatgaagttttctttcgctctcatgaagttactctactaatgagatgtatatggttgacaacttggcatgcattttccagtttcacaacaatatgttcattatttaaggtccgcttgcaaccttataagggctctcgtatagaaaaaaagtcatttttatagtagtgtcataaccggggagaaatatatactactaacactataccaaaatataacaacttttagccgtgaatctatagataagtatttgtacggatttgtagctaagacttatttaattttagaatggagaaagtacctctgtatttaaatatacaatgtcctaggtattatttgtctttggcatacaattttaaccactacatgtattattagaacatggcgataatatccaacaaaactatatattatagaagtatttataaaaaaaattgaccaaaaatgacttatatgtttgcaagctaaagattttgagagctattgaaggtaaaaattgtaaaattttgaccaaataaagttaatagtgttatattttaaatatggaggggtactttcttttatatcgttaatttttcacaacgatgatcatgaactcttctattttgatctttggaccataaggaataattactccttccaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattaagcatctagggcgagcgactgaagaaagaggttaagcaggtcattaaggacaagaggttcaagcccaatacaataagttacattaataaaagttcttccattgcaatgatgagganccccacccatcaacaattttttaaaaggtaaggccccccaatagaaaaagcatgactagaacatgaaattaccttccagactaagggaggaagagaaaaccaacctaggatacaatgttaatgtggcacctctgcatttcttgatgtgtcccagtcatagtcctgtatgtctatcagttctctttctcattgcaa

SEQ ID NO: 51050 - DNA, 2191 bp, Oryza sativa
attgatgatatatggtaaacggatgattttttgattgatgacatgatgatgaatagatggaatgtggtgcattaatcaatttagtgatagatgcatgatatgtggatgaatagatggtatgaggtgaatttatgattttaggatttgatgatatgtttaatttatttatatgtgccattcaattcattctatcgttgtgatatgcgcaatttagtttatttatatatttcatttatttttataagtgacattcaattcattgtaatagattgtagcactcaattgtgtttttttttgtttttttggaaaaaagtagacaatgtctcagcaaggcgaaccaatgtcgacgacaactagtgggtcctcaagggcacgtactcctaggacagggaacaaaattcctaaggaacggttccgcataacagcggtagacgccgtagggttgccgacatctccaaggaaaatattgagccgatttaggtctatctgcggggtcatagggaggcagaaattcattattctgcaagacgacttcaagctcgtgccggccgtagagaaggacattgcttggctaacgttcaaggagagctttgattatcctgcggagcatgaggaccgtctcaggcgggctgctttcaaggttatgggcactgcttggaagaacttcaagactaagctagtcggcgagttcgtctacaacccggcaaatccagatccaagagagaaatttccttggatcacggaacaggtctggtcggaattccatgcgaagaagtcgacccccgagtccagagctagaagcgaggcatatcgcttgctccagactaggaaccagcatccgcaccggcttggtaccgccggatatgccggtaaggaagaggaatggcagcgtgaggatgaagaagcgaaggaatcgtggtacaccgctcgtgtttggcgatatcccacaccctcgggctaggaactgggccagggctaggtaccagaaacatgatgatggcacaatcttcatgccaaatgtagaagatcaacgagtatacgaagctatagtaagtgtctaatcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcgaagaaagatgcacgccttgaagccaagatccgggagtcgatacgagctgagctgacatctgaattcgacgaaaagctcgagtcgatgagggccaagattaggtaagagatccgagaagagcaacagatcccccaggctgccgctactgctgcgcacaaagagttaggaagtcccaccgaaaaacgcagcagttgcgcatcaactgagttggcggaaaatccaacatcggtcgacagcgccatcgaccacataacggtaaccgtgaacttactcaatacatgaaagacgtaacgaatccatatgatatataatattctaaaaaaattgattaatctatcgcaggaaccaacgagctgcaccctcacagttagggtgatgccgatcttcactgttccagcagccgagggacttgcgtacaagccgaccccagagacaagagtgcatggagcgcaactcagggccgactgtgcaaaagttcaagtcgactcggtgaagcctgaatacgagctgttccctctgaagtatccaccgaacgacgaggtcctctcactaggaaatgcccgtggtaccttcatccaatggcctaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggatttcggggaggaccgaacggaggccgacagcaaggcgattcatgaacccccaccgatgaagaagagcaggaaggcacactcttcccctcagagaattactctcgataaacccgaagcaaaggggagaggaaggggagg

SEQ ID NO: 51051 - DNA, 3802 bp, Oryza sativa
tgcaccggaagttgccttccttgatccacaagtggtcactatcacaaatctccagaataaccgtcaaggaatggtcaactacatctacgacaccttgtggtcccgccgagacaagagtacattatgtgtgcctataatcaatagtaagtgtgttaactaaatatacacaacagcatgacacattccttgagtacttaattaactttcactatattaatgccgcagtgcccattggatcattctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttctcggtgaagcaacaaataggtgaccagtgcggattccatgtgtgccacaatatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaatcccaaaggaatgtttaggcttaaactaaaatgatgaataatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagttggggatattggatatctgcgtttgtttctgtcatctttgcagcgggcatggctagcaaaggcctgaggctagccaaaaaacaaaatttattttttttgtggattatagtcatctgtgacgggccataactaaatgcccgattgagatgagatcatctgtgacgggctctagtttaggcccgattgaggtcactagtcatctgtgacgggctctagtttaggcccgattgaggtcagcagtcatctgtgacgggctctaatttaggcccgattgaggtcatcagtcatctatgacgggctatagtttacgctcgattgagatgagtatcatctgtgatgggctctagtttacgccccatataggttagtagtcatctgtgacgggcgctcgtcgtggcctgatagagatacgtcatctgtaacggactatagcttgactggtcgtctgggtcaaagctatcggtgacaggctttacttagggcccgattgagatatattcattcacgacggctgattgcccgatcgagataactcttcacatcaatgactactaccctgtgaccgacgctgagcccgattgagatgagggtatccgttctagagaatgcactttgtttattgactagcagtatgacacttgtcgtggcacacaaactcacatatgacattgaactatgagcacctggcactgatcttgcgaataccgatgctttgttggacataagctatatactgaaatagaccagtagtatatatctaaacctgaaatgcgtgggtgcataattaattattatggagctacatacatgcacgatatggtcattgcattgcatatactgcaaatatcctcgatcgatctattctgccaataaagaggatgaactgaatgtttcaaaaacgaaagaaaacgaagatggtttcattactgtcaggatttcagcatcatttcctcagtcggccgttcgcatcaaaaacatatatatgtactaaaaagcaagaaccaatcgtcatggatttcaggagatcggcacagccatcgtctgggatcccgattgttcgatcggagcaagtgcaagcacaccatattgcggactctagcgacgactagcgtcactagcctctccgaggtgtgcatatgcaccatacgactgcctgggcaaagaagataagattgatatgatatacacgacataagaaataattaagtagtactaccacatgcattgtcgctttcgaaaaggctttgcgggagatcgacgagtgattgatgccgcctgggttagttcaactattgctgcatcgcaccgtcgactagtcccgtcccgtcgcgccgttgccttggaggacgatgacctgcaattccgccgcacgatgttgccgatcggtcgacaccgccgccgcgccgcgcgtgcaggtcgccacgccgatggatcacgccgtcacctgcaacgcagccatggatcgacgatgaatctcgctgctgtcgcggaatcgacgatgaatcgccgccgccttctccgagttctggtatatcgcggtctctcccagtgacctgattttcgtatccgatgcactggtgggaccgaggaattatgcgagctcatgtcattccggtttctgtgattaaggggtacgtaattttttttctagttaaaaagttaaacgggtccgctcgttaatccgatatcaggatccatcgaagctaatcacagatcgacggtggataagagcaggtgtacatacttccaggtgtatacttccaggtgtatagaaccattttcatatatatatatatatatatatatatatatatatatatatatatatatatatatatataaagtttggtaagatagatgaaataaccttgtccttgaagatatcccttcagtgctctcataatcaagtagtgtaatgtctttcacttagtttgccattgtactaattcataggatgcaacagcatggttggacgtgttcatctcttgattatgaatattttgtccatgtgctccaaagcgttaagcattggtacgaaatttttcgttgttttttttttcttgtgttggattgggtttgtgctacattgggttttgtgatctatgggcctgtacacatcagtttatggctttgtgctatcacaaatggttagatgggtttcagcttatccaatttcctggtaaaacagcttctactcttattggcaaatgttgctttaatatagtgtatgtatggtggcctctcacagtcacaacatagtacggctaccaaatatcaaatgagtgtggaattggggaaaagaagaaagagacaggtggtgcaatgactaaagcaagaagaaaattagacaaccaactgcattatcagacaatttttcttgctttgtggggtctaaaatagtactgaacgaacttgatttctttgagagagactgcagcattttgagtgcttttttatataattacaaatgcaaatatatatcacacacacaaacacacttgcctcctgtttattgcatccagaaatgaaagtaaaaaaaaatattaggaacagttaaaaatcaggcagccaaagaacacagtaacagcatatactatctgctccccaattgattgattgcacctagatccaatatcatccaaataaacaaaagagcacaaggtcaaatctttagccaccaagatcccatcagccacaaatcgatccatctccaagctcaaaatcccaattctttccaagaaagatttttctcggaggccatgtcgaccgccggcggcggcggcggcgg

SEQ ID NO: 51052 - DNA, 9176 bp, Oryza sativa
  unsure (1)..(9176): unsure at all n locations
ctgcttttcatcaaaagaaaaggaaagagttggattcgatctgtaaattaactgtgaatgctttaatcgccaggacgggaacaatgaattgatcttgtggatttgtgagcatgtcgggttgttttgagcaagatcaattgtgaatgtttagtttgtttctggatttttttcttcttctccatgttaagctgtaaaaatctcttcttgtgtaaaggaaaagtcatcatcctttcgacggagctgctgcatatgggcttattgtaatgctgtgtatgggtagatgatttttttttttcaaaaacaagattattatataaaattttctgtaaaaaagccaaataaatctagtttttaaggttatagtcttaatttctattcaaactactagactgtgcgtcctcgttgctaaactgtttaagacaattagatgacctaacttctactctctcttttttcacgtgtgtttattccctaaccagttgtgttgcttactacatgatcttggaataagttcaacggaggactctcaacttgatagcgagaaatgtatacccctaaacttatacaaaccgtgcactcaaggtcatgtggcaatatatatgagtggtttcgctgacgtggcatcctaatcaacaaaaaaattaaaaaagtacgtgggacccatatgtcagctgtaatttttttttcttctcctcttctcttttctctcttctcttcttcagcgagggaggccgacggctggcgggcgagcacggcggcgggcctgtgtggcagcggagcggcggcgggcggcgagcggagcgcggcggatgagttcgccgtcgtgcctcccgccggctcctgcgtctccgccacccacactgtctaccactacgaggcggcggtcagagcaacccccgtccttgtcgtgcttcttcccttcgtcggaagcgagcggaaggcgaagcaggtaggcgacagcggcagagcagcgacgggcgagcgcgatagcggggcggctggcaaaaggcgagcacggccgcaggcggcgaactggtggtttgctgccagatagtgccgccacggcggaaggcgagtggaaggtggtgacgcagctgtgcagggcatcgtgacaccatcgcaggagagcgagctcgtcattgccaaaacaggcgacgtcatcgcctcaacctactacatgagagcgtgggagcgcgacgccggcgcagaggcggacgcgttgctagaggagctgtggaacgtgaaggccaagctcgagctcgccgagacgaaggcggtggcggcgggcgcnctggcgganaaggcgcgagatgcgtacgagcgtgacagggaggacatgaggtgcacagtgcgccgtgctccaccgctacccgcacctcgacctggccaggatcgtcgtcgcgcaaccgggcgataacgccggtgccagtcggcctcctctctctctctctccctcctccggtctcgctttgtctctccccactcccccaccgcgcttgcccgccgccgctccgcttcctcgcaggcccgccgccgcgctctcccgccgcccgcccatcactgctccgcccgtcggccgctggcctccctcactgaagaagagaagagagaagagagaaaagagaagagagaagagagaaaagaaggagaagaagaaaaaagatgtgcagctgacatgtgggcccccacgtacttttttttttctgactaggatgccacgtgagcgaaaccacccatatatactgccttaggaccttaagtacacagtttgtatgagtttaggggtacatatttcggctttgttcggttacgcccagattcaatccgggccgggaatgacaagtatagtaagaaatttatgatagatacaataagagactaggatttattccagaccgggaaccaatttactcatgatagatacaacaaaacatccgaattagttccacaactcttgactagtgggttgattcctggtctcttattgtccctatcatgagtaaattggttcccagctcggaataaatcccggtctatcattgtatctatcataaatttcttactacacttatcattactagcccggattaaatccgggtgtaaccaaacaaggccttttagaaaaatctcgcccttaagtcaagggacctccggtgaacttatttctacaatcttctctccgaacacaccctaaccagcagaggaacctgaaaattactcctctatattaggccgctatgtctgactaggtgaacctcggcagaggatggaaccaagtggcccattagaggcccaaaactcctggccttgctgccctgggttgaattggtcaaggccctacataggtcccacccttttttttccttgacagtagctctgtaagcaccaggtagccacaaagacctagggtgtgtttggttggatagatgagcctggatgtggatgggagatggccgctcgagtttttgtagtgtttggttggagggccgggtagatggggtagcctggaatagggaatattctctcaatatgctggatgagtgcatccggctgatttggctggatgaagccatccagttttggattgggtgatgtgttctattccgattggctgtggttggtttgatttcctgttaagcaagctccaaataattttttctcctaaaccgtttatctaatttatgatttgattacaccattatattttttataattaaatctttaaaataagatctcggatgattatattttgttaaaaaatatatatatgacaaatgggtcccattaacttttggcttttcccatccatgctatatccctccaatcaaataagaaattggatcgtcatatccatacaaaccaaacaaaaaattggattgtcatatccatacaaaccaaacaaaaaattggatcgctatatccaacaaaatatggatggccatatcctatccatacatgaccgtgaaccaaacacacccctagttaatactcgttgacttttttctgtacatacagttttacatatttcacaaaagtttttgaataaaacgaatggtataacatgtttaaaaaagttaacggcgtcaaatattttaaagacggatggagtatgtcacgtaggataaagaacaaaatcactgtccaaattatcgagggacatgattaacactggttttgagagtagtgggtggctttgtaccatattttacgattgatgctaatgaaagttgacccacagcgaggtatctcaagcggactttatcaactaagggagtgacgaccttatctggtaaattaggcccaatataggcccaaaatttctggcccttgctgcctttgggctcaacacttgaaggcctcctcctcctccttcaatgtagaatccaaccgaggccatggagcagcccaaaacggtgcaatggcgtgagcaacagacacattgacttttttaaaaaaaaaaacacagtgtaaatgtagacgctaataacacggtcacactcatcgtccttgtgaacacaaacacgtaaatcctacccctataaacatctccagaagattagaccgacatatcttgatattaacgaagtcaccacgtacacgttgtttaatcatcttgcttagttagtcatcagttaagggatgacagcactagtaatcgacaattactcgatcggtaggaagtgcaggaggagtagaccagttaattaactggagctcgtggttatgctttttactagttgacaaaaaatttggtcggtctcggtcaaacgatggcacagcacgggcgcagtttgtagctgcatctaggccactggtggtgagtagtggttgctggagctgaaggagcatcatccaccaccatggccatgtggggagcaggagctgaaggagagcacgcacgcctatcactatcatagcattgtacgcacacgcgcgcgagcgattcctgttcagatttccatgactaaaatatatcatatatgatcttttattgctactttctttgttttttgttttatgtcctaagttgtttgatttttttttctttgttaaattttttataagtttgagcaagtttatagctatagtaatactttaaatacaaaacaaacattatatcaaaatatatttaatattaaatttaataaaactagtttgacggtgtcgtataattttctctataaattagatcaaacttaaaagaattttgactaaaaaaattcaaacaactattttatgacggggcagtaatcgagaagtatcgtacctatccatggagtgcaaaacaatggcacggtccatgtgtcgtgtcgtactaatatccagtctattcgtgtaagcgcacgcgcacaaactccaccgatggatgaatggatggatgcatatccatcaatctgttgtctaatctcgcagcatcagcagtgcgctcctccggcttaccgctggttgtctcttctccagagaggcagagaccagagtttcaactttcaacctcacagggggcattttaaacatcgtcgtcacgagtctaaaccaaatcaggatggtttctctggtgcagaaatgaaccaaatggtttatcataagtttctcaagggtgcagaaatgaaccaaatagtttatcataattttctcaagggtggtacgaatgaatgaattaatgactactataatacgggatatctctttggaacacattacaatatattaaaaagaataaaaataaggtcttaatttgtaggggctatattcggtggacacacttaccaacggccctgattatagatcttaaggatcaagactctaaataacgaatttaggagagagatgcgttagttaattacatgtatctatacatcttgtattataaaacaacctaaaaagaaaaagcagtcgtgcctttagaatgaagggagtaattgactttgactatctgaacgtgcacatgttaaatcctgcattcctcttccgttaattagcccgaaaccaagaagggaaaggtagagagataaacgtatacgtgttgctcgctgattggtcgcctatcctctctgggacaaaccccgttctgaccgctaccttgtccccagttaaaccctttcccaccattgaccatgaatgcggtacacgtggcaagcaatccacaccttgcattgtccccttcatccttggttaattaccctggcactggattaattaccttaacctgagagtaacatcacagtacgtgtgtagtaaaatactcctgtgaaggatggatataccagcaaaatcttgtcagctggcattttatcttatcctgttctgatatgatgactagcatacactgtaggagcatatttttcttactattccgctggcattaattactgtaagtacaagttatatactccaactatttttatataaggaatattataaagttacaaattcaaaactaattactcaaactatgaatatatatatttggtatgtaaaaattgttccaatagaattatatttttaatgatatttcgattttataatacaccttatagaaagaaaaggagggagtatacgtaaccaatgcaacgaaaaataatttcaggataaggtctttacatttctacctttaattagtggtccaaactccaaagcaaacctgagtgattataaattaaggaaagaaaaccaagttagtaattttgaagttatatattaaatttcaaaattggtgtagttttatactccacaactcaacaagcaatactcctaaataaaaaatccaagcaaagtagatctacctagctagcttaatcatataagcttcacctggttttttgtttgcacatcatgtaagaaatcatgcatatgagtgtctctttagtctatatatacatagagatctcatataattacatactggctaccaagataatatcacagatctgtatataatactccagcatggcctttctactgattgactatgcggatagtacagctaattagacgatgtgctagctgttgtatattgcacaagttgatactctcctctgacgttagtaggagtacactataacctacacttaattaattaattaattaaaattaaaaaaatgtgggtgatggagcagataatggtggctggaagcccggatccaaggccccatctttgaccatcaggtcaaaactgtgtgtgtgctgacatctaagcgagtagcactgcttgcattgctacctttctaagcaaaaacaggccattatatagtctagagcccacatgcttaattgttttattttaattcccatcttaattttgagtagtgatactgccacgtgtacagttaggtactgtgttcaaacgaaatttgtgatgcttgtgttaattgattaacactctcacaccgacatatataggaagtgctatgagaagatgcccgatagtacagtgataaagggggtgtggttttaatcctaaagtttcgtattcaattttcaacatgctcatatttttttatgaaaaatgtcaattttttttcaatctgatccttatataggacatgtttaggagtttttaatagctacatccattgaatcccaattctctcatattgcctaaattttactttaggtcgtaaaatctaatggttgaaaaatctagaaatgaacgattatatagaagaaaaaaaaccataagttcttcaaaacccttttttttttcttatcagttggctacttaccatctacttcgtgtgatctacaattcctttaaacaagaccttaattacattttacaccctgagcccacctgccatcgatggctagctcataacttagctaatgtcccaccgctagcaatagtagctacttgctcaatttcctactgataataatgaaggagttcaaggcaagcaaaggagaagtcttaccctgcatctagagtaccaactttgaccagcttattagcacactcaattagtgcacatgattcccggttttttcccgtcaaacaaacaccaccacactcaagtcgccacgtgtaaatattagtcaatactcgttattgaaaccggacatattatattaaatgacacgggagattacaactctgccatcataataaacagataaaaagaatatcaaaatagagcaaagagcctcggcgtcttgaaaattcacatcaaattaatacgatcgcatgagactacccacaatgttaaccagctctgacgaacataagagctaatactataccaatattaatatatagcacctcctctaatttcacaaagtttcatatcaaaactcaccggcggtgggccctagatccaattgtcattgcataacaaaatatagcaataggccctctctagctcacacttactccattagtctcaacattgacaggctgtggactgggacccacctgccggcattctcatctctctcacacacacacaccaaattctaatcaaaataaaagcaaaggggatcatgatagtgtcacggctttgaccggctactgccattagataagccctaatcaaagtggattagtgcttaattagagtgtgtgattagcgcgccggatttggatctgaatcggagccgggagctaggatcagtgagctggaagtataatgcccccaatttctcaatctttttttaacctcggagaacgtgctctcctctttcttttaattttctttttctcttttcaattcaatcttgccttttaattttgaccccggtcaaactgctcccatctcgacatctctcatggaaacaaacgcacgcgtcacatgccacacatgcgtttcagtgtacagtaactgaccgaaataattactgacttaacaacaactgtcaaaagttactactaattaccttagctaacaaagatacttagcactaatcaggaacaagatgacgtaatgcgtagaggcatattcgaatctttcactgttttgatccgcttggaacaccggttaataacggcataacgcgtaatatacgccatagtgatttggacttttttttttctacgtacttttttcttttctttttggcctaacgaccgtcatgatgagcatttttgactggatttgtattcgaattcgatttattccgtctgactttgcttgggtaaaacggcacctgaaaattcgtgcgtgcgtgcgtgccttgaattatgcacagcatttgcagtttgaccaaggcttgtgctacgtgcggtttagctgcagagatctcggtgtgagtgagtgtgtgcactgaacgatccaaatatttttgaatggtttatgccaagtggaatttgaatttgctatgaaaattatggtattcatgcctacaaaattgtttgtaatcagttttggaaatttggataccactgtattgctggactcgatgggcgcgcacacaggatgtgaaatgtggggaggaagcagtttaaagtttaaacaaaccagaaactgaaaaaaggggaaagcaaaagtgagttgaaattttgcctgccaccacgcagccttgcttttttttttcttcttttcttttttctgatcagaatgcaacgaaaaaccatgtacaaattagcaccaaaacttttctgtaattacaaatgcggacacagctgcagtcgaagctgcagctgaatcatcatcgcctaaactgaactcggatcgagcttaatcttaatcacccccgttaattaccctcccggagactaattaattgattttagcctagccggagcacgccaccgcgccgccattgccgcagacgagggtggtggtggtggtggcggcggcggcctctcgccggcggcggctgccgagcctgccgaggaaggggaggcctcgacctttggaggatcttctggtggtggtggcggtggcggcggcggtggcggtgtcaccggcggcggcggcgacgacttcttggatggtgtccagcttgggcgaccaccgccgcgccttgctgtagccgacgagctcctcgtactccttctccagcttcttgtccccgcgcagcacgggggggttggtggcggcggcggcgaggtcggcgaccttgtcgtcggcggcgaggaggaagtcgtcggagaacttgatctggagcgtgccggacgcggtgcggaggagctcgaacggccgctgctgctgcttcttggcggcggaggcggaggaggcgga

SEQ ID NO: 51053 - DNA, 5245 bp, Oryza sativa
gtggggcccacgtgggggtggcaggtttgacactttgaccggcattttttttcttttttcttttttctttttttgcgcggcgtttggatctagctagttcctcagtcgtcacactaccagcttggctttcccactttttttattttcctttttctctttttatatatactactgtataaatataaaaaatacatatagagatattcaaaagatgcgggtgtgtcagaatgtggggcccggtgttcagtccacgtgcctgcgacggtgccagccagtgtgtgtgaccgtggatccatttcgaggcgacgtacgctcgtgcatccatccactcgtgcgtgccaacgtgacaactactactcctcttctaccgtgcaaattttaatggcgcgatcgagttggcaaattgcgcctagtaatcgaggtgagttcgtggatgtttggagcacgtttggttagtgtgagggagtatttttgtaccggattaaagtaataatgttgcgtagctttaggaaccgggactgatgtgtgacgagcgatttctagcgtttggttagagtgattttgcatggagttcttgaaatctggtatagtgcgacaaatgatttttatcctcctgttagagcatagtaatattttcgtgtgtctctagaaaccgactaatgttcgtattgttgtgaagctcttgaaatctactatagtgcgacaaatgattctagtcgattaaagtgatattgttgaggagatattgaaatatgctatagtacgacaaatgattatggccttcagctagagtgatattgtcgcgtacctctagaaatagactaaaggatgcattcagaagtcaatgttcttatttcccactccctcgttttctacgcgcgctactctttctaaactgctaaacattgtgtttcttgaacaaaaaactatagaaagttgtgtaaaaatcttatttattcttttttaacattatttacttaacatttaattaatcatatgttaataagctatctatttttcatgcacgtgggagaggttcccaaccccttctccagaacacatcctaaagtgatattgttgtggaggtcttgaaatctgctgtagtgcgataaatgattctagcctctagctagagtagtgatatcatcgtgtagcactaaaaactgaccaaagttacattgttgttgagcgcttgaaatctgctataatgcgacaaacgattctagcctttggctagagtaatattgtcgtgcagctctaaaccttttttttttgatagtttgtggtcaagaaaaacatttgagttgcatttgtgtcacggaattaagtcatggatgcattgggaaaacacaatgtgtttgtcggtaatcctacctaatatgtggtgagcatttttggtgtcagattaaagtaaatcttgtcatggagctctacgaaccgaccgaactgtgaagagcgatttttggcatttgattaaagtaatttgtcatggagctcttgaattctgttgtagggcgacaaatgaatttttgttgtggatgtgatcttgaaatatgctaatgtgcgataaatgattctagcctccggctagagtgatattatcatgtacttatagaaacagattaaagtaatattgttgtggaggccttgaaatctgctatagtaaaaaatctagcctctggctagagtgatattgtcgtgtagctctaaaaactgactaaagttatattattgtggagctcttgaagtctgctatagtgtgaaaaatgattctaacctctggctatagtaatatttttgtgtagctctaaaaaatgactaaaataacattgttgtggagctcttgaaatttgttatagtgcgacaaatgattctagcctctagctatagtaatattattgtgtagctctaaaaatcgactaaaataatattgctgtggagctcttgaaattttttaatagtgcgataaatgattctagtctctcgttagagtaatatttacatgtacctctagaaaccgactaaagtaatattgttattgaggccttgaaatctaccataatgtgaccaatggttctagcctctggctaaagcgctgaagtaatattatatatagagctcttgaaatttgctatagagcgataaatcatttaagcctctagctagactgataatatcatgtacttctagaaactggctaaagcaatattattgtgtggagcttttaatatctactattaaaaaaattagcgaccggcaatttcgttgtgggatcatgaaataattttagcaacgggccaaaattatattggaatagaacactggatcactaagaaacattttttatggcacactgaactttgccaaagagaggcgcctctagctagttaatttgatcaagaaaatattgaagtaacacttgttccatgaaattaaaaactgtagcgctcggttcaaagtattattatcgtttaatgtttggaagactcaagtgtgtgacaagttcaaagtaataaggtcatgtggcactttattaccaaaaaaaaaatcaatggtgtgtggccaagaaaatattaaagttgtatttgcgccaataaatcaagtttctgataaaaatatatcctcgtcaattgtccagctagtttgcctaaattgtgctaagcatttttggaatttggttaaagtattattgtcgtggagctctagaaatgaaaatgtgacgagcgattcaatatttggttaaagttattttgttgtcgagctcttaacccgctatagtacgacaaatgattatatccactagccatagtaatattgtcgtagagcacatgatcatcaacaaactttttatggcctactaaactttgccaacaagcaaagtcgctagattgatcaagaaatgttgaagttaaactttgccaacattagagttctctgttcatcaagggaccagaaagatgaactatactcgttttctcacaatatttagacaaaaaaaaatataaccatttgtttactcttctcaattcttgttggaacaacctctcactcctatgatatgcatagatacaaatgaacaatcagccccctacaaaatttttgccggaaaagtcccctacaaaattacagtgacataaaaaaaaaaggacgatcaacatggataataaactaaggaggcacgtacgtatgtaaatgctaaagtttcattttgtttagcatagcaatgcaattcaataggcggttgacatactgattctggacttgtttagatcaattttttcacccagtcacatcgaaagtttggactcgctaaatgataccaaacttttacattagaataataaagctaccaatagttaacctgatcaccaaatgatcaatgccttctagaacaactcagaccctcttctagaacgaacagaagcacaattcaagcaagaactactaccacaaaggtccaagaaagcggtgcaaaatttggttttggatttgaatttgtcgacgcatgatgttcaaccgtagtccgatcgtcactactacactcctctgcagtccggccgcatgcatgcatcttctgcagctagccagctctgaatttctctgatcatcatcatgcatgcatattatcatatcatcagatcgatcaccctccttccaaaacatgcattcatcatcaacagtaaaagactactactcctcctaaaagttaatttgtttgttaggttggtgttgtggcgttggaccaacaacaacaacaacaacaaagccagcagcaaacacagcagcaacaatcatgtgtgtcgttaggttcggtactatctgtcaaaggatcgagtccaagctagcgtttgcatggaccagagactgctgctgctgctatcgatcaaccacacaagtgttgaaagttccaaccaaacccactgtctctaggcttaacacttgctgttgtcagctagttggtcccatggaaactacattgtcttaatttgggtgcagtttttagccacaggttcagtcattttggaacagctagtagtgattttgtccgctatttcgcctgtttatccaatgggtggaacagtggttttcaggggggaacagtgatttgctctgagatttctatagctcttttagacttggagtaattgttctaattatttatccctccttccctggccgccattgccgcgccttatcgccatcctctcccttcttcccaccctattgtttcgcttatttgtggaataaggcaaacggcatatttgcaaacgaaaaataatttatgtgtggaataagtcaaacggcatagttgcaaacgaaaaataatttatgaataaaacttttatggtcaattgtcctcgccattaataccaaccacaacccaccaccatttagcggccatacaccaaacatcacacgtttgtacatgccccaacacaagttttaagacatggagaccacagtcgtaaatcctctcatagaaatcctaacaaaaagtgcacatacacttactatcacaggggtttaatcctggttgggtccaccatcatacttttgttctttccctggtaattaatacatccccatttcatattataagtcgtttgatttttttcctaatcaaactttgttaaatttgactagatttacaaaaaaattaacaatatataaaatattaaagtaatatattttgataatatgtttgttttgtgttgaaaatactactatatttttctataaacttagtcaaactttaaaagtttaattataaaaagtcaaatgatttataatatgagatggaggaagtacgtaggaatagtgttatgtcacaagtattttgacgataaaactctagtagcaattacaaaatagaagcagcaaaattgtctagagtattaaagttttcatccggtttcgttcgcattcctaaaggttgccgtgatatctgaatttcgtccacccaaacagatctcggatcatgactccacacctttaatctaagtttcaaaccctcctttttgcttcaaccgatcgacctgtggacgtacgaaaaacagaaggccctttacttcatgtgcactactcgagtgattccttttttcggaacgaattgaatgaacataattcgagtcaaaaagcaaattaaccaaaccaaaaagcgaacgcacgcagtgtcgtcctatcgaaatgcacgggtgacaacactggagtatagtagtggcagtactcttttccatgatcttta

SEQ ID NO: 51054 - DNA, 16601 bp, Oryza sativa
  unsure (1)..(16601): unsure at all n locations
ttttgaataagacgaacggtcaaacatttgctaaaaagtcaatggcgtcaaatatttcgaaacggatggagtatttttttttgcctatcatttacatccaattgaatatatgtaagcttttaggacccctttaaaatacaggattgagaaaacacaggaatagaacaaaacataggaatagaatgtcatgattattggattcctatgggattttcaaacacgggaaagtcttcaaaccatcgtttgattaacatacaggaaaaatactggaattttagacacacgtagagaaaatcatgaggtgagacctcatgttattttcctctaaaattgttctagcaaggttaattccatagtaattttaaagggattagtaggaaataatccttagattcaaaagactctataggataaaattctatagaattcctatagtttttcctttgtttcaaaggggctcttaaaattgagaacttgacctttcaaacaacccaatgtaaaatttactttcataaaaatttaaacttaaaatttcaaaatgctactcaggtgacggcaactattacgctacctactctttcgctgcaactgcacgcctgcctcgagacctccttctctccctctcctccggcgcggtggccggccgggcggcgctttgacccacactgcccggccacggcgaggcgtagatgctacgtaggagcaggagtagggtaggagctagctgggccggccatggcgctccttttgcagcagctgggagcagtgcatcgagacccggagacccacgagagctacggtatctgtgtctgtgtgtgtgttttttaacgtacgtgcgcgtagcacaaggctgccgagtaatacccagatgagaagaccatgatgccatctctctctctcacacagagtagggtgcgttcgtttccggtgctttggaactcattccctccataccgaaaacaagcggttcattatcacgtaattaattaagttttagtgtttttttaaaaaatagatcaatatgattttttaatcaactttcgtatagattgttttttttaaaaaaaacacatcgtttaacaatttaaaaagcgtgcgcgtaaaaaacgagaggggagagttgggaacaccctcttgcgaacagagccaagagcaggtaaactagcagcctataaatcagctttaaaagtatatcgagatgataaaaaaagagagagaagcatgtggctacagatttatagccaactgtagtacggactttaagacacaatgtgtgtatgacagatgtgaccagatattaatagtgtagtttttatttataggtaactattatatgaattgactattaaattgactatagataatttagagttagtagttggctatactattaaacttgctccgagtttaacactccctccgtcccattttaagtatagttgtgggtttctatgtaatgttgatcgtccaccttatttaaatatatttatgattaatatttttattatgacatatgataaaacataaatagtattttatgtgtgactttaaaaaaaacaaatcataaatatttaaataagatggacggtcaaacgttagacatgaaaacccacgactgtacttaaaataagatgaaaggagtatatagtagcgtagctataagccaactgtaaaattatgtggagaagaaggaatttaaaaattgaaaaagggttagagtaaggataatagcaagcataagtcaaaaattgaaaagggttagagtaaggataatagtgagtataagtcaactatacttatgtggaggagagagttaaaaaaataaatgagagttcacttaacacgtgctcctggataaatacactaaatacataagtgagaaaaggagagaggagaagaaaaattgaaggctctattatttaacttgtacttggctttgatggaagagctgactattcacatacttcaacatgaatatattaaatgtataggcgagagatatagagaggagaagaaaaatagagataactttataacttatctactatacatgttaactctattattatttccgttctaaaatataacaactagtattatctatgaacgtggacacacatttatctaatatgagctatttaaagatggagtgaggccgtgtttagttgttttggcaaaaaaaaattgacatatacggacacacatttgaagtattaaacatagactaataacaaaacaaattacagattccgcttgtgaactgcaagacgaatctattaagtctaattaatccgtcattagcaaatgtttactatatcaccacattggcaaatcatggtgtaattaggcttaaaagattcgtctcgcaatttacatgcaaactgtgtaattgatttttttatcacatttaatgctttatacatatatccagacatttgatgtgatgtttttagttaaatttttttttatctaaaccaggcctgagaatgaaacaggaggttcgatttttacccgggtcaagtggcgaagaattccaggtagtacaggtagtactgctttttactgcggtgaaaggagcaaagcttctgcgtctgcttggcgttggtctacgtctaacgtgagcgtgcgtgcgcctgttggtcgtcgtccgaatggcctggtctccaacctcctttttcgttcaacgcctttgttggtcccccggcccctctcttcctcttcttcatcgatcaccaccttttcttttttctttcttcccctaaagattatatttgcgcgcagctgatgcagtgcactgcagcagggagagcagctgtggcactggcagtggctggctgctgctctttggtttgggtttgcctgcctagacgaacctctgcaccgtcgtggtccacctctgtcttgttaagtactcccttgattctcatacggctcgtttggttggagggagtttttaggagagattgggaatttaaagggatgatgttattaagggcctctttgaatcaaagaatttatgtaggattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttcccgagtactcttgtctccctccagtctaccaagatacatggaattcattgcctacaggagatgaggcagcccaggctgtagaactaatggagcgcatgataaagctgaaagagcaaggtttgcagggagaacagatcacttggcacttcataaaaagccgattagctccaatcaaagagaggtcccgcacagcttttgagtttgacggcaaacatgatccaaatcgtgaagatccagactctcttaactttaagattatgaaggaaaggatgtacaagatcttctcgaatgctatcgtcgtcagctattcgcacttgctgctagtcatgccattcaatgctttcaatcctcctccaccgatatgtaatcaaacatttcaacttttcacagaatatagtcttgtctttttgttgaatcaattaacaatgaatgatattacgaccaggaatttgctttgatgaaatcggaccccccagtcgtccaatgccgatcaccccaccgccaaaccggtcaagggagcggggtcccaagacccgttctgaagcccggccaaatacttccaatccagccagatttacgcaaaaggaagttggtgtcaagtgatgacgaaagcgatactgctagaaagcctggagaccgagaggcaaccagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattcccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatattcgtgaaaccttccttgtcatatcgattaaccgaagagcatttcagtgcaagccgccaggatttccgacctagagaggcaggtcgaagctctggagaaggacaaggccgaactagcaaagcagagggacttggccttaaaagatgttgaaggtaatgataactagttccccatgctcttatagccacctgttgatacaaatttattcgtgcaaatcgcaaaatcaagtcccaggcacagtttgatgtcttaatcaataagatcaataggcttgaaggggccagggataaagtcgctaatgccgctaccctactcatccaagccatgttcttcaataacgccggttcgagtacacttgacgcttccgagatcttcgacaagctgagagtcgctccggatacttacttcaagaatattagggaggttggatgtatgggagcaagcatggcgttagctatgaccaaatctttataccccaaaatcgatattgacgccgttgatgggtttgcagacgggacaagcgaagaaacagccctcaacctcatcaatgatgcgcaaaaagccgctgacaagattgctgctgacatagttgagagattccaggatggcgaccttcggccgactgggtctgataattccgacgatgaaaaaactgacactgattgatgttatattgtaattgtgattctgatgatgatgatgacgatgatggaggtacaatttgtacaatactgataaatttatgctgtgcatgatatttcaaacttagctcctgatttcttaaaagtttttgtcaaaccttgttgagcctaaaactcgcaaaagttgttaaaaaactttcagtcctcattgactaagccaaaaaatcaaacagagcaatgataaatcaagtaagcgaattgaattgataaagatcacactccattatcatagtagcccccgactgacaactcaagaaaaggcttgatgttagcagtcgaagaggaaaatacagaagtgatgcctaagcataaaaacaacgaaggtgttcaatattccaagaattgttgacaagagtaccatcttcacgcttgagtcggtaagaacctggccgagtgactttagcgattatgaatggtccttcccataagggagataacttgtgccgatcctatgtagtttgaattctcctcagaaccaggtcgccaactaaaaaggctcgcgatcgaacattccgattatgataacggcgtaacccttgtaaataccgagctgactggattagggctgcttcacgggcttcttccagtcggttgatgtcatccactcgatcctcttcatggcgctcttcccggaagttacgaaatcggagggattcaaactctacctcactcggcagcattgcttctgcgccataaaccaagaagaacggcgactggccagtagcccgactgggggtggtgcgtaaagaccaaagtacagacggcagctgttctacccacttgcagcatagggacgcagtcggtcgaaaactcgtgctttgatcccttgaagtaccatgccattggcgcgttcgacttgcccgttactcatggggtgtgccacagaggcgtaacaaattttaatgccaaagtcttcacaaaaatctttaaatattccgcccgtaaattgagtgccgttatccgtaatgatacgattcggtactccaaaccgatgtacaatattgatgaagaaatctctagctttgtctgcggtgatggtgacgaccggtttggttttaatccacttggaaaacttttccacagctacaaagagatgagtataacccccgactgcctttttgaatggaccgaccatatcaagcccccaaaccacgaacggccaagacaacgggatggtttgtaactcctgagctggtaagtgagtttgtcgggcaaagaattgacaaccttcacatgttcgcacaattttgtcggcgtcggaaacagctgtgggccagaaaaaaccctgccgataagccttgccaacaatggttcgtgcagcagcgtgattaccgcagatgcctgaatgaatgtcttttagcaattgtcttccctcttccaaagatacacagcgttgcaggattcctgatggacttttcttgtacaactcggtctcatgaatgacatagagtctgctgcgcctggagatctgcttggcttcatttttgtcttgagggagttcttgtttggttagaaattttatgagaggttctctccagtcggcttcaatcatgcttacgccttgagtatccatggcttcaattgtttcttttctgggcacggttggttctaaagatgttcgacgaacacatctgaaggagccgcttcctgttttgaaccaaaattggccagcctgtctgctgcctcattattatgtcggaggacatgggtgagcttgagtccgtcgaatttatcttccaacttgcgtacctcttgtcgataagcggtcatattgtcatctagacaggaccattctttcatgacttgattaacgaccaactgagaatctcctcggacgattagtcggcgaatgcctaaagagacggcaatccttaatccatggagcaacgcctcgtattccaccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgttttcttgacactcggtccactcggcgaggaagtcagctaaagcttatgacttgatcgaagttcgtggcttgaaagatatgtccaaagatgtcaattctaaggcccacttcgctatccgtccgtttgctttgtggttatgaagtatatccccgagtggaaacaatgtgaccaccggaccgagtgaccttgaaaatagtgngnnaggggctaacggtaattaagacgccatataataaattttgaacctgaggatatctcgtcttggagtcggccaaaacctcgctaacgaagtatattggtcattggactttttgaacatggccttcctcttcacgtttgacaaccaggaccgtgctcacaaccttagaggtcgccgacacgtataacagcagcggctcttgtggatgtggcgaggccaaaactggtgtagtgagaaattttttgaagtcttcaaaggctttttgtgcttcgggtccccactggaaattgtcagttttcttcagcaacttgaagaagggcatcccccgttcaccgagtcgcgaaacgaaccggctgagcgccgccatgcaatcagtcagcttttggacatctttttgtgagcttggcggtttcatgttgagcatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgcgatcaggtcatacttctgcttggtcttgacgactacatcatcaacataagcttcaacaatgcgaccgatctgagttgaaaaacatctttgaatcatgcgttgataggttgctcatgcgttcttcaatccaaaggacatggtgatgtagcagtaggacccaaagggcgttataaacgaggtcttcaagtagtcggattctttcagtcggatctgatgatatcccgaatagcagtccaagaaactgagtagctcgtagccggccattgagtcaaccacctggtcaatgcgaggtaacccgaaaggatctttagggcaagacttgttgaggtcggtgtaatcgacacacatgcgccattgcccagtcttcttccgaaccagaactgggttagccagccagtcgggatggaggacttctttaatgaagcctgctgctaacagtttggctaattcctctttgatcgcatccttcctatcttgtgcaaagcggcggagtcgttgtttgatgggtttggcgtcttccttgacatgtaaagagtgctcaatcacctctctgggaataccaggcatatcggatggtttccacgcaaaaatatctttattattctgaagaaaggtgatgagagcgctttcctatttacaatctaactcagcgcctattacagcagttttggtaggatcggagggatctagtggaatcttcttagttttgtcgtcgccttcttcggtctttgacagcttggtcgtaggcacctctccttcgcttgccgtagtggcagccaatcggatctcttcgcgagcgagagtgatctcgtgggtttgggctatttcgcaactttctttgtcacatgtgacggcttgcttgatgtcgctccgtagtgatatgactcctcgaggaccaggcatcttcatcatcatgtaggtgtaatgtgggacggccatgaatttggctagagccggtcgtccaagtatagcatggtacgttgtctcgaaatcggcaacttcaaaacaaacgttttctgtgcgaaagttttcccgagtgccgaaggtaaccggaagagtgatctggccgagtggtgtagcggataatcctaggatgacaccatggaagggtgcattactcggctttaattccgttcgaggaatctgcatatcgtccagagtcttggcgaaaaggatgttgagtgcactgctaccatcgatgagggttctttggagcttgacgttacgaaccactgggtatagtaccagggggtaccgccccgggtggaccactcggtcgggatgatccgagcggtcgaacttaattgctatctctgaccaccgaaggtattggggcgtgttaggctgaaccgcattgatctcccgttctgttagcttctgctttctcttagattcataagccaggggtccgccaaagatgtgaattagttctttgcgatgatcttgaaaaccaagtgggacatcgtcttcaccatctttcttctttgatgtgccttggtctccgtctgagggcttacgtgcgttcttgacgtattgctctacaaactgtttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtaannnangtttgtgtccgaacttgccgactaggtcctcgtggcgaatgcctttagtaaaggcggcaatgatgacgtcatcggntgatgtcggagatcttgttgcgttgctcagagaagcgtcgaatgtaatctcgaagagattctccagacttctgaatgatgttgtagagatcgaagtgtgtaccagcccgttcaaaagtgcctgagaagttggcgattaagtggtcgtgtagctctgcccatgatccgatcgtgccgcggggtagcccgtgaagccatgaccgggcagtatccgctagggccacaggtagataattcgccatggcttgctgtctcctcctgctacgcggattgcgagaccatagacggtgagccaagactcagggttggtggtgccgtcatatttctcgattccggtcgacttaaagccagctggccaatccactcgacgcagatcgcttgtgaaggcagcaactccgtccacatcgtcgtcgtagcgatccggtgaatgatggcctcttgctgcgcggtgctggttgatggtgtcacgaagatcgatggggcgccttcgatgtggggagtgtggtcgttcaactcgacgctccctgtatcgttcgggaggcgaacgaacagaccgttcatcatgtcccctgctcctgcgactagatctggcgccgtcaatgctgaggcttggctggtgatagtcctgagatcgaaggtgagggactcggctaccagtcggggtgcgggcgcttgcggagttggctggaaacgaagcaacgatcatggtcttcgtttgattcaagatgtttacaacatgatcagcttgattgagtacgtcttccttgaggagggtgtcgaggagagtgattgctgcaaccgcgttctgctgggggtgcgaaaaaccgctgttccatcgacgtcttgttgcccaatgagctctctcgctcgtcgcccaaattccaaggcgcgctgccgtcgatcttcaccctcctttgcaatccgttcgcgatcttgttgctcacgctgtagtcgttctcgctcctgttgctgtcgctcttcctccagttggcgacgttcagtttcttgccatgcgcgctcttggtccacttctcgggctcggcgttgttcctccgtttcgttgtcagccacgaatacgccgaagaagagaggcgtgtagttatcctcatagctgtcgtcgaagttgtcgaagtcgtcgtggtcgtagtggtagccgaagtcgtcgtagtcgaggatctcggttggtcgagaactgacaccgggggagctaaggtagccatccaactcttccgtcgagactgtcccaaggggttggagtataacgccaacctccctggatctagatcggatcggggccgaagccggagctcgcctagatcttcgagcaggagatgtcttggctgtgaagacagcggccaaatcatcaggaagttttatcaggattgagggataggacccgtcatcttgatctggtcgcggaggagtagattagatctcgtccgagtggtttgaagccgactcgggagagatgatcttggagtaggcctcggccgagttcggaataccgaacggcgcggggacctgatctctccccgactagttcgaatccgagttaggagagagatcttgccgaagtcgttggtgatgaagttgaggctgccgaaccggaacgcctgtccgggagggaaggcgaagtcgtcgatgccagaaacggaacccatcgcacttagccggtaaaaacttgacgctacccctacctggcgcgccaactgtcgaaacaagatttcggcaatactaaaagggggtggctatcaagctaggaaagtggatgggtttggagacgaagaattttatacaggttcaggccttcttattcaagaagtaataccctactcctgtccggggatgattccgccgagtgtattattgattgtataatctaggtcaaaaaaccgtgccccgataagcatccggacccctccttatataggggaaggggtccgctttacaaaatacagtccatatcctaaaagaacatggaattacagataaaatataatcgtaaccgactaggatctcgggtatttccttgacatacaagtttagaatctaacccgagtcctcatgaagatattctgtctttattcggtatcctgtacccagctagaatatgaccgccatgtagatatagggtatccataatctccacatgtttatttaggagacatgagaattttggtgggatggggatggggatgtggaattgaggaaggaactccctccttttcaatacctgggtaggggcaggtgattgggagggaattcctcctttactttgtctatgcaaatctcaactatccatttttattaatgacataatctccaactaaactccctatcagtttccatcactccaaccaaacaagatactgggattaaaaatcaaattcccatcttaatctcatcataaattcccttgtgtaaactctcaatccccttccctcgagttaccaaacaagccgataagacttagaattattttatattttgatttttcaaagtaaatgggtcataccttgtagttttcatgtatatatctgaaatttaaatgatttaccggaacccaaatacacattcaatactcatcgattgcattatatacacttacaccttcatcggttggcttatgttgttgcgtttcagcataagcagactgatgtttatcggtataagcgtttccatcgtttggcttataaagagtaatggctgattagtggatcttctgtggcatggtgatcgttgagaggtagggttcgagagaggggagtggggaatcgaggttggtctcctagcgatgtggccgtagaaaggtgtcgggaaggattgtcccactaccaatggctgatgcataatcagcccaataagctaaccgatggacttttgctgaaaatctgcctctgcaacattgaaccgatgagagtgttctttgatctttgttacattacatgtagttttggtcatggtgataaaagtaatatatctaactcttttggatggatagaatatattactaaattttcatgcgtgtgtgctataattgggatcaaaatgcttataaacgaccagaaacaatattgtttctatgaaaaattagaggatataaattctatgtatatagctaggattcaaatctggcgataatggtaccacttttacagaaaccaatctgaaaattccgtcaccattttcatctcctaggttgctagccagctgcttatggttgatggaccagatgtatagttactgagctctaaattggctatagtattgtattatcctttttaatggtaaatagtctgaaggctgagattttcttttggctgtggtttataggccataatatgtgaccaaagcaatgaaaaataattctacaataggatttttatgcttatactttcagcggtttaaaagtcagggatgaaaagtgaaaaacgatgggaaaaacatcaagagtaatataaaatcgactttgaaaattcaaattagactatgattctcatgtatccatatgcacatttgtggtacccgaattcgaatttcgctgctctaataatggaagattggttcaggatttgatgggtttataagtcatttctattaaaaaaaaacaaggtcgcaagatacggtcttaatatgttggaccttagcaatttaaattcgtactattcgtgaaggtttctttaaataatgtccaaatttggtagaaatttattcaaaaattaatcttgtgaaattttcccttaaatacccaatcgagtctccctctccaaacgacttaaacttgcttcacacactttttcccaattttatatatcatcttaaccttgctgccatattctttactggttaacggataaatggatgaataggcatgttctccgaactaattaa

SEQ ID NO: 51055 - DNA, 2241 bp, Oryza sativa
  unsure (1)..(2241): unsure at all n locations
tctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctggtatagagtgcctgtataatattagtctaaaaagatactcatgttaacatatatcagtcaatttatagtaggttgctgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgttcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgatgacgcatcatccgatgaggaaggtgatgtaatggccactgattgggcaaatgaggacttctctggacttgttatatcagagggtgatcatgtaccctgngagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggcttgaaccaaaatcaactattaggcacatcgagaacaaattcaagtacaccataagctatgcaaaggcctggagagccaaacaaaagattattgagatgaggtatggcacatttgaaacttcttatgataatttgctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggatgggatgagaatccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatcttggtatggcataatgacaaccaatttggcagaggtgtacaactgggtaatgcgaggagttcggatacttccattggttgctattgttgaattcatccttcacggcacgcaagcgtactttagtgatcgatacaagaaaattggtccgtccatggccgataacaacatagtgtttggcaacgtagtgacaaagtacatggaagataaaatcaaaaaggcacggagacatagagttgttgctcaaagcacacaagtgcatcggtat

SEQ ID NO: 51056 - DNA, 841 bp, Oryza sativa
atggaatgagagcgccggtgaatgtgtgcaccgcctttgctcacagcatgtagctgagaatctatggaaattttgtcgcaatgaaataatgctcaagacatttaagtggacagtgaagaaaaagaaacctagaaaatttgatgaaggaatgtgatcaattgcaaatatttgtcctgaggcaataacatatattaaaaatgttggaaagtacttgcatgaagataaagatgagcaagaaaagctcgagaaggtatttcaatgcaaggatggaggatatcgttggggaatcatgacaagcaatggatctgagtcattgaacaatgtgtttaagttttctcggaggttaccggtggcagccattgtggaggaaacattttcaaagtgcttagaatggtttgttgagagaaggcgaaatgctgttaatttacttaacaatggcaagcaatggtctcaaagggttgataagctattagtgaagcgaggaaataaggctggacatatgaatgtaatctcgtatggagatgaagttggaatatatgaggtaaaggtcgacaatgagttagtcccaatgcaacaaggaaaccatgaggtttacacatggagggacttcaagtataaggtagttttgcaacccaacaacacaccatcttgtgactgtcaaaagccaaatttgacaggtgttccatgtgctcatgtcttggcagtttgcaaacatagaaatcttaatgaaaatcagttgatcaatccattctactcttctcaagcacttgctagtacctgggctatacaatttcttccttatggaaatcaaattgaatggccaccatttactggtccaata

SEQ ID NO: 51057 - DNA, 6120 bp, Oryza sativa
cacacacatatcgtggcaataaactgaagtaaatagcatgcgctcattcaaatgggatgtaagttggcaacataaaaatccattaatatagtaagtcagtacaaagtaaagtaacacgccattcaaccactgacagcatgaccatattttacatagtatagcacccatataagacagtggtcgaaaagaacatatatgtcaacaggaatatatggtcttcctaacttggagtggctgatttctagttaacatatatttagaacatatagctccaaaagttctacaaaattatatccaacagaatatatggtcttcctaacttggagtgttctttttgaacataggagtcctctcagtactagtccaatcaaccacttggatagaactttctgaatgacttgacgttctttcaccaggatgcaatggagctgatgcttctcttgaagccacctgtcatgtcacccaatagtatatcatatattaaatacattacaaagttaatttgcatacacacaagtgttagaattttaccagatcttcattttccaaacattgagtcacttggcttgcatcttgtgttgtgggaactctattagtagtttccacacctagatcaatatatctactaaaacattttcctgagatcatccactcatcaaatatatcaacggaactttcatttggaggacttggcgtgcaagcagtagtgccatcgtcatcagatggaatttcttcaaccttaattggtagtccagcctcagataacatgttttgcaatttgtattccaagttaagatccctaatattcccctgacatgtgatcaatatagatttacctatcttcttgcatccattagttatacaacatttgattccccatgctgcatttttaatctcacgcaatccctgcaattatgagttaaaatcagatctaggttgtcactgcaatataaagagtaattggaagaaatctataacttacaatgcgagctaggggtggaccactaggcatgtacccagtccactccatgttatctcgagggtatgggatagagttttcaagtcctcccaagcattgagaatcaaaaaacatagtgaacataccatttgcttggaaccaacatctatactcctttaagctagctacgtcgaaaggacaatcctcttgaacgattgttgcttcaatcccatcatattgttgcacatatttggcatggaatttattccaatcgcacacttttcctcctacatgcttcactttgcgtagcttccgaagctcaacctcaccatgtggaggcgatggtggaattaattgttttcttccaaactgtctcattaccctttctggataatggaactctacaacccaaaaatggatgagaggtagtctagcaaaccaccaagtacggtcattctgaatttggataggcatctgctctatgagaccttcatatggttgccattgtacagtaccttctcgaatcaagtcaatttggtttcggtagtattgagtgcctgtataatattagtataaaaagataagcatgttgacatatatgttgtttgttataagaatatacaatgagacataattcaaaagatatgtaaaacattaccacaattatgtggggtggggaattcatgataactacaccatttggccccaaatataggatagccatctgattcttcttcttcttgctcctccacttcatccgtcttttgaattatattttttggacgacctaatggcaaccgtgaccatgaccacaattgtaacaatactagagggccaaaaatttttgatcttgccttctcagcaccattgttcaactgcctgtacaacatagcaagtacagctcctccccaattgtattcagtgcgggtcgctaaattatccataaattggaggtacattgcaggcacactatctccagatgaatcagtaaaaataatggagccaagaatttctaagacaagtgctcgactatgccaatcgatctcccgttgtgttgggttactgggcatgacacgaaagtgatcacgcaatttgctcagagttatggagtatcgtgagtaactcagtgcaaatgtatcatcttcctttttcctctttttcttctttatttcttgatcttctggtggaatcccaagatacctctcaatcatatcctccaatttccatcagattggcccacaattagttttccactgattggcaaaccccaaaggcaactgatatcttgcaaagtaattgtcatctcccctatcggtagatgaaagctatttgtctcaggccgccaacgttctaccaaagcagatatcaaatatttgtcaattttgatactcctcatctttgcaatttgatagaaactaatattttgttgagccgatcggcacaatgggtggtaagggattccaacgcgatggtgccgtatattcattgaactactaggctacatcaaagataaaaacaattactcatgggaacctagatgaatatatttacaaatcgacaagaaaccaaactaagtagacaactcacattttctgaaattttagatactttgtgctgcccatgaggcatccatagtaaatcactgaaccgatcactatcagccattttttagctgcacaaaatgttaacaatcaataagctaaattagtatttcaattctactgtgtgaataaatgtaattccagttccgaagttggaactccaatgacaactctgatgcagttgacatatattttataaagatctctattatacattagacttatcaggatgaacctatgttatatttttgaagccggttcttttttttttagaagttgtgaagccggttcttgattctccatctcctgtaattaccatccataaattgtgtcccaaaatgtttattaaataggctacaacaaaataagttagttgaatcaccttgactgtaggagttctgggcttggacgtcaatggtggctgcaagcttccaagatgagaacagatgacagcacttggcaggagtcgaggcagacaacagctgcagcctccagggaagacagcaagctacggatggaagcggctgacggcagccacctctcagaacttcaaaagtcgattcaggcggtggcgtggtcttccggtggtggtggacggcgacggcggactcccggcatcgaggtggacgacggcggcggcggcggcggcagccccctgccttagcgctgccgcgccatttgcctcgtgggtagtccctacgctcagttagaaggaggaacagactccagaggttgaggcggacgccggcggcggcggcagactcccggcgtcgatttggacggcggcagaggcaccctgccctagcgttgggggatttttcttttttcttttttctaatcgcgatgattagcgccaggttatgaccgcaccaacctggacgtcgatccaattggcgtccacatctgtacgttaatggtaatagcgtccacatctggacgctgtttctattagtgtccatcttattttggtaaatgttatcctctaattactaataatttaatttaaataatattatttattattaattaaaaaattggtcctgagttagtagtagttactatgtcaacatgagccaggggattttaattcatgcgccgctgcgtgaaacgcgtgatcacacacggtttgtcctttttcccttcctcattctcttctactctcgagccatgacttgagagtcccatggccgcctacctgatgacccaatattcatcttccttcacacgatgagacccatatataatggttacctgaacttctatcattcccttgctgcacagtccccttccttgtcgccatcctctgtccctcgcaacttaacttgttggtgcctcagttaccccaccacaatcctaccaaccgccatccaggcctatggtcagtggagccccggttagggatgaaaacggctttgtaacggatggaaggtatctaccatatttatttttatttctattttggatttcgaaacataatcaaatattatcgaatatagtcatagagtgaatacaaactgaaacaaatatgatcatgaatatttatcgcaacatagaaacccttatacctaaagaatataaaatcgtgttaaatataatatcctaaatcattcttttatcctacagaatatactaatcgtgttaaatatattgtgccattgtaaattagctctttagtttttctttttaaaaaaacaatgaattttaaatatgaagttatatccatattaaaatctcaactaagaattttatttatttatttctaaaattaatattaacaatctaattgaaatgaacccttttttttaaaaaaataagctattactttgaaaaacaatttatttcgtatgttatatattttttaatattttaacattaataatagtactgagcatagtagtttggaactagcaaataagacatactacaaatatcaataatataaattttataatacatcaatagttcatttaattaaaggtatacaacaaatatcacaaattggatatataatttaaaaatattttcaaatgtgaacgtttatagaccattggttcgatatttgatatttatattatcgatctagtttaacttcctatatttatgaaataatatatttatctttatatataaattatattataaatatcatcattttttatggtatatgttcttttactttatcgtatatggtcgaaaattctattttcgattttttttccgttggctttattttttttattttttacacgtggctttatctttttttttatcttatgtatgtggacatgtttttttttccaccgaactgtacttaatctttattgttttttttccaaatcatacatactgtatgtatatatgtttttttttctcccttcagcggtatatattctcttatatatgaggaaggtattacataatctaatgatctatgggtccaccgatagtaatataagtgaaaattgataatatgtatagatctaatctaataatgtcaaataataggtccaccaatttaagtgaaaatcaatagtgggattagacaatgttacgtggcggtttaggatgtatgtagaaacatcacatgatgtcttagaaaagtttgtaaaaagtttaatgaatttttaagtatataataatagattgttggtaaaatttgttaattaccatgcacagtaagcttaagctccttacttaaatataaatcaaaactaacatttggttgagacaatagacggagaaagagcttttttttttttggcacgataggggttgtatttttctcccacgaaaaagtacaatctagtgttgtttttccttaaaaaaaagacggagaaagctcacacagaaatcactcgggttcaaactgtggccgtcttcagtaactcgataacccgaaggaatacgattataaggatccgtacgtaccgacatctgaaataccggaaaattttaagtgaaatttgttaagattatattagccatctggctacagcaccaatcatacactcgtgaacagatctgctcgctctttgtttcatgagaacttttttgcaacgctagcaataaagctacaataatgcttgatgaacacattattacaagtgccataattaagttgcatgagaactgaaaaccaaacgacgacatcagtagcatatggttcaagatccacctaataaaaggtttacctaataagattcacaattgctattacccaacattacgattacagtgtggctaatgggcgatcgatcaagcgatcgatccccacgccccctgtacacacctctccttccttcctcctccccttcttctcttcctactacactataaattaaaaaaaaataaaaaaataaagttgaaaaaatttatgtatagaaacactatatatatataaaaatatttgaattcaaattcaaatttgaatcgggtatgtaaacttttgacttataaactttgggtctataaactttaggtgtataaactttagatgcatagaaatactatatatagaaactatttgaatttaaattcaaatttgaatcagatataattcaa

SEQ ID NO: 51058 - DNA, 6814 bp, Oryza sativa
atttgaggggttattttaggatgaacaagccaagccaatagagaagacacacgcttgtttaaccatttagtgtagatcatttaaataaattgcatctatacacgttgcagattgggaaaacggaggtagggtttacctacagaggggactacgagttatgttctcctccttgcggtggtgctgttcttgccatcttgcactcgtgctcgccttcaagaggagccgcctccggcgggcgcttcacgatacccggttccttttcatcacccaacacttgaattaatacacattgaatgaatgaacgaacaaacgaatgaatttggagtaaattttcttaaaccctaactattatgatccaaattgcataaaaccacatgtattttaacacgtgacaccataaccccatgtattatgatcctaaagtttcacaaaatcatattgttaaccattttaacatactgctatatcaaaatagaaaaaacggatgtaatatttatatcttctatctattatatactaaaagtccattaaacgttctataaacactcctaagccgccatgtggcatcctataaacgctctcgagacgccacatgtcactctaataaaatagaaaaatctaaccatcgattttcatttaaattggtggactcattaattttgaccgttagatttatttttacattaaaataaaatccccctccgacgcctccgcaatgtacgtactttccatcaatccatcagcaacgtacgtacgtacgatccctccgtttccatttttttttcgtttttttatttccataataattaaattagaaaaatgcatgcctaaaaaatccatcaatctactagatctattcttcctctagcccatcctaataagtctattaaacatcatataaatattaccgaacatctatttgacacctaaattagagaaaatctaaaaagatataaaacattcgttcatcgatttacattattttaggttattatatatatctttttcttacgtaaaacatcccaaactcccctcgcgttcatatgtggcgttaaaacccattaaccatccttataaatgtttgtaaaccactctgtaacacttcgtaaatagagtaaataataaaaatttaagaataaaacatctaatcattggtttcgacttaaatcgatgggcatagaatttaggttgttatgagatttttatttaaaaaaagaaacaaacctcctttcctctctcccccacccaacaatgttaaagccttatacattaaacatccaacacattattttagtcattatatcaatcttttatttttttgaaaaaaatatatcaataatttatttaagaaaaacatctcgcccaccttatccctatatggtgtgcatcgttcatccttttctcttatttttattcttataataattgaaattaaaattatcttcatgggaaaaaaccacaaatggacctccacataacaggtctagctagctctcccatgatcccttttcttctctttctcatcttactaacatttatgggaacaatataaataaaataatataatcttttaaatcatatattcaacttatgatttgtttgaactattgtattttcttagtgaaatcaactttaatatccatattgagtatatttaaatgttaacataaaaattacattccggacccacatccatcttgaggcatccacttagtaaaacaaaaatgaaaattcatcattataaatcaaaatatcacatcttaatttttaataaagcctgtagacctattacttgtatcccattagacacataacaactttctatcaacttaattaatttctctcaacatgtatatggggtaatttgcctatacaatttgattttggtgcttttatcaataaatgatatttttaggagataaaattatatataatctatgaagtcactaataaattagagaaaaaaatctttaaatgataacaatttttatgtcataatgtgtactccatctagcgttaattttttatagacaacattttaaaagtaaaaaaacatgctcagttgaacatccaactgatagtaccaaacatgtggattgcaccaagaaatctttttttttttgaggaaatgcaccaagaaatcttagcagtgaaacaactctgaggtggcattaccaatatagtgagttaattccatatggaattaaagaccatgttcatttatttctttttggtaaaacttgctatgctacatcgtaaattcataatatttactgtagaataatatagaaatgtgcatttattatatgacctctattttcatattcttactcaattccagagagataattagaatagatgattttaccccatgtcaggttgtaggcttaacccacatatatttataacccaaattgcagagatcaaatcatttcaaagatgcttggtagaatggaattctccaatttattaaaaatggacatgataagaattcaaaatttatgtaaatgttttaaaaaattgttgggtttaaaacccattctaaatggaaatattcaaatattttagcaggactaatagaacgaaaatatctaaaatttcgaatagaatctgataaaaatttggactttttgagcaaatgtttggggaaagatatccccatgggtagttgaaatacccaaaaatttttcataggaactacatctattgtctcgacataatattatctcataaagtgaaaactgtacgattttaagtaattttagtttagaatttatgtgctgcaagggtaattagaagaaaatcataacccacgttgaaagcacattaaataagttaaataataatttatatatagtaaagtaatattttaatacaaagtcacatacatagatattcgtaataaaatttcacacatattaaattagttgcacgcgcatgtgcgcgggctacctttctagttaggaataaaatgctcataaatttaagatgtgattgtagaacttaaaaggtagtaaatcaagtcaaaacaattagtgatgtggctttgtgaaatgttaggaccataatacctgaggttatgtgccatatgtcaaagttcacgtggttttctgaaactttgaccataataattgagattttctgaaatttactcatgaatttgatagcatcttatatacgccgattaactgataaatgatagataaatgggagacgctaaactccaatcgtctgatttcttctaaactgtcactcagacagacagttgtgataaaatcacatctccccccttttaacatacattcttcttgcctttctccccctcctctgaatcctcctcatctgatcctcctctgaatcctcatcctcgtagtcagagtactgggccaaaaatttcttgtaatattcaaggatttgcgactcctcgaatggtataggtgcaccactatgtttctgaagaacagcaagaagaaaatccccactagttattactactagttaattttaattaggagggcaactgaatctgagatcgatcgatcgatctcagcttgcattggcacgtaagtacgatctcgttgaaacgaaggaatgaacgaattaacgcaccttagattatcatctcgatcttctcgtcgacggacagatcggtacgatcggttgatgtaggagaggtcaggaggaggcggccgaaccagcggcggcggaatcaaaaacttcatggttgcccttgccgccggcggaagtgtacggcggcggcggcggactccggcgatggcggcggcgtgagggctacgttatttatcgattgcaaagccattttataggtggattagagagtaatgggctaagccaattcatgactagcccagaaatttattttgtcgatttatcatatatttattatttaccttttattaaaaaaatgtttttcatagagatgcacatgcttctgtattgatatcttctaagattaacatacatgcatctgatccagttttaatatcctgtgtggaattgttgattattccacgaaatatattaatttctcaaaagcagtacattttcatctgtgtgtagccatccccttaatttgtttgtgcaaaatgcgaggatgcttgtttctgcaatagggtaggaagattgtcaagagtggtgtagtaggggaagaataattaatcttctattgtgatcactgtgtctagagcaattggatgatttatattgtttgaatatatagtacctttcacaattgtttggagattatgtttcttcttttattaatttttcttacgtcgagaaaaataaaacaatggcctatgatttgaatgatgaaactgcatccccagagaaaagcaacatgttgccaccatgtgctttttggtggtaaacatgaatctatctaggactcagattgagaaattccatcaattctattggtcatacttttccttaaaaacttacctcttttttctgaaacgtttaaaactttttcttcggccatactttatgtggttctctctgtcctagtgtgggctcttgttgtgtgcaaacttttgtgggccggtttgagcctccaaatttcttttttttaaaaaaaaaatcaatttcgggatgcgattagatgatgtgtatctcactatagtattcattcataggattactgaattcttccaccaacagtaaaaaccagaattcatattttcagagagcatgctaaaagagttgcacagaaatcacagcatgtgtttgcttaagctgatcccacatagtatgtgaaatcagggcaatatcctaggaatcgtattacatatttttgtaggccatctaagataaacaaaacatgatgtatgatgtatgtagcacaattgtccatgatcatgatcttgatctctttttttttcccattcatgtcttaattctgaatattttgttcatgtgctccagagcattgtgcataaatccccacttccggtgttcaggggaactgtgattagcatgaagattttggttgatttcagtgttggattgggttttatctacgggccagtagatatctgttcataatatgctattacaatggttaaatgtgtttcaaccgctccaatttcctaaaaaaaaaaagaggaaagaacttgtgttttcggcagatgttgttttactggatgcctctcacattcacaactcacgcaaaggatcaaatatgtgcagggactgtggaaaagaagaaaaatgggacatcgaaaagcaaaaactagcatatgatgattacggactagcaggatagaacctcttgtgttgtcacaaccagttcaagatcctcactttcatgctttggtacgttcccaaacgcctcctgttcctaaccttgcaatgctcgtcggctcgtcgatcgctccatcactataccgtatgatgatttcaaagttttgggaggcatatagccatagaggcgcaagactataatgtttaaatattaggggttcatgtcattctccttaaaatcagctgctacggaataacttatttacgcagatactataataaaactattggtatatattttcgtcttccgtctacctaccctccaatgagttcagtccttggagatctctcaaagaatacctcctctgtttcatattacaagtcgtttgacttttttctaatcaagtttgactaattttatggaaaaatttagcaccatctaaaatatcaaactagtttcataaaatctaatattgaatatatttttgataatatattttattgtgttgaaaatactaatatatttttctataaatttggtcaaacttgactaagaaaaatcaaacgacatgatatgaaatggagagagtatccttcagttatcacgattaagaagtgtagtgtttcacttgattagtcaccaactgtattttggttgcaacagcatggtgcttactaatgagccaatctaatcgtgtcatattgctaataaacagaataattggatgaaggagaaacataaattatcatgtgcatcgcttaggaaaatgcattaaattgattctttgggttacacatttttgctatcttaaaacatttttcaggtggaatgagaaaatgtttacttctacaaagcctattcatcagctcagatttcatgtctactgttaattcttcttaattttgagaaaagatacatgaaaagtccaacacagtatgcttgatgaatggatgtaaagatcatactggaaaacagcatggtaaagctgaagtgaagaacttcattcctgtcctgaacgtttttctggtataatagaactttgtaaccagaccagaccagcccttttctgcaacataagcacaaagacatccaaagtaatgcgtcatctacttcgcgaaatggtgcttctagcgcacataagaaataacatgcaataattagaacaggaaatttccatgccgcaatgtccatgtttgcaactctgcatttctcgatgcatcccaatcctattcgttctacgtccacctcttctcttttgaattgaagaactaaacccaattttcgagggatcacaaaatgaacagggaagtttttcttcgtgcggaatataactgggaagtttgtgcccactggctatatatattaagctaacatatactcatatgtgtcattttgtcccatcagggtcaatttttcaattcagtagttctatcggaggtactgatatagccgaaatttagaaatctcgatccaaaataatttaaatttttttaacaagatttgtccaaattcgactaacttttgccaaattcacaaaagtttgagaaa

SEQ ID NO: 51059 - DNA, 966 bp, Oryza sativa
gttccaagtcttgcaatgcttagtactatatcactaccatatgatgattgcaaagtccttgtaaggaactaaggattgtcaaaggtgagcaagattgtgtggttaaagttgtgagttcaagtcttccctctccttaaaatcagttactcaattagaccggatgatgtgaaatcagctattgtatctcatcttcccttttcctctcccctcctccttttccatagtcacatggcagatcccccagttgagaattttcttcaggtggaattagtggaatgtatttcacttgattagtcaccagctgtattatttaggttgcaacagctgatggctggacatgtgcttgctaattactgagctattgccctttcatgtcaatgagcagaatagttggatgaaggcaacaaatactcgggacttgattacttaaaatggttcattgactgcataacttaattaatctgagaggttttttctgtttgactactctttaatcagtttttttccctaaatgaaacataaattatgatatgcatttcacctaaaaaagtattcacggattgattcggctattcatttatgtgatcttcagataatcgcgatatttttcaagctgaataagatggctttttacttaattgatgtttttttttcagtttatcagctcaagtttcaatatttgctctttatttttcttcattttgagaaaaatattgtactaaatagtccacatttaatttgaggattaatggaaaaaaacgtatcatttcccctatccttaataaaccgatctcttcattcacgttgaagtgaaagcgaagaacttcattcacgccctggattccggaattgtagaacttcacaacaggatcattccgttcctgttaactaaaatacaaacacaagtccatcagctacttcaaaaatggtataaataagaaacacattgaattagaataggaaaaa

SEQ ID NO: 51060 - DNA, 707 bp, Oryza sativa
acttttgacttataaactttaggtctataaactgtaggtgtataaactttagatgcataaaaatactatatatagaaaatatttgaattcaaattcaaatttgaatcagatataatttaaattcaaatttgaaacgggtatgtaaacttttgatttataaactttggatctataaactttaggtgtataaactttagatatatagaaatactatatataaaaaaaattgaattcaaattcaaatttgaatcggatatataaacttttgacttataaacttttggtctttaaactttagatgtgtaaacttgaggtgtataaactttagatgcataaatttactaaaataggaaagtaatgtggtgccaaaaaagaaaactaggtagagggagggggagacccgatccgatcgctcctggcggcccctggcgatcaatcgcccaataggagtttcggtattcagttgccactgaaacgtaacggagcacaagtaatgcagaaaattgtcacaagttcgtctcctgttgcattctcctgtcttcatcaaatcctgtcaaaccaaaccaaatctatgtaagcaacagttcgaaacctcaaggctgggttaaaaaggaactgcacgaagcttggatagaaacattttgaagtcgatggatgaaaagattaacaagagtaaattttacaaagccccatgtttagaggacaag

SEQ ID NO: 51061 - DNA, 1404 bp, Oryza sativa
gtttgtttttttacgaagtagataatcactttagcactgttgaacaatatttttacttgcagcatgcgtagccgtacagacgaccagcaaaaactcaattaccagagtcaatgataagcgacaccacgttgcagtgctgtccattttcacactgttccagagcatatgtaaaacgttctagcattggcatcacgccacacaaatctgccaattataacacttgcgtaaggaacttgatgaggctggaaatacttaaggcatggctaaacactctaaacacattgtcatgtgcactcatatttcaaatcagatgtttcaaagaaaatcaacatacatgtggaaggaaagaaaaaacaacttgatctcaagtaaaagaaaaaaatagtttataccaggtagttgcacaaactacagatttcggtgttccagcattagcacagttgcaacctcacactgagcgtcattcagtcaattcctacgcttgtctcgtttcaaaaaattctgacgcctatacttgcatttttgactgtttgcgttgactccctcacttcttcttgcctcctctccaaatcctccgcatccttcttggacttctgttttgttgttggccatggcccatgctctgcactgtgcaactccgtgtgtgaaagggttttctgatgtcggcgaagatgctaattgaagttgatattttacatcccttggtcatgaactcatgatcgagtggtccaaatttgtgatcaaaatcagacaaatttgcttttggataagaatataataattgatctcatcagtgcccactacaaagtctagcctaaattttctgtctcttactttccatttggacctgaaaccattaaaaacaaaattggagcaagtagagtacactgcattggtgttgggaaaatgggaaggaacttgcagtgtttcgcaagggtttgaaaaaagagttcacataaagaatacacctactcacctgcgtatggctggcagaggaataaacaaccaattttgatctcgaatagttgggcacagatcatttctgagtccaaacgctccagcgttgaggtttgaccaagatgacaaagattactattatactgatgataaccaatcatacttctcgaggtttgtttcaggttaaacacaatatcgttagtggttacgactgattgagatgtgtgctcagacagtcacaacaccacgttgacctgcgattctgcgagctgaactaaatccatggtctgaattcttaacagcaactcaccctgcttgcagcatcgtgctgtgtataagctagcttcaaaccattcctccttcagttttccttctccaccactcttcccccgtgttcatcttctgcttccccatgcttctcccttgtcatgtccttcttggcctcct

SEQ ID NO: 51062 - DNA, 6640 bp, Oryza sativa
aaatgggggagttctttacattcgccttgctgcaaaagagttgccaggttcagaaaagaagaagaatagaaatataagtggttttgccattggtgcaagcactgccactttgtttttgatgatccttctactgatactttggaggagaaaagggaaatggtttactcgcacattgcaaaagcctgagggtggcattggggtcgttgcatttcgatatattaatttgcaacgggcaactaaagccttttcagagaagttggggggaggaagttttggttctgtatttaaggggtacctaggcaactctaccatagccgtgaaaaggctcgatggagcctatcaaggagagaagcaattcagggctgaagtgaattcaattggaatcatccagcatattaacttagttaaactgattgggttttgttgtgaaggtgataacaggttacttgtgtatgaatacatgccaaaccgctcccttgatgtgtgcttgttcgaggctaatgatatagttttggattggactactaggtaccaagtagctactggagttgcaagaggtcttgcttacttgcataatagttgtcgggattgcatcatacattgtgatatcaagccagagaatatacttctcgatgcatcttatgtgcctaaaattgcagattttggaatggcaaagattttggggagggaatttagccgtgcaatgacaacaatgagaggaactattggatatatggctcctgaatggattagtggaacagttgttacatcaaaagtagatgtttacagctatggaatggttttgtttgagatcatatcaggaaggaggaactcaagtcatgaatgtttcagggatggtgattattcattcttttttcccatgcaagttgcacgcaaacttctcaatggagacatcggaagtcttgtggatgccagtttgaaaggtgacatgaacctagtggaggttgaaagagcttgcaaaattgcatgttggtgcattcaagacaacgaatttgatcgaccaacaatggctgaggtggtacaggcccttgagggtctacttgaactcgacatgcctccattgccaagactactaagtgctatcacaggagactcacattcagtgacaccacaatattttgattcagtgtaaatctatatgctgattcacaattaaaagtagtctaccaggacattataattcatcttgcctttttagaaaattagggataacatctaaggtctttaagagatcatgttaaataaactcgtagttattaagatctctgtgcccaagcaggagatcgtgccagccttccagacaaaatatattttgtgtctatgtaagatctgtaggtattagtgtaccgtatacatttttcatgttgccaattgagatgtttccggacacgcaggcgcaattgccttgtcagttgagagagtatattgttgagcctaacattggcaaatgtgtgacaacctgacaactatgctgctcatattatgcaaagttgcaaacatggcctatatatggcctataaatacaaggctaaattgttcactggcaaacaaaaaggagaagcctggctgctaagctgcaacttgtattttcaaggatagccacattctacaactataacacaagaactttgtaagccagaattacgcgcaaatcctaacactaactaccttaactgcaaggaatttaaaagttgggtgtgtgttaccaatcactgaaggaagataacggatgagcatgtttgattgtctctctttcttcatctacagttgttgctgctgctgcagttagttgcgatttataggccattccatctgccaaaggcaaactgtatactgcatcagtttccatcaaaactattgatctgagaaagataagtgccaagatgagtaaataacagaacataatagaagaatagaactgccgctgctaaaccaaaagttacctttggtgaacaggtcaaggcaagtcgatggtaataaccagctaagtagagttggattagcttcacaagtagttgttgtgtgcatgtgccaagcctcacaagtcgtcacaagaagcaaggtaactgcaagaagcttcaaaagaagttgacacatcaacattcctagctggatttttttttcatatgtagagctagttgatgggtacctggacagaataagctttacaacaagcagtgcaccagccaattaactcttgacatgaagataggtttgatgtaaacctgagaggttcccttcagtagttgtctgaagtctgaaccctgaatatattttagtatatgtattgttataattaaattttctcttagtacataaactggatagagaaggctgcatctctcatcatgcttacttcaattctgttcatcgtgaaatggcatccaatccaatgacacactgcatgggatatatgaaaaaaaacaatacacaacaagaagccttccattgcgactgtagaaatcaaatagcacaaatgccttccattcactgtagaaatcaaaaccatctgtagcgctgctttgagcacctgacaagtaactttctccctggtacaaagatagatcagagcaagctcaatggtatgaactggtgtcttgtttgtttccagtaagactatagtattactgtactatgagttaggcccaaatgcccaacgaagttaacactgccaatcttacgattcgcttgttcagtgaacgatgaaccataaatacagcattctttccctcgaacaaagtactgacaaaaatagtaggaaaagaaaaacctaatatgttcaaatctatttttccttttaacgaacaacaaaatggcgacggtttccaatcgaataatctaccggagagcacgacgcatcccacaaatctcacgcttgcgagcatccgggctagcccccaaggatccctcagtatctcgagcgattcgcatcgtcctcagcggcgcatctgctaacattttgtggaataacaaaatatgctttcccccaaatcgaagaaacaactggtacaaaggagacgtagcggcggcgagaccgtaccgcggagggagatgctccgtcgcacatctgccccatctccgtcggcggcgacggcggtcggcggactggcgctgctcgccgctcgccgctcgccccgcgcgcagaggaggaggatttcacgactcgtccgaggctgcaggcccatcgtcttcatcaccgtggccgaagaagcccaccacagcccacctaacttacggacaacgggacaatgccgcgacaggtccagcgatacataatgcccgaatgcccgataaaacacatgctgcgcttggagagttggagaggtaaaattaatacgtaactctagaattgactcgtgggttacctattaatttgatttatactttctccgttctaaaatataagagcaagtataatagtaggctataagtcggctaaatgctgagttggaggaaagaagagaggagagagaggagaagcgggctataaacttacagccggcttggacacaagaaccaaaaactctgtgagagagacaagtgggtcctgtattaattgtgacaagctaactattatataggtaggctgagagaaggctacaaatgtccttatagctagcaggtcggttgtattattagccttgctctaaggcacaactactttttaaagttgtttcataatataaggcgtgcatgcatgcatgtaattaattagcacattctctcccataaattattattattttaaatcctacactcacaagattttaattctattggttgcatgtattgtactagttggggtgatttatgacaatgatgtgatattaattatttcttggacttcgggttaaggttggttgtgccttatattttggaattgagggtgtaaataattttatggatcgacccacttgcatctctacgtggtaagtcggaccataataggcccacgggttgacatataagttcgcaggtcagtcctcttttcatccctagctgcgctccatgttattagttagtttgtgctttaaatcgtcaatagtagttgtgtatatgatgtaaatttataatgcaaacttgatagaaacttccttgttattgtgatacggtgtttccgatgccctattctaatacttccccatcctagtttgatcattagttttctcaaaatgatcatcatctaataaaatctctttatttatttgtgaaaaaagtaaatgtgcatcgcgtaatgccctgcatgcatgtatgcttgaatgataattaatttataaatgatgaatgttttgatattcttggtctaggtgtccttttgtttagtggatgatcatattgggacaaagggagtagcttcgttcatgatattttccgatattacggtagaatcggtatcattttcgtttctggctctaccgtttggtttgtattgttcaagaaaatagtaccctttcctgatattttcatccttactctaaagtcttaattgggtgtggcctacgctagaatgtgactcttcaattatattgcttaggccaggtacaatgatctttataagtaaactctctctctattatcatgtaagtaaaatttgattacatggaagaaaaagaggggatgaaaataaaaatatggttgctatctaagccctcttagcaattagtaaaaaaaaaagaattgttgcatggatacgagagaaaggaaagaaatattattttggtacattaatgtttagacaccatgcttacagagataacatttaatgataaaacaagtcacaataaaataaataataattacataatttttttaataagatgaatggtcaaacgtatataaaaagtcaatgacattatacattaaaatacggtaaaatacggactgagaatctgtttagacttttgaaaagtcctacaattccgcgagctcaaaaaactgtgatgcggtgtctgcacccgcgttgcacccgcgttgtttgacctcactaagagcaagtttaatagtatagccaaccgctggcttaaattatctatagtcaacttaatagttaatttatacaatatatatacagtctgcatcaatctcttcaaaagtactacttaataaagagggttgtaaacgaaatcgttagagttgcagcatatttcaacatgacagaattttgcaggatgcgaagaagtaaaactcaaactctcggctgataaaggtcgagctgcataccaaactctcagcagcaacgagctcaataaaactactgaagtagcctggcaaaggctcggtttaaaacagattgttgagtagatggttgccccgcattattacttgattatagtgatagattaaatattttaataaataaacttaaaaaatacagtggaataaagttcttttttttgaaaaaaaagtatttttaaattgtgtagcaaatatcccttttcaacaatctagcactaatttaaacgaactaagcctaaaagatggagttgcctatcgtgagcaggtcaattcaatcagatggtcagtaccagctttgagtactcgtgattaagcactaaacggcatgaccaagtcaaggcatttttcattatttgtctccattatttccaaggccgatcaagcattcttttttttttctttttcaacacacctgtgccaccccagttacgattccattctctttcacatttgagggagctacttcatggctcacacggctgacagggcaagaaaacgatctctgaaaaaaaaaataaagtgcagtggttagttataaattgatcactacgattgtatgaaaatgatgtttttctatctgtcctgcagcatgcattcacagttacgtagtcatacaggtgacaaacgaacagattcattgaccaaacttacccatttgtagcaggtaatggagtctaaaattggcatcccaagcaaactgagcacaaacaaaatataaaggggaggagctgtggctctgcagttctcattcctaaccaacactctgcatccatccatcccaatttctcgttcagaatgcctctcgccctcacccttcttggattattactcttgtcactacacatctctgcatcttgtgctgccatggacaccatgacacctgcgcaagcgctctttggaaacggcaagctcatatccagcaacggcaagttcgcgctcggcttcttccagactggcagtaagtcctctcataacaccctaaattggtacctaggcatatggtacaacaaaatccccaagctaactccagtatgggtggcaaacggtgataacccagtcacagaccccaacaattcagagctcacgatctctggcgatggcgggctcgtcatcttagatcgatccaacagatccatcgtttggtctacccgaataaatatcacaactaacgacacagttgccatgctattgaacagcggaaacctcgtcctacagaatttcttgaattcatccgatgcgctgtggcaaagctttgactacccaacacatactttcctccctggtgcaaaacttggttggagcaagatcagtggtctcaatagccgtctggtttctaggaagaattcaattgacctagctcctggcaaatacagtgttgagttag

SEQ ID NO: 51063 - DNA, 1537 bp, Oryza sativa
ctgtttatgctggcaatcgcactagtgatttggtggaacaaaagtaagaggtataattgcacatcaaacaatgttgaaggtgagagtggaattgttgcgtttagatatattgatctgcagcatgcgactaaaaacttctcagaaaagctgggggaaggtgggtttggttctgtattcaagggatttctccatgactcaagaactatagcagtgaaaaagcttgctggtgcacatcaaggagaaaaacaattcagagcagaagtgagctcgattggactaatccaacatataaatttaataaaactaattggcttctgttgtgacaatgatagtaaactgcttgtttatgaacacatgccaaatcgttcccttgatgttcatctattcccaactgatattaaaattttgaattgggatactaggcatcaaatagctattggagttgctagaggactatcttatttgcatgacagctgccgcgactgcattatacactgtgatgttaaacctcaaaacatacttctcagtgaatcattcactcccaaattgcagactttggaatggcaaagtttctaggaagagattttagtcgagttttgactacaatgagaggaactataggatatcttgcacctgaatggattagtggagtgcctatcacaccaaaagttgatgtttatagctatgggatggttttgttggaaattgtttcaggaaggaggaattcaaatggaggatgtatcactggtggtgacaaagatgtttatttcccagtgaaagtcgcgcataagcttctggagggagatgtagaaagcttgatagatcccaacttacatggcgacgccaacttaacagaggttgagagagtttgcaaggttgcttgttggtgtattcaagataatgagttcgaccgacctactatgggtgaagtggttcaaattctcgagggaatatttgaacttgacacacctccaatgccaagactactgcaagctattgccggaagctcttgttctattgcagaataatattttcacaatcaaatgattctatttaatcgatagggttatttttacctttcttgtgcataagattgtcagacgtaaatgtaagctacattgtggatctatattgaaatgttaattagtgaaatcaacacagcaggtaccattgcttagcctatagcaatgtttaaacctacgacttccctttcccatattcttttgaagctcatccccctaggcttttcaaccaagcggtctaattactactttcgatttttcaacaattatattcgcatcatttactagatagccataatccctatgatattttttttgtcccacagttctgcatcatctactggatgcatcttgtcaaataaaaactactaaccacccatctggctggagatatcactggattggttgtaactaacaaatgttttctcctctttaaatcttaatgagattggtcggacaacctttggctgacccggcaaaaaaaaatgtcactggattggataatgtcctgtact

SEQ ID NO: 51064 - DNA, 1337 bp, Oryza sativa
  unsure (1)..(1337): unsure at all n locations
aaatgtgataccaaggcaatcttttatttggaagctaagacttccgttgaaaataaagatcttcttgtggtatttaaaagagggggtcattttaaccaaggataatttagctaagaagaggtggaaaggtagccttagatgttgcttttgtaggtctcatgagacaatacaatcctcntntttattgccccatggtaagatatgtgtggagcgcagtacatttcacttttggcatctgcccaccgcacaatatgtctcatttacttggtagttggctaagtggtgttaacattaggctaaaaaatcaagtttttgtgggcatagcggcgttgtgctgggcggtgtggttaaataggaatgatgtggtttttaatggaccatgtacttactcttttatgcaggtaattttcagagggacacactgggcaagactttggtctttgttgcttaaggaagaggatggcaacatgttgaaaaattattgcaaggtgttagagatgagggtcttagaattcttctctaattatggctggaatttcagagggagaattgaagcttacactgttgtttaagcttgtttgttgagtttgcttggttgtcttgttagctggcatattagttgaacttggtacttcttatgttacttttaagtatgttttgtaacccatgtaatgggaggagccttagtgctcttgtatggacttgattggcagtgtacattcttcgggatgtagaagccggggtttatataaatcctttatctaaaaaaaagttgcaaacgaacaatatggtggccgacctcgtgcgcccctaatcccaggtaagctactaccagctcttgccaggtgacaaacgccggccaaggtgaacgatggtggaggacgagcaatcaaatgcagggcaggttgcatccccccaaatatttgcgctgatttctaccggaatcttcagttttttgcaggcacacacggagatatatatatattcttcgacgagatgttgatccccaaaacgtacaagaacagagagaccaaaaagcgtaagacgacgagaccttaccactgggagagagagagagagagagagagagagagatcccccgccgccgccgtgagtctggtcatctccggcggcggctcgccgccccgaggttacatcgcccacgacgccgacgagcggtgcagcccaaatgaaagccacgtcatcagcagcaccgggccggcccatctccccttcccaagcaaatttctgcgctcgcggcccaacgcttcgtggctcttcctgctgtggagaatctggagatcacgtggattttttttaatatatttattttaaaa

SEQ ID NO: 51065 - DNA, 7287 bp, Oryza sativa
ttagatttgcataacaaacattttttaaaataataacagacaaacaccatggtattcactatttagtgcttaaaaaaagaatccagggtatttcgatcacaaaatttctagtaattccaagaaaatttccggaaagtttccgaccgattccgagttccgacggaaactacccttatcatttccgattccatttccgagaaaatatttccaaattcgtttccgtttctgaaaaattccgaccgacagattccgttttcaaaaataggtctggaattcggaaagtttccgtaccgttttcacccctagtaattggtaagtattatttcttttcttttcaacgtgagtgtatacaagtatagattagtcaggattaaagattcctacttactccgtttaactatgtaagacttctatataaatgtgggtgatggtagaaagtcttacattatgaaacggggggagtaatagttacgctttaaatacaattttcaatctgccaaagtccatgtattcgtgcgtgctttccattggttcagccgatgattgcgcggagaaaaggtcaaactgggtgaaatatacttaatcacactattatgataagctgtgctcattggcaagcactcatgggccctgtttggaagattagcccagggctaattttgagagctaatgtttagtcatgaattggtaggctaaacattagcctaacatgatatgtttggatccataggctaattcaagactaaaaggtggagagagagtagaaagagatgagagagaaggagagagagagagctgcttttttatggtccccacacaaaattagccctattagcactctttggaggggctaatgttttgaggggggctaattcacattagctcaaaattagtccacctgtttggatccttgagggctaatttgagactaaaagatgagagctgaacattagcctatggaaccaaacagggcctggtagcctggtacacatggcgatcgaggaaatttggtggttagtgccacgccttcgagtacccatagtcccgtatcatgatgtacgcaccgatttggcatgataatatagttaatgtgttcagcatttttgcctcctttaattccgccgtccaagtccataagaatggtttgcaacacgctttggtatgaccaagaagagatgtacactattccagcattaactcatactccttacgtactagtaaaggaagtcgtttaggacagcggcatggtctccaaaacacaactttgacttcttgtttctataaaaatatttattgaaaagtgatatatgtatacttttatgaaagtatttttcaagacaaatctatacatataatttttacatttttaaactcaacaacttgagagttatttatgatttatattcccaaggtttgacttaaacattgtcctaaataactttctttatgagtacggagggagtattccattatttctataaaaaaaacttctagccgcatcataactagaaattggatttttataggatggagggagtagtcacgtacttatatacagccgcacctgagcgttgacatcctgcatcctgtgctcaacatgaaactgatttgattttggagaaggaatgtcagatttgatctcgtgtgccacactggaaactggacaaaattttgtctactagctgaagttttcatttggacccgaaacatttttttgctcaggaaaggaaaatggaacaaagtagagtccacagtgtccactgcattggtatgtgggatgaacttgctgtgctttgcaaggtttagaagaatatataaacctactcacctgcgtacgtgttgatggcagaggcataaaacaaccatttctgtctggaatagttggcaaggatcattcctgagtccaaacgctccagcgttgaggtctgaccaagataagaagattatttattattcagataacctatcatatttctcgaggcttgtttcaggctaaacacaacgtcgtcagttgacaaggtctgatttctaaacagcaactgaagctgcttgcaggaccatcatctgcttcaatcccactcttccctcagtcctccaccacgccttccccttgttcatcatctgcttcctcatgcctctccttcatcatgtcctccttggcttcctcctcatcctcctctacctacggactccgacgagctctaccgccacggacaccgtgtctcccggccacgcactcgtcggcagcgacaggcttgtctccaacaacgggaagttcgcgctcggcttcttcaagccaggcaatgagtcctacaccaaccacaattcctaccttggcatatggttcaacaaggtccccaagctaaccccactgtggactgccaacggtaataacccggtggtggaccccacttcaccggagctcgcaatatccggtgatggaaacttggccatcttggatcatgccaccaagtcgatcatatggtccacccatgccaacatcactgccaaggacaccattgccatactgttgaacaacgggaatcttgtcctacgaagctcctcaaattcatccataatcttctggcagagcttcgactacccaacagatacacttttccccagtgcgaagattggctgggacaaggtcaccggcctgaaccgtcgtcttgtttctaggaagaactcgattgatcaagctcctggtatatactccttggagttagggcccaatggggatggtcatctgctatggaactcaaccatagcgtattggtccagcggacagtggaacggccgatattttggcctaacaccggagatgacaggcgctctcatgccgaatttcacatttttttacaatgaccaagaggcttacttcatatacaccttggataatgacacagcgatcatgcacactggaatagatgtcttcgggagaggtttcgcgggtacgtggctggaagggtcacaagactggctgatacattacaggcagccgatagttcattgtgatgtgtatgcaatctgtggaccattcacaatctgcgacgacaataaggatccgaaccttctgcgactgtatgaagggcttctctgtaagatcaccaaaggactgggagcttgacaatcgaacaggagggtgcatcaggaatactccgttaagttgtggcagtagaacggacagaacaggcctcacagataaattctaccctgtgcaaagtattaggttgcctcacagtgccgaaaatgtgaaggttgctaccagtgcagatgaatgctcacaggcatgcttgagcaactgctcctgtactgcttattcctatgggaaaagtggctgctctgtttggcatgatgagttgtacaatgtaaagcaactatctgattcttcttctgatggaaacggggaagttctttacattcgccttgctgcgaaagagttgcaaagtttagaaaggaagaagagtggaaaaataactggcgttaccattggtgcaagcaccggtggcgctttgcttttgattatccttctattgatagtttggagaaggaaagggaaatggtttactctcacactggaaaagcctgaggttggcgttgggatcattgcatttagatatattgatttgcaacgggcaactaaaaacttttctaagaagttggggggaggcagttttggttctgtatttagagcaatgctccggtgctttctaccggtagtatatactaccagtagaactaatctgaaccgtttatttttaagggtagattagtaaagtactgaggtagatttgggataaatttggcacttaatttatttttgtcgtggatcgctcggatgtttctggaaaagcagtgctgccaccgcttcctcatccatcgcaatcgagcggaggtggagagagcgactccttccgccgccggcgcttgtgcatcacgttcccttccgccggtggcaatactctccggcgccccctcttgttcagttccccttctctgccggcgtctacccgcttccccgccgcaggagcttctggtgccaccctgaagacttccggcgtgcgcacaggggcagcggtgcagaggagccccgcgtggttccacctcctctcgcacgacaccgccggcggtggtggcagccgcgacgacggctacaggcgtgcgtggagccggctgttgaggaggctggtgcaggagagcatgagcttctgtagcctcagcatcagcaggcacggtaatgttaattttcgtggatgacttcaccagaatcaagaatctgattctgaatctgaatcaagaatttaatttggagatggacagtatgctctattgctataccagaatcaagaatctgaatttgctatgaaaagaagtagctcaacttctgtgagcctgatccattaaatttgtgctttgcttcctctttacccaagctaatgtaatgtgaataggcccatcttgttggaattctgcgtgaaacccattccagcaatccagtccacgaaggcttccccttgcgagtcgtcacggcggcgagcgggtggcggtggcgccatggatggccagcaggaggagcagcacgcagggcggcggcagctgaagcccgggaaagacaaaagtatccctccgcaaatatttttttttggacaaaaatatccctccacaattctactaccattaagtgtgatggtagtagaaatagatctgaaccctatgatcaaatgagatcaacggttcagattattttctactacaattagagggcaccggagtgggtatcctgtatttaagggctacctaagcaactctaccatagcagtgaaaaggcttgatggtgcccgtcaaggagagaagcagttcagggctgaagtgaattcaattggaatcatccaacgtattaacttagttaaattggtcgggttttgttgcgaaggtgataataggttacttgtgtatgaatacatgccaaacagctcccttgatgtgtgtttattcaaggctaatgatatagttttggattggactactagatatcaaatagctattggagttgccagaggccttgcctacttgcatactagttgtcgggattgcatcatacattgtgacatcaagccagagaatatacttctggatgcatcttatgtgcctaaaattgcagattttggaatggcaaagattttggggagagaatttagccgtgctatgactacaatgagaggaacttttggatatctggctcctgaatggattagtggaacagttgttacatctaaagtagatgtttacagctacgggatggttttttttgagatcatatcaggaagaaggaactcaagtcatgaaaatttcagggatggtgattattcattcttttttcccatgcaagctgcacgcaagcttctcaatggagacgttggaagtcttgtggatgccagtttggaaggcagtgtgaacctcgttgaggttgaaagagcttgcaaaattgcatgctggtgtattcaagataacaaatttgatcgaccaacaatgggcgaggtggtacagtctcttgagggtctacttgaactcgacatgcctccattaccaagactactaaatgctatcacaggaggctcacatccagtgacaccacaatattttgattcactataaatctgtatgttgatttgcaatttccagttgtctgacagaacattataattcatcttgccttttaagaaaactaggtataacatgtaagatctctaggagatcatgtcttatactcgtattaaataaactcagtaccgtaacatgtaattaagatctctgtacccaagaaggagattgtgccagccttattaacaaattatagttggtgtctatgtagtatctttaggtattagtgtaccgtatacacttttcatgttgccaattgagatgttttcagaaatacaggggcgattgcctcgtcagttgatagtggattgtgagcctaacattggcaaatgtgtgacagcctgacagttctgctcatgttatgcaaacatggcctatatgtggcctatacatacaagggaaaattgttcactggcaaacaaaagggagaagcctggctgctaacctgcaacttgttttttcaagggtagccacattcttaaactacaacacaagaactttgcaagacggagtagctcataggttgtaacactaactacctgaactgcaaggaattcaagctgtggcgtaccgtactgtggttaccaatcactgaaggttgataatggatgagcacgtttgattgtctcatgttcttcatgtacagttgttgctgctgttgatagttgcggtttataggccgttccatccaccagaggcaacctgtatacttcatcagtttccatcaaaacttaactggttattgatctgaggaaggtaagtgccaagatactgatagaacatagggcctgtttggtagagcttcaagaggtggagctggaggtggagctgtgacaaacagacccataatagaagaatagaactgctgctgctatatattttttacaggaaaggttgaaaagcttttttgaaagcataagagccttacaggtttactgctgggggctccagcttgtctatacatcacagggcaccgacatccccaaagcacctgcatgctcaaagctacattatagacatcacaaaacacctggctaaggctaaagtgacaaccacaaataaactttcaccaaagactgatgtcaacccactccagatcttgatagtcctcaaattttgtccagtgccttggatcaccatgatcagagcttccatttcttctgcttcagatgacttcagtaagatcttccattgcataaggaacagaattcgaaaaacaattattaggggtgaatgtaaactttctctctaaacataatgtcattcctgaataaccacaactgccaacagccaacacacatacaagaattctatttcttttacgcccagctctcccaataacaaggtgaaagaaatgatcaaaagagaaaggagaactttgccaacccaaagcatcgctaataacacaccatttgctgcagatcaactggagataatatgttgcgaatcctccagcacttgcatagcatgcaatgttctgaaccctcctaatttcttttttttttcaattgtacagcagactggattctatctctactagccaaccgtagaaagtgttagggcaaggagctctataatttccatccctttactataatgtacccccctaaatgtcaaagcatacac

SEQ ID NO: 51066 - DNA, 3385 bp, Oryza sativa
  unsure (1)..(3385): unsure at all n locations
acatgtgccttcagcagtcgccgatgtggtcttcgccgcagtgcagctcagcccgggcgccgccgtctccacccgccgcgggagagagagggagtggcgaggagagagaaggaactgagggagggggagaaaaaagggacacatgggtcctacaatctattttatgtgtcaatgacaaatgggtcccacacatattttttaattctaaatgccacctaaacaccacgtcaacgtcacgtgtaaaggagacccggtcaatactgccacgtcagcgaaaccgtcctccaaaaccgttgagggagtcaaattgcaccggttccatagtttagaggtaagatattcggttttgtggtttagggtcatggattagatttcaattacttttgagggtcaccaagtgaacttattccttgttgcagtggctgcatcagtgcagcccagcccagcccagcgatgcgccctctctgtggaaatcacgagcgttccatcagtaatatgaggtatgtagattaagtagatgtgcgtaaaatgggaaagttattagcacataattaattaagttttaattattataaacttataaataaatgtatttaatattttaaaacaacttttttataagaaagtttttcatgaaatgctccctttaatagttaaaaaggcgtgctaacagaaactgagataaaatctaaatcttataatcagaaaataacagggccacttgaaccgattatcgcgcggagaaaggtcaaactggataaaatactcaacgacaggctgaaatcattagcaagcacttctgttacacatggtgatcaaggaaatttggtggccttcgagcacccatgattacgcaacgattttcacatgataacatagctagggcccctttgatttggaggaaaaacataggaattttagggcccctttgattcgtaggaaaagtttaggaaatttgaaggatttcaatctaatggaaaaaattcctatgaaaacatttgaaacaaaggattgaatcctataatatcctttaaaattcctatggaatgggtaatcatagagagattttgtaggaaagttagcaagaggtccaacctcttggaaaaattcctttgagcctatctctctcatccgaatcctgcgtttttcctttggttcaatcaaacgatcattcctatgtttttcaatcctttgttttacacctgcattcctgtcagaatcctacgtttttcctattcctccgtttttaccttcctgcgattcaaaggggcccttagaggatttcaatcctataggaaaattttctatgaagccttttgaaacaaaggattgaatactatccaatcctttgaaattcctatggaatggacaatcctatagagattttggaggaaatttagcaagagcttcaacctcttgctaactttcctttaagtctatctctctcatccaattcctatatttttcctgtggttcaatcaaacggtcattcctgtgtttttcctattcctacgttttctcaatcctacgattcaaagggcccttaagagcatccccagcagctcgtccaaatttgatcatccatatggctatatagatggtcatccaaaaaagattcctccttcatatttctccccatatttctccccactccaacagatcatccatattacatcatctatatcacatcctcctatatattaatagtatccttcaactaccatcaattaatattatttttttcttttttcatcattatcttctctttcactcccttctctcactccagagagctcgagagacacgagctggcggaggagcggaggggcgacacgagcggctcgccgccggccggagcggagggtcggcgcaggcgaagggtcagcgcgagcggctcgccgccggccggatcggaggggcggcgcggggggctcgccgccagccggagcggaggggcgcgcgaacggctcgccgacagccggacaaagtggcggcggcagcggaaaggcgacgcggccgaaggtaccttcactcgatctaccttcactgcttcacctcttcctcgatctcgatccggatggggacgggagaacaaatggcagcggtggttgcgggatggcgtgaggagagagaaacaccaaatctagcgtttctctctccgggaatagcgcatgcgccatctatggaggcccatatggcgtatccgttggagccggattttctccccccatacgccatttcctggatggaagatgggatgccggaactgctgggatgctctaaaggccaaagtcaatgtgctaaccatttttttcgtttttgcctccattaattccggtgtcccactgatcggttttcaacacgcttgtctgcaagccccagccacagttctgttccctttcacgcccttttctcagcaaacacatactacaggcgtacagccgcacaccctgagaaatatatgctccaacaagtcctcctcaatatacaaatgaacctgatgacattatttggaggggatcgatcagccaaatggggaataatactctgcaagacgtacaaatacaacatgcgatttcaaggcacaatcaagttacaacaaattcaatgttctctggcaatctgaagcccaaccgaaacatgtcagactcgttgggtggctcctgactcatcaggcgtacaaggtcaatcaattcctatgcttgcttcgtttcagaaattcttgcatcttacatccctcggtcatggtctgtgcttaaaatcagaccgatttgcttttggagaaggaatgtcggatttgatcatactggaaactagactaaaaattctgtctcctaactaagttttcatttggacctgaaaccatttcttggtcaagaaaaaaaattggaacaaagtaaatccactgcattggtgtgaggaaaccccttccagtgttttgcaatgttttaaaaggagttcacttaaaataatatacctactaacctgcgtgttgatggcagaggcataaacacgnnnntctgtctgaaatagttggcagggatcatttctcagtccaaacgctccagcgttgaggtttgaccaacatgagaagattattattcagatagcttatcatacttctcgaggtttgtttcaggctaaacacgatgtcgtcagttgacatggacttagtgattgagacaaagtgcccacaccaccacgttaacttgccaatctgcgagctgaactaatcgctggtctgatttctaaacaacaacagaaccggcttgcagaatcgcactgtgtgtgagctagcttcaataccattcctccttcagttctccacttctccttcccttgttcatcatctgcttccacatgcctctccttcgtcatgtccttc

SEQ ID NO: 51067 - DNA, 826 bp, Oryza sativa
aaggattgggagcttgatgatcgaacaggagggtgcatgaggaatactccgttaagttgtggcagtagcaaggacaggtcagacctcacagataagttctaccctatgcaaagcattaggttgcctaacaacgccgaaaatgtgcaggctgctaccagtggagatcaatgctcacaggtttgcttgagcaactgttcctgtactgcatattcctatggggaagatggctgctccatttggcatgatgagttgtataatgtaaagcaactgttggatgctgcttctgatggaaatggggtagtcctttacgttcgccttgctgcaaaagaattgcaaatttcagaaaggaagaagagtggaacattaattggtgttgccattggtgcaagcacaggcactttgtttcttattacccttctactgatactatggaggataaaagggaaatggattattgctcacccactggaaaagtctgaggatagcattgggatcattgcatttcgacatattgatttgcgacgtgcaactaaaaacttttcagagaaattggggggaggaagttttggttctgtatttaaagggaacctaagcgactctaccatagcagtgaaaaggctcgatggagcccgtcagggagagaaacaattcagggctgaagtgaattcaattggaatcatccagcatattaacttagttaaattggtcgggttttgttgcgaaggtgataataggttacttgtgtatgaatacatgccaaactgctcccttgatgtgtgtttattcaaggctaatgatatagttttggattggacaactagatatc

SEQ ID NO: 51068 - DNA, 1094 bp, Oryza sativa
acagggctgtgcggcgccagcatgtctggcgccgtcctcctgccaccgtggcgcacgcgaaccgatgtggcaggaggagggcgccagccatgctggcgccgccccagcctagtgccgccgcctccattcctgtttctctgtatggagttgcaacggtgtcatttttattttattttttcggatgttttttcacactcaggatcacgatacaaccaaccataaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccatattcaaaatataaccatatgaaatgacatatataagttaaacagtacatagagatgcaatttttttatttttatttcattttttgatattttttttcatacttaggagaacataggaaccaaccgtataaaaaataaactcaaacggacaaaatatgtgacatgtagaattttccaaaactctaccgaaacgaacaaaatatgccatctattaaaataggcgtaactttctcatacggactcggaatcaggcaaataatatatgcacggacatctacagaaaaagttacatccaattctcccccgctttgccgggttcggcgatattaaaacctccaaattccgcttgcaagattgtgtttttgaggagagaagtttttcggtggagctttggaaaattccatatgccacatatttcgtccgtttgagtttattttttacgtggttggttcctgtgagttcctaagtgtgaaaaaaatatcaaaaaagtaaaataaaaataaaaaagttgcacatctctctcctctgcactagttcggagagaggagaggagaggaaaaattctacatgtcacatattacgtccatttgagttcaatttttctatggttggttcttgtatgtccctaagcgtgaaaaaaatatcaaacaaataaaacaaaaataaaaaaattcggggggggggggg

SEQ ID NO: 51069 - DNA, 7556 bp, Oryza sativa
aaaagtcaacggcatcatacattaaaatacggagggagtactagttattactctggaatatgtcagatgtttgtccacttcatagattattatattgtttgatgactaggataactttaattcaaattgtttggaatgcctacagtggaagttcatatatcatgcttgatagtagcatgatttttggggctataaattcggagtctatgcacattttgctatcttcctttgctttgccctaatttttgttttgtagtcgaacttgatcagaaatgctgcacgaaactatctgttggattatgggattcactggggagcagcaccagcagtaaaggtatgtagcataattaagataatcgtactgatgttaacgcttccaaatgtgtaccactaaaaaaaaactggaaacaaccatagtatactactgatggatagtctgtaactttgtatatgcagttcagttgcatgtactatattatttgctgcaagaaaattatcataatattttgtgcctgcattgctatgtgctggccatggctagtagttgtgtgcgcatattaatggtagcctcatataacagttgtacgactgcctttgttatcttacatgaaattaacatcttgataatgctcttgtggcatttacattctattacaaattattcttctcgcagggcattcgagatgcagctcttgatttactgcacatccttgtagctgtacacgcagaggtttccatttctacatttcccctgattattaaaattgtgcatctctccttcgcactggatgtacatcaattactgataaatcataaatttacttcaattgctctttacatactttcttctttgatggaatactgtatctgtggtttcaggtctactccggtgctaggcctctgctggaaaaggcgatgacaattttggtagagggtttgattgatatcttcctcagtattttccatgagaataagaccaaagaactcagaatgttggacgcaaatggtttttgtcagctcatgcttgaggtactaattttgtttcttttagcttcaactgcattagcctcttcagagtcttaagttgtgtaaacgattcaattatgaacttaaagaactgttctgtttgttttacgggtgcagcttgagtattttgagactatattacggacatacttatcaactgaggcagagcaggctttgagatccttacaagagaatttattggagaaggcctgcgaaagtgtgactgaagccttggagaatcctggacaccaccgtcgaccaactcgtggcagtgaggatgctgcatcagatgatagacaatcagtatcacctgatgatctgcttgtaagttctaaaagatgtagaacatatggattaattcttgcatcagtgacaactgaataacacttccagtaggttctgttgcattaaatctgccaaatatacatcccgtttgcgttaggcatctatattctcattgccctggattttgaattttggaaaacactaagtcaggacttctggtgctttcatcatctaattatgggaagctctctttagtgaaagtttcatcctgttctgattttgcaagggagcatggctaaccaggaactatttattttttatttttcccaggcacttgctcagcaatgcagtagcgatttgcttcaaggggagctggagaaaacccggttaaatattgcgtgctttatggagtcaactcttcaatcaacgcctgcaccggctggatcaaaacctgctgcttatcagtcatacaaggcacctgcgacacaccaaccagttcaagtgtcctccccaagttttagaaggcagcagacaagtacaaattcacctgcagcctcgaggcggcgtcgatgaagaaaatgcatcatgttgagagaaccattccttcatctacgtgcctcttccctaaattctcctctttctttgttcatctttcccatgctttcgtttgttacctgtaattagtatcatgttgtcatgtattatgaattttgacccattcttttggtgttgtaagataaaaggggtgtacaggggttgctgtacggggctatctacttgtataatttccatgagcctggaattattgtcgccattttttctaaagacaccatctcaacttaactttctggaactgagtgtcagatttgtcggtggctgacgaactcattagtcattaccaccattggacctcactcttccgattttctatgcggacttaaatgtgtcttgtaccaggctgaaacgatagttggagcacgcgatcgatcttatttgattcgtggatctgaatacctttctttagtctaatgtaacatgtttttttcttccttctcgatcgatcattttgctgtttatacgactaaacgtggaagccccccatccccctttgttttgttgattagttctttttgtttgaatcaaattattacattcttgatcgataatgatctcttcctcttatcctgctgtcaaaattcctgaactcctgcacgcaccacgcactacacgattacattatccacaaaaccaccttgcattacacccccagttgttatatgtacccaaagattcggccattgcatccatgttctccatgcatggctgcacctgaacttgtcctgcactcctgctgctccaccatcgctcgcacgtgccccaggatcaatgagcctctcgtggccctttttcttttcttttttaaaattccctcctccagctgtgtccggtggtgtctcatctctcatgtgccggttgatagatactcgggctttgtttagttctcaaaatttgttttccaaaaacattacatcaaaatctttggacacatgcatagcattaaatataataaaataaaaaattagttgcacagtttctatgaaaatcgcgagacgaatcttctgagcctaattagtccatgattaggcataagtgctacagtaacccacatgtgctaataacggattaattagacttaataaattcgtctcgcagtttccaggaaagtcatgaaattagttttttcattcatgtccgaaaactcctttcgacatctggtcaaacatccgatgtgacatctaaaattttttttcgtgaactaaacaaggccaacaaggcatcagactataaataggtgataccctgtgcttgtactactgtctactgctccctccctccatcccttgctcgctcgcgccacaacgttatcctctcctcgtagatgtggccacagtttttgcagccggaacgagctgtccaggctactactcctactagccatctcccacccacttatcacgaggctaacccgcatgggcgcgcgccaaggaggcgggaggagtagcacaccgccaccatcaccagcagcagcatggtgcagctgagccgccgccggcaccgcgagcacgctccatagccctctgccatggcggcagcttccgtcctcctcctcctcccttcccccttcctccgtccgtcgtccccggcgcaccgcgcgcgctgcggcattgccaccacgacgacgacgagcacgagcgggaggagggggctcttcctcttcgcctcgcgctgccgccccggcccacggcgacgcgcggcgtcggcggcggtgcctcccgagcacggcttgtcccagccccagccacaggcgcgggcggtgggctcgtacgaggccgccctcggcgacgccaaggacgcgctctacgccgctctggaaggttccatctctctctctctctctctcgcgcgcgcctgttgctgctgcctgctgctgattgtcaactgtagcagcgtcgctgttcgatcgattcgctggcagcctattgattaattttatttttttgcctgtttgatgctttggaggaaaggcatgaacagagggatattcgggatgacctccgagaaaaggtcggagattcacgcactggtggagctcctcgagtccaagaacccaacgccggagccaaccgacaagctgcaggacaaggtattactacatacatgccactttccaccaatgcgcttatgctactactaatcaattcgagcgttaatttggaagtctgatcacctgatattgatcaggattttctttaccttttgagtttatgatgagcagggattgttgttagaatctaggtggaaataggtgtgtactagtttaagataaacaaatgtagtatgaaattgcctctttggtaatgttactgatagtttggtgttgagacgatggaaggtggatggatgctggaggctcgtctatagcacgatttcgatactggggaagaagaggacaaagttgggactgagagatttcatcagcttaggagatttcttccagatgattgatgtcaaagaggttagtgaaatttaccgagaaatgttgtcaagccaaattggtaacgttggtgctgtgcttgtttgctgtatggcttgttctatgtttatgcctgaatttacaagtttttcatcggtgtatttctcctatgttgtatagagtttgattgagtagaatttgacttcagtactcttcaattcttggacaataccaaaatgatcaaaacttatgttggctaatggctaccgcaacggaagtacatgacaaatgctctgtttcctaaaaagacaaagtacatgcttttgtgctataagcctattaactatgaagtaaatgttattgaaaaagaacagtgaatattgttacatgatttttatactggcaaaccaagtcagttttgatttttgatatatcttgaaataaatggagatttagcatcaccttctctacacccaaaggaaaaggcggtaaatgtgataaaattcagtgcaagggcgttgaagatattatctggccaacttactattgaagcttcgtacaagataactactaaaacagtaaggattctatctgcttctcatcattggttacgtcgtcctagaaatttttggaacctgaccacttaaattctgaagcacattattcttttatccaatttttgttttcagaaggttgatatcacgcttgatagttcgaccatcactcctgatcaggtataattcatgatattttcacttagaaactagcttcatatacataagcagtacttcaatactattggaagggtagagttatgagtcaaaacttttgtaacaaatctttttacaaataaccttgagcagaggcacattgttttccttcacaggatgcatgtgcaactgtgtgtgatgtctattttcttctatggacataagtaaccattttaattacaccatgtaaagcaactgtaattttctctgatgttcactttgactgtcatgtgcagctgatgaatattttccagaagaactatgatatgctccttgctatattcaacccagaaggctggctagagataacgtatccttttcggcttatgtgaaactgttttgttcttcgctgtttttctaattttacaatctctgctacaaatcactagtttccctacgctacattttttctttccagaagtggtgtggatgcttttaacaccaataatttcgggtagcacatgtatagcagcagagtaacccaatttgcatccagattccagagttctcctcaacattttggtcagatacgttgatgaatctctacggataggaagagatgacaaggcaaacatctttgtgctggagagggcagacccctcagaagtttgacaagatttatctgaagcaaaatgcctgcatatacatggacattccggcaaagatgcctttgcacatacccgtcctgtaacacggtggtttttaacagccagtgcagatcgtgtgctcaactttccatttgcgttagattatactactgctatttttttttctttctggagcaaaaggcatttccctttgcgacaaaatcatgcaagctgggaaagctcatgcaagttcagttacactacatagagaattggtacattaagaactggtgtacttttgaattttgaaatacaccattttcaattattcatccttgtaagacataatctaatgagtgtacagcttggcaaatggcaataccctttagacaaagttgttgttgttgtttttttttttaaatgatcgctgggtgatcccttatatcagctctttgttcctgccacgccatgcgtcatgtaataataactgggcggaaagaaattcttgcgttatgtcattttggtggagctttgcacctttcaacaaggacatctctcttcgagtctttgcctcgggtagagactggaaatgccggaaaatattttaagcccttgatgttgcatattctcattttttatacagtcacgtggagcattcaaagtcaaactgaacatcacatggagaaaaagcaacatatcaaactacacaaagtgatataacactgaatttgttatttttgtttttccatgtttgtgaagggatatgtagcacaactcgtttatgtttgtccatttttttttataaaaagtttcataactatttgtactatgtgcaacaaacattttaaaataaggtatgcgataaatatacttccgtaagaaagcatctttatctacagtctaaaggtgcattaatattcgatggtcgaaagaagctagcatcaagattctctctacctattatctaaagatgcatcatttatatttgacggctaaaagaaattatcatcaagattatctctatctattgtctaaagacgcatcatcatctgtgatcatcaaaagaagccatcatcaagattcctgaaaaggcctatataaaaatcccaagagaagccaagagaagtgaggatccacttttggaaatgctagactttgtttgcattatatatagagtgactctaatccatagaggaacgtggagagctccttggaggggtgcaccttcttgcgcgtcgagccaccatcgtccttgttggctcccgctcatcatcatccaaatctagagtcggcctcaaaggcaccgtgcaatagtggcatggcatcataaccatcgggaagaggtggcgagacgaggtggcaattcgttgggcgcaagaccgatgacctccctcaactgccaccaagcgaaacaacaggtcgtgggagccctgggcggtagaagcagtaacaggttgtgcgggtggagaccggttgaggccacatctatcttgcctccactgagtgcggtaagcttcacaacattccctattcaccgcttccgtgggcacttctcgagccgccgccgtcgttgccattcatccatgctaccaagcttcgaggatgttgcctccataattggatccatggtgccgagcttcaggctattgccaccaccgaggattcacgccaagctccttggccgccatcaccacaagccgggtcgcgctgtccgctcctcctccaccaccgttgacaaccacaacaccatcctctccggccacccacctctaccgccgcattcactggatttttcacattttgatccttttgaaaaacttatttcgcaaatagacctctgaaaaaacttatccc

SEQ ID NO: 51070 - DNA, 4102 bp, Oryza sativa
gggagcgccagccaatatggcgcactccccctagccacctcagcatcaccccgccacgtcggtggtgggacggcgccagcctctttggcgccgtcctgttgaacgacggcgccagccactctggcgccccaaaaaggaccatttttgggataagtttttctagggatctacttgcgaaataagtttttcaaaaggaccaaaatgtgaaaaatccagccgcattcatgcagacggctggcgagttcgagctcgccgggtctcttgccaccctcctcttcttctccgctgccacgaaccaccagagcccctcgtcgtcaacctcccagtcgtctcccactgtcactgctgcctccagcggacgggctcgccagccaccgcccctttccctgccagctagctcccggggaagagaggggataagtggaagtccacttacatgtggcccctacatgtattttttttctaactagaatgccacgtcagcaaaaacgaccatccatactgtcttacaccgttattcaacccagttttgcaaaacatcagggttcgaaatttctagtatcgcggtttgaggatacgattcaaaacgttaacatgagggacctaaagggaacttattcttccccgacaattataccggctctcatgggcctacatgagtcgccaggtggtgtagttgggcctgcattgagtggttgagccgcgaaaggaagcccataccaatggtagcgcgcgaaccaattatacgggctttgttgggcctgcaatagcggaattaatccagctcagtgacgtctctttcttctccgggattgatcgccggcaaattaaacctcgatctagcggtgagctagcgccatggggcatgataatggtcgcagaggtgaagtcaaaatgggtgtgcctctcattcaacgatcaacttcagatctagactcaaccaaaccccttaatttgaagccacatagcatgcaaaacaagagatcagtattaggaggcacatacgcgtggcgtgatctagcaaagtgtgttgatctctcttgttctctttgtgaagcaagggcatatgagtgcctctgctgcccacgcttagttctctcaaaataaaccgtcgcaagtttttttctaaaagctttgaaatgtacctataatataattttagttcaactacaatataattgtactatggtggtgtttgaatctcctgaagatgaagatgaagattaagtgtttcacgtaaaacgaggtggtaataatgtgtgattaattaagttttaattattacaaacttgaaaaacggattgatttgatagtttagaacaactttcatatagaaagtttttgcacgaaacgtaccgtttagcagtttgaaaagcgtgccacgagtatccaaaatttaatccaaaagttgttggagaaaagaacatggcctatatataactataccataacctctaaataatttatgtatgaagttacaggtatttttttttgatacttgtatataaattagataaaagttatttataatgtgattataatatagttatatagtgtaattacagtacaattacattataattatattgaatttttttaataaaaaactcgtatagtccctaaataaatcgtcgagggttgtcaaaaacacacttaaatctttcttgtttaatcagtgatggagccagaaagttttttaaactagtatttgcttatttgctatagaaattttatcatcaatttactgtaaatatattgaaatttaatgaagttttcgtcggtgagcctgggcggtggctccgccgctgtgtttaataaagaacgatgtgcaacaaaatctcatataaccatggatattcggatgacaaaaaccgggccgaagagtagtcatattcatccgtccacgatcgatccattcgatcgatctttcgtttttggtgtctttgctattatctagcggtgaccgcgatcttcatcatgcccttgtcgcagtcgcccgggaagccggagacgaagaaggtgacgccggggggcagcgcgacgcggtcgtcgccggagccgtacgccgtcgcgttggccggcgccctgcacagcgcgtagtccacgtcgcccaccaccaccacgttgtgcgcgctcgcgtcgtagctgaacactgcgttttacacgcacgccgcccgccgccgccgccgccgcgggcgccattagcaccggccatgacggatcagtttcagtaaaaagaagaagaagaagaagaagaagaagaagaagaagacagatgaagcaagcagagggagagcaagctaagctagctagacatggatggagcaattagctaccgagcacgtcgcccgccttgaagggcttgtagttgggccacccgacgacgccggggctccagccggcaccgtcgccgacgggccactccctccgcgccgccgccggttcgacgccgcattgcagcgccaggatgacaaggagcaggagcaggccgaggtgaacggagcagatggccttatcgccgccgcggccgccgcgtgccagcgccattggagcaggagtagtctcgagcgaagaacgcggaagagcttaaggctataggcctcggtaaaagtccttgggtcaaaggctctccttttgtggcaacaacaggcctcctaccattcttgctctctccattttataatataagatataatttttttctagatattttataatataaaacgtccatacatactatatagaattagctagcacatcctccttattgaaatataattaactagtacattctctaattttattgggtacatatattgtatttattagagtgatttaagctaggaggtgatagtaattgttttttaatgtttggattaaggataattatacactatattttgaaacggagggataataatttaaactcttaggcaaaacaagggataagtgttagcaggtattaattcttggcttcttgcctttgtgattgctcattgctcatcatcaacaccgggttcacattctctaccataatgatactatcattatagatactaacgtgtgggacaatagaagggtagaatccatatgtcaatgattgtaatggtagtaccaccacaaaaatgactctggtcctactctcattccaaggctttcttcgtgacgcttctagcatgagaggaaaacctgatattcttagagtgtcatttattttagaacaaattttgaattttaagattgtacttattttgaggtggtgtgagtatatattttgtaaaccaaacaacatttcacattgatttgtgaatgtattcagagctttaaatgcacaacggtttatacaagaattgttgaaaagtattttaatagaattcttgattttttagtgcgtgggttccatgtgcccacttactagtatatatggagtgcgttcatttcacttcaaactatatgtaaatatcattctcttgatccgttacaacttacaagcatacaaaattaatcatcttgaccaacttccttcctaattggtcgaaatgcatatatatatatagggcaggaaatcttttttctgccgtgaggactaatttcactacttgatgcatatgaattcattttttcttttaatccacggtcgagtgcgacgtccttcaccggcgagcatgcgttgcgtatagcttgttaattattgttacgacattactagacagtttgcatctgtacattagtggtttcttgatcatcatggccgtgttgttgttgcagcacaggcacagcttccttggctggatgagatgatgatgatgatggtgatgcctccttactctttccccagagaacgaaatacaggcccatgataaccaaagcagaacctatcacactgcacatatatagctagtgtcaaataaaacatgatcaatatgatgacaatagtaattactcactccatttcagattataagtcgttttaactttgtaatattactctatttatctaaaacttggtcaaactttaaatagtttgactttaacaaaagtcaaaacgacttgtaatctgaaacggagggagtaattaaacatgacaaatacacataactat

SEQ ID NO: 51071 - DNA, 23797 bp, Oryza sativa
  unsure (1)..(23797): unsure at all n locations
ataagtaattcaaaatttaagaattgacaactgaaatgactaaaagagaattttaaacaagctaaaaaaatattatatttttaaaacggagagagtacttacgttccaaggtgaagttgctcacggagaacgatgacgttgatagcagctgcaatgatctggattagaggcgtgaatgcagtcgtgaacaccggccctctctgctccacacaccatgacattgccaagaaccctattcctgacccaactatcccctgcatatatagatatcaattcatccatccatcagttgcaattaattaataacaattgttctaattaattaattaaggtatggtacgttaaaacgcactaagaatgcgcaataactaaaacatgctccttacatagtaaaatttttactgcgagttatatcgttctcagatatcatattcttcctccgtttaaggttataagtcgttttgactttggtcaaagtcaaattgcttcaagtttgaccaagtttgtagaaaaaaatagtatcaacccgagacaaatttattttgaaaatatatttaattaactaatttggtattgtaaatattactatatttgcgtataaacttagtcaaacttgaagtagtttgactttgaccaaaatcaaaacaatttataatatgaaacggatggagtagtaaacattttactactaggctcaataagagtatccgacaaatttgactactaagctcaataagagtatccgacaaatttgactactaagctcaataagagtatgacaatgattgctctcgcagttaaaattatacaatgttaagtttgttttagctatattgcaatataggtgtagtatagcacggagtatatctatagtcacgtaccacaaagagcacggtgatgatctgaagcttggtccttaagatccatgggggcaagctaaccctgtcgatggccaaggcgaccacggccatctggaggaagctgaggaagaacatcagggccgtccccgagtagagagccgggtacttcctggcgatcctcgactgcaggatgaaccacagcgaccagcaggccgacccacccagcaacgccaccgacccgatcgcccatctgtgcgcgccgccgacatgaccggcggcgatcaccgccgccgatgccatcggagaggaagaagatgatgatgaagaagatgaagatgatagcttggtgagcgatgggccctggtagagagcaaggaccattgctccgctgaatcctaacaccgtgcctcccactttagctatgccagctatgttcaggttaactttctccagcctgcacatatttcaatcttaaatttgattagaaattttaagtatctcaagatatttaaattttacactattttttttatctcgggatacttagtaccgaagatactaaaatctaagtaattttatcatttttgaaaaaaatattagaaaatagcatattttctagtgtaaaatttaatacatatacttaagcaccgtaaattttctatcaaaatttacactagaaaattcggtacctatcgataccttctcaaatatggtaaaattaccctaatttgttcttctatactcatttcatattttcatgcataccaattaaaaagtcctgttttccatgcagatgtatgtatgttttgagttagttaattattatatattctagctagggggaaattaatgaatgaatgaatgaattgtaattacccataaggcagagctacaaggaaggtgaagatgggagtcatgttgatgaaggcgcaggcgaatgttgcggtggtgtactgcagccccaggaagaagagccactgggtaagggacgctctgcacgcaggtacacatttgatttaatcaattcatcatttgttagtgcatatatatacacatataatgatctttcatcacgttaattaaactatctatgtagtgtatatatgaaaaatgacttgcccgagcaccgcactgaagaagagatacaccaagatttcagctgttagctttggtcttgtcttcctgcatccattccatgcagcacaatatatatcagttaattccttaaaacatacatctatatgttactatatatacagctacaatatatacaataacaattgtcgctaattaatctatcaattggcatgctaatatatactgatcgcgaattggtgaagaactgaatcgatcagaaattcagaatgcagatatgctatatacctctcccggaagtaggcgatcggggcgaggaagagggtggcgatgagctgacgaagcgtgatgaggacggtggcgtgcatcccctcgttcagggccatcttgatgagggtgttcatcaccgcgaacaccaccacaaccccaaccattgtcaatgttggcttccaactattgcagctacccatatcgattcaggatcgatcgatctctatctagctgatcaatggctagctagctacaaagctaatctgaaatatgtgtgtttgtgtgtatatatatatgtggttgttaattgctttggcactgctaagtatattggcatcaaggatgctgcaggtggcaagaatttatatgcatgcctgccctggcctccaagtgatgacaatctgacaatattccgttccttgcttaattacatgtatcacgcggtacgggcgtatttgccctttgctttaattaggtgcactcaagaatgatgccaataaggtatggtacgaacaaatgtattagttattaattagctttactttaattcctacaccactcaagatgaacaatttataattaattatcacctgcatgaccaaaatattttttttaaaaaaagctgaagaatttgttcatcaactttatgcaagcattttttttaaaaaaaaagaggaaagagaggtttggattctttggctagcttggaaaaggtacgcgttagattacatatataattaacaaggagtaatgatcctaatatatgtatgtgtcaaagacactgatgaggagagatcttccaaattaacacagttgttagtatatgcaaattaatccggcctgttcttaattttctcctgccttagatcgatcatatctatctaatactctagcagtggttaattttgtcctgcagctttaatttgatcacagggagagggatgctagctgtagatatatatatttatcaaaggccgacagcatatgtacagggagattgaaaggaaaagagatgctttctttggtgcgtcatccgtcgttggtcagcaaggtgacttgaggggaagggaaaaaaagagttaaaggtcatatagacttaatagtatatgctccaacaaggaaaagaatgatcgttaaaaaaagaaaaaaaatatgtacacctcaaattgacacaaatatatagtccctccgcttcatattataaatcgttttgacctttttctaagtcaaattttatagaaaaaattagcacaatcttaaacatcaaatagatgtttgttttgtgttaaaagtactactatatttttttaaaagtttgattaggaaaataattaaacgacttataatataaaacaaaaggaagtagcaaactatataaatcagataccatgcatgcatatatagctgggccagctcttttctcttcagggcatccaatgctcctccattgttgaacaagtattgatcatttagaacattcaatgctcgcatgaaagaattgatgtgccattttttttgccagattgaacacatgggccggccgggcgacccctaacaattctgtttacgttagtcatcttcatggcatcttagaccgttcttccctcgatgttcccaacctcactactctcattttttatgtgctctacccaactgctaaaagatacgtttctttaacaagtgtctatacaaaagttttattttttttcaaaaacatgcaaaaagatcgcatgccaatatattaaaacgagagtttagttacacactgtatataaaaggtgctataatttttaaaattttttaaagctaatacttaattattcttgtgataattcatcgatttttttacatgcgaagagaaagggttttcaatgcctccaaaagaacacggtctttaaagaaagagaaaatcccctatatacctatgaaagttcacataatcccttctatacccctgaattttgctcaatcctttatatacccctgaattttagtttggatccctttcatgccctttccgttagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttagttttacatatgatataaaaagttgatacttatttattagttattaaaagttcttttatgtagcatatgtgttttcaaagtaatacaacagatttgtttattacttcagaacacatatgctaaaaaaatcttttaataactaataaataattattaattttttatatcatatctaaaagtatatttatcgcaaataatatggtgcaaaactatctcataaacataatagtctcatataacaaatttctatgctccaacaatatactctattaatttatatgcttctttataccaaaggacaaaatggacttgttcataagaatttaacggtcaactaacggtcaactagcggaaaggacatagattggatccaaactaaaattcaagggtatgtaagggattgagcaaaatttagaaatacagaaggaattaggtgaactttcaaggatacataggggattttctcttagagaaaccgagtgtaatattactctaatattattattttcttctgcttgaattcttccttttgctggcgaaaggaaccgtgtgtcacacgctggcacttcgtgtcggccatatatatttagcctcacatgtgcagcattagtgtgcattaatatgctgatttgtatgcccctgtcatatgtaagagtatatgctaaccgaccaggcatcatatcagaaacagtaaatattcaacctttacgtacgtgcgctgaataatttctctgcttttgcttgctctttttttctaggaacaatactgttatgatgtttcattaattaagcaatattaataatattccttcttttctgaaaaaaaaggttgcacgtatatgaatggaggggccctcgcatcataatttaaagaaaatacctctgaaacttcacccaatccctcccatgctcctgagatttacttatttccttccatacccctaaattttagtttggatctcttctatacccctttcattagttgacctttagttgaccattaagtttctatcacaaagtccaatttgccctttggtatcaagaaaatataaatttatgaagtatattgatgaagtgaataaatttatggtatgcgaatatttgcaatgtacgatcagggatatgaatcaaggaatgaccaatatgctcaattttcatacctgcaccatttgcagtgtggaagttcccttgtatttctccttagtcgtcagcttgtccaactcacttgtgagatggtcagttgccccagtgtgtatataccaattggtatcaacaccgtaggcatacgcagcagccgccacatgcctctcatccggcacataatttgcatcaaacctgtgccagcattcagcagcaacatggcctcttttgtagcatacctgacacacgggacgggtatcaacacactgctgctggttgccacctcgccctcgatttgctcgcatgttgccgcggccacggctaccaccatcaccgcgaccacgtcctgagttgctcccgccagcagcgctggtactgccaccacggggagcaaagttgctgcggcctccactgccacgaagtgctgcatttgccgatccttgttgcctcaagtgcagcatgttctcaaaattaagtagttgtgcatataattctgtcatggagatgggttcaaccctcatcccaagagcagaaacaaaggaatcataatcgccatctaggccatttacaatatatgcaatcatatcttcctcatctagaggtttcccggtagatgcaatctcatcactataagccttcatcttcccaaaatattcagagattgtcattgtacctttacttgtagtttggagcgccagccgcacattcaatgtgcgagcacgggtctgcgatccgaacatatcaccgatcgccttccatgccagcgccgcagaccttgctcctgccacttggttgagtatatcacgtgacagggaggagaggaggaagccaagcacctgctgatcagctgcaaaccactcctcgaaggccggattatccaccattactgtcttctcccccttttcgccttccttccgctcgatctgagctgccggcgccatggttttgccggtgaggtagccctccagtcatgccccgcgaacggccgccaggatctgtgccgtccaaatggcatgattttgtttggtgagcttttcagaaacatggacgccgaagagagggttgccggtggaggtggaggatgaagaggaagccatgacaatctatgccaataggctctgataccatgaaagaaaactaatatggagtaacgttatcggtgcggagaaaattgacatttagccactttcaaggatgggtttcgctgtaatgccattccgccaacttgcttcgctaaaatgccattcccacgctcgcgcaacacgctgcttcgccgtttttccaatttcaccggattaacacacaaaatcaggagtgttgtgaccaatgtgcccttgggtcattctttaggtcagtgagagaaaggggatcgagatgcgttggctcttgctcacggcggcgccctagatcgatctcgtcggcatcgccattccacccgccgccgcagtcacctctcgccctcacccagctgtagctcacggcggcgctgccatcgccattccacccgccgccgccgccgccgtcgccgccgtcgcagtcccaatctcgcgctcaccaatacttcaatcaaatttatcagcttatcaatctttccatcatcaactgaactccacttcatctctatagaaccatcaaccactgcaacatcacttggaccttcatcaacaacatgctcactcattccttcaaccatcttcctataactttcgatccacttgaaaaacttgcaacaatttggcacctatacatacatcagtacaaaattagccccaataaccaaaagcaagcaaatgcaacaaattcaaccactcacatcttgttcgttttcctcgcatttgaagaaaacctttccaccatgcctcatcgatctgcactctactactgcagcgccacacctagggcaacgaatgagaggaaggccgctagatcctacgggtagccgagcaggaaaggagctaccttgcgacatcccgaaatcctcgcttccagctgcataccttcgctgcatagcccccctagggttagggtttcctctcatctccgcaaatcagcgccggcgaaagtggcacagcggcggtggagcaaagcggcacagcggcggcggcagataagagcggcacggcggcggcggcgaagtagagcggcagcgttgtggcggagtagagtggcggcggcggagcaaagcggcacagcgcggcggcggagtagatcggcagagcggcgacggtgtagagcggcagcgtggcggcgcttgctgcttcatttggcacaaaaggacccccaggggcaatttggtcagcagacaactcacttacgggattaatccagtgaaattggaaaaacggcgaagcagcgtgttgcgcgagcgtgggaatggcattttagcgaagcaagttggcggaatggcattacagcgaaacccgtccttgaaagtggctaaatgtcaattttctcgtcggtgcgacggttcgtgttaattgtatcgtagcaaaacggcgaggaggagaagtacatatatgtatgcgtcagagattggttagccgggatcctatttacatgtaatcaaaacaaccttagctaaactaccggccacctaatctccaactcatatggtttacaatggataagcacatactctaacaggcggtagccatgaacgccagccctacacaagaacgctctgagcaaaacacaagaacacaaataaaaaagactacaagaatatggattctaatctcttggtggacgtccacccgttttttcgtgtcaactaaatggttatgaatttttttaaaaaaaattaacaagatagattaatatgtaatatatcactttacaaatatgtaagttcatatttgacttctacaagttgtaacaaaaaacttttttttaagttgtaacaaatatgttacaagaaacgggtggacgttcacccaagtgtttaaaacagtttccccatcttgctataatacttcacaatcggtgataatccttgttcttgttgatgcttctagttttgcaatcaccaacaattttttttttgttctggtccactgtcctcacaagttcagctgctagagaggccggtcagtcattttggtaattttaggcaggaaacaactgcataaccagcattggaatccatcaacacattggtgattttggtaattttaggcaggaaacaactgcataaccagcattggaatccatcaacacattggtgatctagtacactctgttgacacaccatgcatccaatcaaagtgatgagtatatctgtgttccttcctttacaatattgcttgcactggatctttcacagccacaggagccatctgtttctgcagaaccagatcgaaggggacaaaaaactatctgaatttccagctcaatccacagatcctagaaaacagacggccaaataaaactgaacaccatttgtcagcattttggtaaaggctctgaacttttcaggtgtaatgcaattcatggaaaggaaaccagaaaatgtccgtagttttgagtgaagcgaggaggaaggaacagagatgtgaagaacactccaccgacaatctgtgtacattttccattcgggtgccaatatatacagaactcctccattgatcatcttgctggtggcttaattaatatacgcaagcacgatcaatgcctcctgtcaacgcgggcacggcggcgccggactccggcaccggcagcattgccgcgaacgacggcgacggcgacctgcacggcgagcagagcaagctggtcgcgatctccgacgaggcgccaaacgtcgacagggcgctcgccaccagccgcccggcgaccgccgacggcgcaggcggcggggacgacgtctcgccgagactgcggcggcgtcagcggcggcggctgctggagatcaagaaacgtggtctggaggtcgaggagcagacgctggcgctggagcagcggcggctgaggtgggccgccgcggacgccgaggcgcgcagggaggaggacgcggagctggagaagatgcgggtggagaacggcgtggcgagggcggagaacgcgcggctgtggaggcggctgctccggcggcggcgggaacgggagctcggcgtcggcggcgtcaggtcgaacaagtgtcgcgacggcgctgcagcaatggaaggagaagagaaatctgtaccgtagtgtcatatgtttcttttctcaatttttttctttttcttttttctctgaattctagaaaaaaattgttgatgttttttttctcctcgaattcctaaaaaaaacaggtttaaccatcaccattataataaaatttgataactaaaaaaaagtactcctaaatctatgtcagaatttgatatatccatattcatttaccctacttaaaaattggtagtaccgaaattcattaaggccttgttcggtttagaggggatttattccacaccacaggtgtggaattattcccctccaatccctctctcacagagattaaactggacaaggcctattggaaattaaacatgccatgtagctatagagtaactctgggtgaaataattatacaagcttgaatgtgcaatgatgctttataaatgctactacctccttgtacaaatgtatgacgaaccaacgtcaaacgtaaaaaaatggagggagtatttacttatgttgtttatatgtattctcttgtggaatctcttagcatgtaggttcaatgtttccttcttcttagggatattgtttcccactttgtactttgtatgtagtttgtttgtgtgaactactccttaaaccataaccaattttaaattttaagttcaattttataattaattttgttcattgcttcatcaatcaatcttttttttgatccctaagagtaatataagtacaaaagtttgtactgaattatggtcggaggagataactgacctttagggacatacatgaaaatcattggtacagctacacgaaggcctttttaaaaaagttttaagcccatggatcatctgctaccatatggagtatttttcaggacacattccgtgtagtttattcggcccagattccaccaaatctcttattaatggtgcaaagttaaaaataaaacatttgctcacaatcataaaagtaaaaaggaaaaaatagacaacatgattataagccataatcatatgagaataagtataatgtctacgaaacactcttcccaccttcaactagtattacgtgcttggttcctagagcttgctagaagtaacaattgcgccaacgtcaaccgcccacccaaaataagccagaaaagaagcccgcccacccaaaataagccagaaaagaagcactcatattttgtggtcacgacaagaggtgtccacctgtcgacctagctacttctaaatgatcgccatcaaccttatatcgtaacaagttcaataacttgctacgtaaccccaccccctcccatctagatgaaaggggctcaataccgaagacctagaactccggtgaaccaatcaccgtttgttactaatccacaatcattgaggagagggagtggacctatgacgttgaccagatccaatctcactttgacttgccataaggagtaagccatataatagagaatcctccaagaagccttggaccctcggtttggaatagttctccctcacagttctcctcatgcgccattgtccgacagttgaatagagaacacactagctggatatcacaaagttgtcacgattcttcctttttacccctacgagttaatttatattacaataaaacttgtgaaattcagcctcttgttataggtggaattcgtttatacctcgcgtacatcgtgcttctaaaattctcaccaattaattactacattcgtcatccgttatattttgagacggagaaagtaaattttttaatgtaatccttgtatctctgtaacctttgttcttagcacagctaattttgtccgttagctctgtgtacattttttttagaggaagctctgtgtacagttggtttcttgcctacccgtttttttccaggccgtacgtgaaagttgcaactcatctatatatcctccatttgcacgcaaaaagcatacatactcgcacacggttcctctttcgtcctccactagtagcattttctatttatgatcgagtgaattcatccacagataggactttctcttttgtctctagccttagctaaaagtctaaagagcctcatcttttcgtttatgcttatacttatttactaaaatttaaattttcaaccttaaatttaaagatgattttgggcattttctatttatgatcgagtgaattcatccacagataggactttctcttttgtctctagccttagctaaaagtctaagagcctcatcttttcgtttatgcttatacttatttactaaaatttaaattttcaaccttaaatttaaagatgattttgggttctttcatcgaagtttatttttcagcctttatttttagatcgctaagacatatataaaaattttattcacaaattatttttcgtttacaaatatgtcgtttgggggtgtaagatcgatcgagtagttttttttaaaaaaacaaaaaacttgagtaagctagctaggcaggtggatgttgtattgtaccggtgtttggtgcctgacgatttaatgcgaaagctagcaagacgaccaatccttccaccctgcttttgtcgccatggatgatggtactacttagatgacgatcactgatattttgtcccagctcaaattttctacgtgctctattcacggatattgtttatgtcttatgtctatcacgccatggatggagtacgagtaccagatattgtttgtctagtactgattatagtttctagccatgcattgtttatcatcttcaggccccaattgatttttacgaaagacataaaaatttaaaggattttaatcgtttagaaagaaactacaataaagatctttgaaacaaaataactgaatcatatcatttcctttataactcctatgaaatagataatcctacgaatattttgaaacaaagttagcaaaaacttcaatctcttcaaagatacccctccgtttcaaaatgtttgacaccgttgacttttcagtacgtgtttgaccattcgtcttattcaaaaaatttaagtaattatttattcctttcatatcatttgattcattgttaaatatactttcacgtacacatatagttttatatatttcacaatttttttttaataagacgaacggtcaaacatgtgcttaaaaagtcaatggtgtcaaatattttgaaacggagggagtattcattttagtctttttctctcacccgatttttgtttttcttttacctaatcagactataattcttatgtttttctgtgttgtagataatcctacaaatattttgaaagaacgttagcgaaaacttctatcttttaaaaaaatatttattttagtctatttctatcactcgatttctgtttttcttttacctaatgagactataattcttatgtttttctgtgtttgtacatttatattcatgtgtttttttgtttaaaagagcacttagttttgtagctacagtaacatgcattctcccattaaatgttggccggtcaccaaaacggaatcgagcttcatgccataagaaggaagccggccggaagcgtagtaaatgtgtacgtgcatccatggacttcacctgtagtgctagagcgtacggtgagaaaaaccgggtgagatgttttttttttttgcgatgaacagggatatattactcatgctcagcacccaacaggtgagtgataaaattataagccagaaagtggttagagcctcgctacgccctttataagccagggcatggctgacactattttggttacggtgaatcttcatgataacaatatctctattcccagccatgaggtgccaatatccctattcccaaccatgaggtgctttatctccctagctaggaaaactagctctgatcgttcctcctcctttgactggatgagttgaattgcctgtaagcagtcagattctatgatgagatggtaacagcggcgaatctagaaattttaatttgtaagcctgagcaagcctaagaagatataatcatgtatttccccgcaaaaaaaatataatcatgcatataaaatccacacaactacatatagatagggttatatcgattaatatatatagtatgggagacttaggctgtgtttgagaaaggagagatagagaagattgggaagatacgcaaaacgaggtgagctattagtgcatgattaattgagtattaattatttcaaatttcaaaaatggactaatatgatttttttaaagcaactttcctatagaaattttttacaaaaaacacaccgtttaatagtttgggaagcatgcacgcggaaaacgatgtgtaatctatctccagtctcccagaacgaacgctgccttaatatattgttgcgttagcctctaatcactttgctaattgctttattaatcaagcagggtacgtgctagtacagagggcggagcccgggcaagtgcccgtacgtggttccacttccgcccctggatgtacacttgtacgtgcagaaagctggctgcccatgcgtaagattgctcatctccgctagctttggctaatcgcccccacacgcgcgcgcccccgcccgcgccgaagccacaagaaacgtgtttgcatgcaaggccaggccaggccaagcgaggccgcgcgcgcgcatcagctcgcgacgcgagccacctgtgccgctgtgcgcgcgcgccgcctggcgccacgcacgccatgcacgcgcgcgtggggtggaagggtgaactggagaggagagcggcgtcgcactcgtgaaaaccgaaacggagacgagacgggacgtacggcttggctttgcctactactgctgctgctgctctgctctctcctctctctcgtgagcaagcgtagtagcctcgctctcttttgcagccgcgcgcttggtgggagggggggattggggatgatggggagcaagtcggggaggccggtgccggcgatggtgtcgctgcagctgctcttctcggcgctgcaggtcttcatcaagctggcgctcaacgacggcatggacgcccgcgtcctcgtcgcctaccgcttcatgttcgccgccaccttcctctgccccatcgccttcctccgagagaggtcaggtcacatcccatatactactatgcccccactgtcctaacctgctttcttgctcttgttcttctgggggaaaaaagctcgaattaataccggaatgcatgtgcatgctctgtagtgtatctgtgtatacttgatgattgttagtatttgataatctcatgtctcacatgattattagtgctttcgtttacttgatcgatgatcatgggcttattgaagtttagttacagtgcacttgacgtctcagagtagactaagcttggttaacgatcaagggtttttttaagttttcttctttcttgttcataaatgtatttttctttcttctttatgtactattagttacgtgcatgtagttccaaataaaagggctagctcttagacgtttctcaactagatcgatctggccttgctgaaaaaccaagcgaactaagattttatctgaagtttggtgaattgatctctccatgtaaatatccaatgatcttttctggcttgcttccttaatttgtactctgctttcttgtttacttgtaccaactatcttacaatttatagtcacctgcaattttcttatctttcttctgtctaattttgcacatcacttatccttagttgcagtgctgattaagtagtatgcaattttttgctgtctttgttgcaattttagtttgtgtctaaagagatccaactaggttttcttaacgttttctgcatcatgtaaggggttcaacaatccatttctaggcctaaatatataattcatgctgatctcatcactaacaaacatattatctgagttgttggctgttaatgtggtagttgaaaatgatgagtggttgaaaattatgactagctatactgaagtagtaaagcaaacatttttctttctttttttatcatcctgcggaataagaatgaaggaaaagaaaccattttagaaattctatatgtaacatataaaccactccaagattaatagaacattgagtaatcatgtatttgacttttacatggcgagttaaaggcacattgcacctaacgacttttatttgtttgttagattctgcaattagtaatgataaatgttctgttgttcaggaagaaacgaccgcctctaaccatgaaggtggtgctgcaactattcttgtgcgggttgtttgggtaagtacttgctattataattcctaagttaaactcttatttcagaagttatctttttgtacaaacaggtcaatatccccccccctctttttttttgcttgtaattgcctctaactgatgtttttcaacacaactacatgttaattcaaagcttctttattagaagctctgtcatgttgaaggtatataaaagaaaagtcatgctgattgatcagaaacagatattgaatatatatgagtgttcacttttccttctttatgtttccatgaaaaaaataaattatgtgttgtgcattggtgaaaggcacttgcttcatgttaatccagttattagccttactgtgtaagtagtagtagaacaatgaatgtttatcatttgacagcagtgtgcccccaattcaccatatactgcatcacaacttatatggtatatcaactcttaaatatttcttggtactccgtaaatatttttccagtgattctgataaccaaagttcaaatgcagagttccataaacatttgtgtaaaatggatatattagtagtcaggaggttcagggtctatgttcatatttccttggtactcgctatatatttgactaggagccaaatgaagatcttacactatgtcaaaaattgagtagccgagttgcctcaacaatttcatccagatgtaaaatcttgaaacaaacgaaagaaatttataaactacaccaagaataataaaacttgaaaattacttccttcaaaataaatgatgcatttaccaatttttttttctgtattagatgtgttgaccacaataacttttgtgtccaactgcatacacaaggatcatgttgatctcgaagccgtcacctgagaataactagatgacatggcacacgttgcagcaggaatttttgtgccacggcaggaatttttttgcattgcataaagtgcgatggttacatgaaattggaactaaagcaaaaaagtataaccttttagaggaatagaataaaggaaatggggatttttgttaggtacaaacaaccaagaggttgtataactgctaaatctggacacaaagtgaaaatcacatatagaaaacaaaaaatgaagttacttaccttcattgatcaagaattatcctaacaaaatatatgcaggcatgtagcaaaatgaataagtccactagcacggactatgaaagaccttgatcagatcggtggtattgggctgtctaaagacgaggcttgaggggattaatccaatggtgaaattcttatggtgacgtggcttcatgtggtgcttgttttataacaataaatgacttgtagtgggtaccaattatataggtagtaaggataggcccgcacaacacatcacaattagtttcccttctaaattccataggaattgccatactctgactacccatgaatcgtgttgaattcacaattcacatggtacgcacaggttgtcatgaagatggtaattgctggacacactcatcaatttaggggcatcatactacaacttgtgctctactaacactagatttcagcaaaggttggtatacgcattcactccctgggaaattttggttgttacatatggccttcgattacatgtttatgtttcaaccaatcaattagtagaccactggcttacattttgaagctatatcgaaacgaaacaagcttaacattgtttctcatgcctaaatggcccaatagaccttcctaaagcctgagcacctagttatgtccttgacaacctggctagattgcctaattgggataggcatagtcaaggcaaactgttatcacagaaaaaaactttggttaattcaaaatatctccgaatgtggaagggtccctttgttgtgcaatatccttcatcttgaatggcattacttacctttcaatgtttgtgatttccaataatttagtgtagtactcattatatttaggaatttaaagcttcctgttgctcaaccgaaaactcatcgaacatctttagtacagtaaaagtgcatgagatcctctgtgcaatcagtgtggaacacaaatattgaggatgatattaaccatggcttggtagtttttctttctttctcttatgtagattactctggataatatgtgctacttacagattttctttctttctcttatgtagatgactgtttttctgattacacacttgcagattttctataaaccagaatctctatgtgcttgctataaagttgacttcagcaacatttattactgctatcagcaacctgacaccagcaaccaccttccttcttgctatattgaccaggttacggatttaccacttatagcttatatgtttaatttcaaggcatacagagatactccagcttatatctctgactatttctgtctaatattatcacctttgaatatatattacttcaagaactggctaaaagtatgttgaatttcaactacaacagttatgtaggagtattctttcagcagccagaacagtttatattttccgtcttatttgtaaaaaaaatatggatataacaaagccataatttttaagggttaacattagtttccatactgaacaaaacaacaggctcgagaccttaaaacttaagaaacctgctggacaagcaaaacttctaggaacacttgtaggcatgggtggtgcaatgttgcttacattctacaagggaccaaagatcatggtactcgaccaacttccccatcccaaatttgcccacctcactgaaaatccccagtcgcacccaatatcgacgggcaatcaaattataggatcgttccttggtataatcagctgtttcacctacgcgacatggctagtcatccaggtcataatcttacacttagtttcttctttcaacagtgcgcccactcaactgttgcagttctaatgtttggtattgatgcattttttttgccatttacaggcgaaagtgagcaaggtttacccgtgccactactcgatcgctgcaatggtgtgcctcttcggcgcacttcagtccacggtaatggcactttgtgttcacagggacatggagcattggaggttaggacttaacatcaggctctactcatcggcttacgcggtacgcggttcatccggcatttcatatttttcatggtaacagcatgatcgatccttacatttgttccgagtctaatgaggttagcacccttgttgattcaaccagggactcatagcatcaggctccgcgttccctctgctgtcgtggtgcctgcggaagaaaggccccctgttcatctccgtgttcagcccgctgatgctcatcttcgtcgcgctgatgagctcgatcattctcaatgaggcgttgcacctcggaaggtgatggccaccatttcctttctggattcatgcattgcagttcaatgtgtaatgtggacaccaattttctcatggcgagttcttgtgttgttctgctgtaatgcagtgtgcttggttctgtcctgattgtgggtggcttgtacatggtgctgtggggcaaagcgaaagaggcggctgatctgtctgaagatgaaaatcagggcaaggaatccatccctgtgaccactggcggtgagaatgaaatgaagtgaagagagcattgggcctacaggttgctatttgacagaaatgacagaaagatatgattctgaaattctgatagaaatatagaatgttcggtttggatcaggcattgatgtttctacatcgattcatctcgtgtattgtggacgctatcatttgtctgaatagtctgatactgttaatctgttattgccgtggatttgctgctattcccagatttgccttttataccctgtaatcttattagagctgtgattttcatgctactctcttgatcaggggcggtaccacccattaggcggggttgggcggccggcccagctacggcccgcgccgctctaaccctccatatccttcttgggccgcctaccacaacatccaattcacaactggcccataaataagcagcctaagtgtctaaattaatcctgcgtatatgatgctttcctgagtcaattcctcgacgctgctcacccccgccccctactatagttaggtgcctaatgtttttttctctctctcccttctaagcaaaataataatcattttattctaggtatgcgatatcttctcatatatttatgtggcggtatgtcatgagatccttcaaccagacctgccgaaaccatgcaaccagtaagggttcaagcccaagacgtcaagttcatcgggggcgaagccccccatggcgaagactgtgaagcaaagacggcgaagggtgaagaattgcgctggtatcccacaaggctgaaggcatcttgggcgaagactatacggcgaagagtgtatgacgaaggaaggtgacttcgccataacgagtccagcttcaagaagacccaagaggccatcccagccgctcaagcccggtggccattgggccaacgttcgccagtcggccctttagaggcccatatacctcaattacactgtatacccatgtaagtgtccctttcataagggcaaccatgtaaattcccctgtaaaacccaagccctaatagggaacatgtaataagattataaatagacccctaggacatgtaagagggggatccccaagaaaaattcaaaagataatacacttcaccgtttccaacaactgttgagtaaccacgttcttcgacgtacgcagttgtcacttcgacaacaactggcgccgatcgtgaggaggcgaactggcgcctgggtggatatattcatatatttattttttaaaagatatctatcaaccatgctttatgaattgactcatatttgcaaattgatatgtttactagtatctttttatgtatgatgaatatgtatggcgcaaaattatactttatttaatatcatttttgnttttgtttgttttaatttattgattatactatatgtttatatgattacaaacataaatatggtatttgttgtgtttagttgctcttttcaagcatttttttcaggaatctcagaaagggattcagtgaacagagagcactagtctctgacagaatgcatggggattactgtttttacaaacgcatggttaggacttcgagcaatctacagaggagaaagcagtaaacactagtgattacaatagtaaaaaagaactattactactagttgtacttctactctactaccagagagccgaaaagaacagcatcatgacgagaggaacggcgagctgcacctgcaccgtcctggctcgaggcagggtgcccatccccacggcctgcaaaaggcgtcaccaccaaccaatggagcaaattgcaaaagttcgtcgtcagtcagagagcgagctactaggctagaaaaaggtatgatggatgcaaagggaaaaggaaaagtaatatgagctcgcaaagatgcagcaagaaagctctgagaaaaaggtttttggggagttacaagaaactaaaagaaatgaaatgaatcagatgtttgctgggttgctttggagtttatcagaggaggagatggcattggcatccaaagaggtgatgaacagttgtttgattggttggttggttggttacctgctgctgttcctggccgggggtgggcatgggcaggacggtggcggagtcggtgacgccggcggggagcggcaccgccgggctgctgctgatgaaggccgtgctcgtgcttgccgccgcggcggcaggcgacggcgcgccggcgttggcttcagcacccgcattgcctccgggaagcgcgccgcgcgggctccgccgctcagacggcagcgtcggcatgtcgccgccgccgccgtcgtccgagccaggcaacggcggtatcgccggcgcgggcgcgggcgccccgaacggagccggccgcggcgagtagtccggcaccacgaccgtcatcggtaccttctcctcgccgtagccaccgccgccgcgaagctaacggcaaacgcgacacggcgcggtcagtaagtgtgactgcaagtgatcagaacacccaaaccaacacaacactacacgcacgcgcgccaacgcgcacttacctgttcgacgtacgcgcccgcgccgcgcaggtggaagagcgcgcgcgccggctgcacggcggcgagcgagcagcacagcagcagcagcagcagcagaggcagagccgaaccgcctcgcatatctttcctcattcctcgatgctcctccggtgtccggtggtggcgctcgtccgaaaccgcacggagggaaggacgcccgtgactttgtagcgcgcgcgggtggtggtgcgtgtgccgtcggccggtctgcccgtgtgcagtggacacagcgtcacagtgcgtgcaccgggtcgctgcaggctacagtacagtgcagcgcgaaacagcaaaagaaagcgacagtggattttaaactctccagagaaacggtattaccttctttgcgtatcaaaagtttggaagtttgcttgaaattggaactatgtgacagaaaagttgtttgggtatgaaaggtttgatgtgatggaaagttagaagtttggaaaaaaaaactttcaaactaaacaggacctaaatagttatgaaaaaataataaaaacatgtagatatactttacaaatagtatacaagtttaaattcagcttctacatgtaataaaaatagtattaaacgcctgcatagagtattaaatataggctctatgcggctaactctaatggtacatattgcgactaatttgcgagacaaatcttttaaacctaattgctccatgatttaataatgtggtgctatagtaaacatttgctaatgacgaattaattaggcttgataaattagtttcgcaggtttattgacgtattctataattagtttttttattagtgcccaaacacccctgcgacaacctatataatatccgatgtgacgcactaaaactttacatccctgatctaaacaccccttaggctcccagtatgtaaaacgaagcagcgtttaacgcgtgattaattaagttttaggaaattttttttcaaaaatagatcaatgtgatttttttaaacaactttcgtatataaacattttgcaaaaaacaaaccgtttaacagtttgaaaagcgtgcgcgtgaaaaaacgaggagaagaggttggtaacctagacaaacgagctgaggtttaatctttcttgttaaattttttcaatcttttagagcaagtttaatagtatagccaactaatagctctaatttatctataaccaatctaatagctcatttatacaatagttacatactacactattaatacatagtcccacctatcatacacacattgtgtcttaaagtctgtgctacaactggctataaatgttacccgttgtttttctctcttctcatttatcttcttaaaatatgtttgtagctgtcttatagcctgctattgtacctgctcttagggcacccacaatggttatctataagctatctacaagagaaccatgtcagcatattttcctacttggaagatattaaatggagagagggagcaaagctatctactaacttagagatagtctatagagaaaaacgagacaatgcataagagagctatagatacccatgtagacatgctattgaggtgatttattattaatctagtctattgctgagatgtatatgttttatagagagcaacttactttattattgcgggtgctcttattataatagaatagttaccatagaaagcggaaaatgcgaagcaaaaagggcaggaaaggac

SEQ ID NO: 51072 - DNA, 2795 bp, Oryza sativa
agcgatttcggaggcagtttcgttctacgtggcacttacgtgacggtttgacttagtatttatcccatgtggcatcgacatatcgctcaagtggtactaaaataaaaacaaacctaaataaaaaaataaattttgggcacatttgtcagttcttcagctcctctctcttccctctttatactcgacgtcgattgagatggagagagcaggagcagcgagaactcggcggagcgacgggagcagcaggacagcgggttgatggcagcatcgacggtgttggtgtcagcaaccgggagctcggcagagtggcttggcgggaacagggagagagcagaggtgaggaagcctcgccgccgcctcctctcctctctccttgcctcccccccggtgtcaccggcaacgaaatgcgcgtcatcgttgtggcagggattgaggtggaggcggagaacaaggtcggtgttgggaaggagagcggaggagaggaggcaacgacagcgatatagggagctggtgaacatgagagggtgctgagccagcatggggagtcgttccctttgccgagatcgacgccgccgtgtttgcacgccatttgcagtggatagctcatccgctgacctagccgtcgaactcggcggcttccaccgttgtcctcgccctctaccatgctctgtctcgccgccgctgccatccactgtcgtctgccggttgatgccattcaccatccaccttagaaagagaaaggttaaagaggagaaaaggtagctgacacatggaccctaaatttatttttattattttattcattgacatgtgggtcccatttaaggtttgttttaattttagtgccatgtaagcatcacgttgatgccacgtggtataaataccaagtcaacccgccgcataagtgtcacgtaggacgaaaccgtctctaaaaccacttggggagttgatttgctatggttttgagttggaggatgagctatggttttgaaagttggaggatgagttatacccggtttttcggttgagggatactattcaaccaggggtatgagatgagggaagcaaaacagacttatttcgatactcttatggcggatcaatactatatcattagggagtttgggactttgggttcgggcgcagcacggcagtaatcatcttcctgatcatacagcccaagggaagaggagcccatgtgtaatcccctagcccaactaaccggccgggcctttgttgggcttggcatagtgtgatgggccagaccagttacgaccaaatccaaccagggccctcacatcctgttttgaacttaggcaggtttagcataattttctcgtaccctcgtagtatggtagtttgttcggataagatcacaagactgcatggttcgtggtgaatttgcatacaaggccaacaaaagaggaaaataaaatcatgcgagtagtctctcatgctaatgagccgtttgtgattaaaaaaaagaaaaaacaaatatcgatccatatggttcacgattacaaatgggaggttaattttctctaaaaaaaacgctatcatatactccctctgtaccaaattataaagcctatattttttatacagtcttcaatgacatattttgaccattaacttatgacatgttatatttttaacaaaaatagaatataaatctagtgatataacatgtataatatttatcatatatatggttagtataattattacacaaaattatcaagtttaatttttcttaaaaagagcgcgccatataatttgggacggaggtagtataatttcccaatttgatcatctctcaaaatcgatctacccggtacacccatgctgctccgcctcgtccgccctctactccgccgccatgcacgcggcggcggcgccggcgccgccgcgagctctccgacatcgcgtacgtacgcctcggccaccggaagcactagtggccatctctacttggtgctggatgactggaaggaggggtacagcctgcacaagctcgatctcaatgccaactccggcgacggcggcgacgacccttccccgccgcggcgcctccccgcgcctctcctccggctaggtttccggacgctcggctcgtggccgcacatcagcgccctaggcagcaagatcatcttcatgggtcagcgccgcccagatcagttccgtgtcgacggcggcggcggcgacggcggcgcctcatcctcgtctacgacacggcgacggcggcggtggacgtctcgcaccatctcccggacgacatgcacctggtgaccagctacgacgccgtggcggacgccgggaagaacaggctctacctgctgctgcctcagttcgagcggtcgccgtcgccgtcgccgtcgccggagccgccgcgccggcggccgccatggccaggggcgccagaacgcggcgtggacatggcgccctacccctacgttgagaaagtggagagggtgaaggccgggaccaggctctacttgctgctgcctgatccgtttgatcagcggtcgccggagccgggccgcgccgccgtgggcatgccctaccttgagaaagtggagaaggtgtaccccaaggaggaggaggagaaaccggcggcgcgcggcggccgtggaaggtcgtacggcggcgccggcgacgacaacgacgacgacgagaaggacaagtactaccgcaacagattgaccgagcggtggtcgtggcggaccagcacttcgccgccgccattctccggcgggaggcgcatcacggggcacgcgctgcaccccgacggccgg

SEQ ID NO: 51073 - DNA, 3829 bp, Oryza sativa
ggccaaaatccccgtgtgctatcccggccgggtcgaattttcttccgtggcccatgtatgcgttcgcctgggccggggtgggagtaattctccaccgaatccacaccaatcccacggggagagaaaaatcgcctcggagacgattttttttccaagccagccgcagcgctcggcctcctcgactcctcgctgcgctagggtttggaggcggcgcgaggtccgggaggcggctctagggtggagatccaggagcagcatatctccagccgctgccgctctccatcccgccctcggtcgccgacgatctccatccagcttcagccgccaccggtctccatcccgtcctcagccgccgccggtctccatcccgctttagccgccgccaccgctctccttcccgctctccatcccagccagtcgccggcgctcgccatctctccttcctcgcttcggattcaccggttgcgggagagggcaaggtcgagggcaacagcccggacaccaagaagcaagtctgattcttgatctcctcttttcccactcagaaaagattttgtgacttatctagtggatgaatttgttgctagttgatgtattgagtggctgtatggattgaagtatcagtcatgttctgcttagaaggaggggtgatgtggtttgtagtagtagaacctgaaaccacagaaaattccatgcacatctctatgtgtgtgcgcaaatcttgcctatcagttgctctgtaatcaaggaaatatatatttgaattggcagatcctatatttctgaacatgggctctcttctttcttttcttttttttttgtgagggagaaacctggtttgttgattctccaggaattattgtagatgcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaattttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagttttaggaaactgggtgttcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccttgcatatttactagagtaacagaagtaatttgaagttggagagagagagagagagattgtaggtacaatgttatgtgatcttgctcaggtggcagatggtctcagtttttttttgctagtgaacaggaggttgttattttcaagtaaacatcctaccctagaaggatatcctcactttattaaagttgctatctctgaggtttaaacaaaactaagtacacaaagtacttctggaactagtcaaaatctgaacacattattgatccccctcctcccattgcaatctgtttatttgctgaaagtattaaaagtatttatgcatgtagccaccttgaatgcctctaatttcatgtttaataatattgtaatacatatgcatattattatgttctcacacatagtttaaagtatagtaattctatatctcttttagtgataaaatcagttcgagaatggcggatgaaattaaaaggaggagagaagaggacgatgatatgatgctttttgtttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgcccacaatgcaagctttcaagatctacagtatgaattcaagcatagtgggtctacacttcattggcatattaagtctattttcaagataatcccagctctcacctatagatttctcaagcttcctcatgccgaccaaacgcattggaagattagaacaaatcctcgcttctttccttacttcaaggtgaatctggcactcaaactagaaatgaatatctattccttttccaattaaataactcatgcatattctgtccttttcttccctttttgctgcaaaattgcataggggctattgatggcactcacatttctataactatagatggagagaaggcaactccttataggaacagaaaagggactttgagccaaaatgtgatggttgcttgtgatttcgacctaaatttcacttttatctcatgtggttgggaggggtctgcaaccgatgctgggtccttagatcagcaatgaatagtggctttcaagtcccaaatggtaaattttttctagtagatggtggttatgccaacacaccacatttcattactccttatcgtggtgttcggtaccatctaaaggagtttggacgtggtcatcgtcgacctagagactacaaggagttattcaatcatcgccatgccattctgagaaaccatgtagagagagctctaggggttctaaagaagcgatttcccatcctgaaagtaggcactttccatcggataaagaaccaagtgcggattccagcaactgctgcggtgttccacaacatgatccggttgcctaatggtgatgagggctggttggacaaccaacctgataatatagaacctactaattttgtcgatctaccagaaggtgacagtgaataccaaaatgatgtgccatctcttagcaataaaatgatcagtgggaataatattagagatatgattgctaagaagatgtgggaagattatgttcgtaactagcaagaatagtatagataatattttggttttgcatgatttgtatttatttatgcaatcaacatttatgatatggacaaattaatagtaagcaacgtagtttgtattttctcattcaataaaatattgcaatatagttatgatgtttggaagactatctccgaaagcaagcctattgcagcagcaacaaaggcatctacaaaagaaggcatcaccaaagagctgtagcatacagaagaagaaggtttctccaaaaggtagtatctaacttgtttttttgtgaagtattttcctttcatattaatgattacaaattttacttactataatctaattttgtctaatagcttaacaatcaagagcttcatggaacccgggactagaaaaggctttagttgatttacttcatgagcacaataacccacattaccggtgccaaaacgggtggacaagtgaagcatggaacaaggtcgtcaaagaatttcgtgacagacatccctatgtcaccatgaataagcaacagatccaagataaggagaaggagttaaaacgagattataggttgcttaaggaggcaaggaaacagagtggagcttcttgggataatcaacggtgcatgattgttgccgatg

SEQ ID NO: 51074 - DNA, 8404 bp, Oryza sativa
  unsure (1)..(8404): unsure at all n locations
actggatgtgcttaagcaacaatttgttgtggcgtattgtgcctaaaatagaagggatgtcacaagacaatagttaaatttttagtccctattactccagcatcaaaatactcaagattttgtaagtcatacaatagagagataataaaatcaagtaatggacatgcatgagccatctaaactatggatttcttagatctttgtgtgaatcaatcatgtaatgttattagttattatgatgttatattaattaccaaatacatgtgcaagaaattggcatgaacaggaaacaatatgcaaaatttttgtgcaaggaaagaacaaagaagcatacgataattgatcttggaaaacaaagaaaatcatatagcatgtatcaggcatatgagccatcatgaaaggaagaaagagaatataatccacaaatctatttcatcgcatttttaatccaacataaaactatttcatgcttttctcatgatctccaaatggttaagggatgtcccacaaaatagccaaaaagaaaaacaggggcaacagaaatgttaatgcaaccgcattaaaactttgataaacccatgctacctgtaggtcagacaataccctttctttcttatttgacatcctagaacccatgttactttgaacatcaatacatgagaactcgagattggctatacgaaactgtaacactaggtatgtacccgagaggtactctcataatactatatcaatatatagctaatggtcaaagttacatcttggaccgtgaaaggtcaaagccatcaaataaaaagaacgggtacatgtttctcttgtgttactaaactagaagtagtgtaagacggtgataatgtaagaatcctgatgggtattgtggttcccactaaatcacattgtttttcactttacgggtgtcggtaccccagatagtgcgctatgatcagttggcacccatccccatcattcccaccacttctaatatcttcaaataacagacgcagataaaataaatcaagttgacgtacatgagaaggaagaacaatagatttagctttctggtactccctgacagctaggtcatattctccttttctaatgttcccacgaattgcacttggcaggttaaataatgtccggaatctctgaagcattccttgaacagatctgatcttctcagcttgggcctgcacaacggtttacgttaccgcactcaagaattgcagtaataatgaccatgattagtgaaatgaagttctagagaaaacttagttggtatacctgcctctcaaatagaggctcaaatgcacggtttgctacaccactaattttctgggtgactgagtacaagtgagcagttcctgcaccttcgggatcttcctctatctgtctcagctttgactcaatatctgcagaaaaactcgcggtattaaaaacaggtgcaaaaattaagatcatgagaattatctacaacagagcagaagaagaaaaaaaaggaacagataccatctatcgtggttttgcacgaaacaaaacaatcaaagttctccttgactaattgttttttctgctgtgttctccctttgagatcagttttcaaggtaagcgcaccagactctaagtcagcagcacttgtatctttgtgaacccacgaaagaaaaaccttggggtcaaaattcggagaagaatatataactttctctgcaaataaaaacatacccttgttatggaagaacagataacagaatgaaataatatgtatgaccaaaaggcatacctcgcatactggggtctaaaccctgagccttctcccttgaaacaggagaacttactgaagcatcagtaattaatcgcagagacttattatcaatgactctggtaagaaaataaatgctattaaaacacgaatatagagaggacattggattggtaattttaattctccatgataaagagcataccacacatgtactaggtaatgcagagcaggacattattaatatatatgaggttaatacttgttgctgccaaaatatattgataatacaaagtttgatgtttcagtaaggttacgtacagctcactttcaaaaattttagaaccagtgaatgtgtttgctatctaacatactatcaatgtatgaggtgattgcattttataaaatgtttatcaagtggtcaagtggtacattaatgtggaaaaaatatataaaagaagatgatgcgtgtcatgtattgaccatgagttttgtgatccagatagttacccaaggcccaaagggtccagaacttctactcctctaggtaaagtctgtacattggtaagtgccttccgagttgctgcagcagctgctttctgatcaactgtaggagctgcccccccttcacgcatttcccgaaccctgcgagcaagctgggtggagcaaaggcagactgacattaggcatattcagtacaagataacatgttaaaacagatgtttgtatttggtgcatttaacatctaatatggagaatgcagatatgaaatgatacatgaacaaatgcaacaacagagaaaatgaaaagcatggcattcaatttcaaacaagctgagagaggaggtttgaataacatgaatgtgcagctagaaggaaatcaaaatgaactataccgaaagagtgtgccaacagtaatgcacgctgcacaaatgcaattgatgtgatgaccaagcattgtgtgtcagaccagcaaacttgtaaaaatgttgtctataagccattaattaatcccttatacctccatatatcatagtactacacaacatgaatgattgaaacacaccagtacccagagttcacaccaataggcaagtcttaggaattaacccaaatccccccccccccaggcgacccaacaagcagctccactctgcacaccacagctaatttgtgcgatccccagaaggaacagaaacaaactgatcaaaccagcataaatttcataacctacactactagctaaatgcactcaaccacgattctgacatgttcataacaagctactcggctcgctgccttaacaaacccgcgagaccaaccaaaattttcggatcatcaaagcacgcgacccccaaaaaactagcacggaagacgagcggccgagatcgagatctcgccgatctccccccacatacctcggcctcgtcgacgcgcttccagctcctgggctcgtcgtcgtcgaaatccccatcatccctcgacgcggcccgccgtgccccggcgcggccgccgccgcgggggggcggggggccacggtcacgggaggagggggcgccatcctcatccccggaggaaatggacagcatctcgacctcggagtcgtcgtcgtcgtcgtcgccgcctccgcggctgggctgcctcgccttggcgggggccccttcgccgcgtnctcctccgccgccgncgcgggaggagttggcaggggggcngacgaagtgacgacgggcttcccggcccccgcggggcgctggtggctgaggtcacgcgccgcctgctcctgcagcgccatctggaggagctcgtcctcgtcgacgtcgctgtcgctcgccatgtccggatctgggacgaggcgacgaggggggtggggagagagtgatgagaggggagagagagggagagagaggcgaggaggtggaggaggagagatttcgctacggagttttgggttttctacttttctatatgcaggtgcagctgcacggaacgggggaccgaacggcggttggatctgcggagcattccgtgctcgcgctctctgtctctcggtctctcgtgtgcggctgcgtggttgtctggcctgtttagatttcgtttcgtttcttggcctgttttaccggcagccgtggcgtactctagcgcgagttcggttcggcaggggcaacgggcgaaaacgcgcatgtgaacattggtgattttacggatcagcagttttgctgaccgagcatcggagacctttgcgtaccggtccgcgtgtggctggtggtttgcttaccagactcgtcttttcgttcagaaagaaaaaaaaaagtatgatttacttctcaactatcacggccgccgatcgaattatccccctaaatcataaaaccaaatattttataccctcaagtatttataccggacaaataacctccctaaacactgttcttagcagtttagacttgagcttatacatatggtgccaacatggcaatctagtcagcaaagaaaataaaaaaaattccctgggaccacatgtcatacatattcctcaaccaaatccctccaagtcccccttcgcgctctctctctctctctcgcgcgcgcgctcaggtgaccggaggcggaagtatctctcgctcaggtggccggcggcggaggcggacctagcggtggccggcggcggaggcggacctagcaggggtgggtggcggcggcaaagcgagctcgagtggccagcggtggaggcggaggaggagcgagctcgggaggctgccaatggcggcgaagcgagctcaggtgggcacggtagatatgctactttgaccaacgatgtttataaaagtaagatgttttaaataaaaagagttgcatattctgatagtttgtttagggtgtgtttggataatggaaaatgaggagtggaatcgggattgggaaatgaatgaagggttaggattaaatgggagagggggaatggatggttaggatttaaatatgtcttttggtgggtggaaaattatttctctatcctattagccaaacattgccttaatgataaatctagtaacatcaattttacatgattaatcttttttatatttttactattaatagtcaaggttactaatatttgactttgacactatgctaaaaatatttatattttgggacggagggagtagttgattttagggggttttttcaccgaagtttatttttcaacctttacttttatatcgttaagaacacgtatataaaagttttattcataaattatttttgtttacaaaataaaatggataagccaaatgatggggattcatgtgtgtgatttagagggatatcnnnnnnnnnnnnnnnnnnnnnnnncaaattttaagtatgtttgattgatggataagggtgaatggagtggccagataaggagtattcaatgaagatggtggataaccttatctgataaaattggtatccacttttgctaattttgatcattaatattggatagaaaaaaatgatgtgtgttgctctgagaaaaattaaaattaggataaacatcgtatgattaaattggtaaagcatttgttggtctacgatctgaaatgcgggtgtatccaaaataattagagcttttgtttggcgccttgcgcaagatagtcttcccatctaggttaacaaagctcaacattagctactactacctctatcccagaaagactgcagtttcacactgtttgtgtccagtgtataaccgtctgtcttatttgaaaaagttttatgattattatttttgttgttattagatgataaaacatgaatagtattttatgtgtgactagcatttttaattttttttcataaatttttcaaataagatgcacggtcaaacgttggacacagaaatccacagctgcacttaaatggaatgggggtagtaatatatagcatttgtgttgttttgtatgtttagctgcacttaaatgggatggggtagtaatatatagcctttgtattgttttgtatattgaacatgaatgtagctattatgcagtagtacaatgtgcaaaggtgatagctttatatgtcttgagtaatggcttatcaattatcatagagacaagtgagttttactctctatgtcccaatatgagtgcattctggtacaatgtgtgacatatcctagtactatggatctatgcctatatatccagattcataatactaggatatgtcacatcctggactagaatacatttgtactaggacgtcgtctatctagattcgtaatactatgatatgttacatcttgtactataatgcacttatattggaatggatggagtatttactttagacctgattggttacttgtattgcttaattcaattccgtcttagttgacaatataaattatcttgctgctttgaagagatggttcttgcaaaatggtgcagtacacaataaatgagagagaatggttgttagatctcttatgtctctactaagttattgcgatatactttaataggcgacgatttctaacatagaaaaaaaaactatgacgattatgaatcaatataacataatgccttgtgcagataggacacagtttggacttccttaaattcaatggtacaatcaaacactattggatcttgacctaaccttgcatagttggatcttcattatttccaaaacattcactttggtcttgatttcctgtttacttttgtttgccaaaacatgaggataccattaagatcgttgtaagacacacttttatcgtaaaaaacctacatatcaactaaagagattaactagattcataataggtgtatgttctcacattcttgttcgatagtgctcctcacgctcggggatcactcatccatcttgtcttttgattcatctatggtatcctttaatatcactcacttacttagaatttaacgtcattaagtaggaaaataatattacccgtcctaatttataggcatgtaaaaaatttattagggagatgatatggaaggaagtttctggatgatattcccgtaaataaatgcacgatgcatgcataagattaattgcggtgattgatgcgcgtattatgcatggagacggtacgtcgttctaaataattccatgcacccacgttaggggcttgcatacatgtgtatggaaggggttaatgaagtgtcacacgcacatacgaaatgttagggcgcacgtgtatgaatgccgatgaagtgaataatcacgtaatcactatatgaagacacgcctcgtattatgggacaatgtttttgtgagagggactaaagtttagtccctagtttccaaacacctcctgaatagaactgcacttacaaaatcctataaatttctttgttccaaattagttttaatgttggtgtgtgttgttcttaaaatctatcctctcttcaaaagaatctggactagactatgtttagattaatatagttaaaacttaaaagttgatcttcagtcttcctcgactgaaggagcagtcctaaaccgaatcagaatgcgacctgtcgcaacacgaacatcgtattcgcatccaacggcatcgtgcgcaaatcagacctgaagacggatccagattgtccaaaaccccccaaagcaacaaaagaaaacgtccggaacgtccaaccggccaccccacggcctaccacccccagtcaatgacaagtgggccagactcaaacccgtccccacaagtcatcgactactatgacggcatcctaccgccggcgtccacgcgcggcagatcaatcccccccatcaccagcaggcagcagcactgcagcagcagccgcgccgcagccgaacgcatctctgacaccccagagaccccgcgccgccgcgacgccgcccctacaaatacggccccacctcccggatcccgatgcgacaggcccgaatcccgagaccttctccacctcgcgtcggctgcggtaatcttcttcgcctctgacagagagagcgccaagccaaaccccccgcgcgcgtgctagggtttgggaggagccccccccggatcgatcctggatgggggatcggggggaggaggaggaggaggagctgcagatggcgctccgcatgagcctccagggctcgccgccggcgcagcagcccgagccgaagcggagcaagccgcccccgccgcccgccgaggagggggtggcggcggcggacgcggaggcggaggcgcgccgcaagcagcgcgagctcagggcggccgccgccgagaagcggctccgcgcggtcgccccctcccccgccgcggcggctccgcggccgccggccccggaggtggtcgccagggaggtggaggtggaggtgaaggcggacccggggccatcgggggtatctatggaggaggcgaaggcggaggaggtggaggaggagaaaggggagcggttgcctacggacgtggccgagaagctgtggctaatggtgttcggcaacaagcttgagaaggaggtgttggcgcagtggagcaatcagggcatcaggtgagctcttcttccttgcgttctctactgtctctttctttcattttgtttgaacggctattacaggagatctgttatcttttcgatatattaggggaagaaagggtccggttatagaaattcaa

SEQ ID NO: 51075 - DNA, 10384 bp, Oryza sativa
gatgctttctatttctgatgatgagtataaggatggacgtctggaaatgaccattaggatgttaccctgaatccttcaggatctggtgcaactctaggttttagtttgcatgaacagttgtttatgtgtgtgttagacgctgttgattcaaggttatatttatgttagaggttcagactgagattgtagggtaggaaataagagctatttgtggtgcttgtggtttgtcagattggcaactaggcttagcttcactcaagagtatcgtctatggcgggcagttaataaatattccatgcgcgggaaatataaaagcactcaatttttctattttggtcacaaaatagatggcttggtaaaagcttaatgagttcttttttcactggccgaaattattattcatgaatactgaccatgcgtggcagtagcagcattttactgatgagattagatcgagttatttatttcctttattgttagagattagaccagatcagcttcttgaaggtcaagttatcccatgtatataaggatggggattgtatttctacgtagcaaccaaaaatctatagacaaatcccaacccctatacttccgacgtggtctctcctatgacatattctagatctattcctccttcacctactgcagttcacgtcaagttgtctccatccagcctccctctgatggatgtctacccttacgatgcatcattacccctattattctttctccataatatttattactaaactacacaagttgacccctccttgcttttccgaggcagttataaagggtaatacagctgttttcttgtgtcgttttctcacctgcttaattgatatgaatggttaaaacacaccataaatcgggtttgaagaatggtcatagtagctggtgtaaacttttttccttttgcggggttctcaatgtttgtaaactgtaaaggctgaaaattcattcttattttttctttgtagtcaactattgctgccatacataggctgttggtgtttttgtttgtgctttcagctgatgatttgaagttgttgatctggttcataccaatatcagaattggatgttaaatgagaccatgtgttttctttgcagttacggacaatgtacatgtaatactaagttcaggctttaaaggatagctcttgttccgtagtatttgtgaaaacaagagctgataggtgttacaaattttactatcatccatatatgcgttgttaatgggttgatttgaggcatctgaaagtaggactgttgtggtattgaacatatctgtatgcattttttttatgtgtagaagttttttttgtagcacaattacacaacgaatccctgtgcctttggtagaatgctgtctgtgtccacctgtttagaatggtgctaactactgatgggatgaagtgtgatattttcagccctacataatccacataaggaacacgagaagcagctcttagttaatttaatctgtcattctagtccctgactggttagagctgtacagcaattgactttgcacgttagatgagaactactacagcacattttaatttagatgcaaacagttgcttggatatggtacagtgttaatcatatcatgccttttgttgcacaattcaatgctatgcaattaatctgcttttgtttaattattgttaaatgaacagatttagctctgatcctgaaacaaccatgggactggtacagcatgaaggtggcccttgtggtgtcctagctacagtacaggtaccgctcccttgctttacctaaataatgtgattaattaattgtcccttttggacagaaatgttaatctttagttccagtcttcttctgaactcagatttccatactgacttcatatttattgttacttctttctcatgctgtgacatgttttatcagtttatttgtagcacataagctactaaatgcatttgagaaacccttctaattgctgcaactaaattttaatacacctgttctgtcaacacaagctacgtttagtggacctttttggttggactgcctgtacatgatcctcacaactcaaactggacctaagcaacctgtctagaacactagataccaatgaaagaaattcaaagtatctttgatgattcaatgtacaaacagatatatgttagtaggagataggctggacttctctgctgtttcattagatttaatagaaaaatgctatttaaaggtaagtagcttttttagatgtttattttgtgtggtcaccttgacctgattttaattcttttttcctgatttgtgacactagtgtatcgctatctgatagacagacacaagatcaaactatttcttcattatttatttctgttttctgaaagctcaacatttctgatggtgtgtttcttaatgcaggcctatgttcttaaatatcttttgtttttctctgatgaattgggtaatccggaggttagtgatccgttttatgccctgggacaaaggcgcttttatcagagctcttttgctgcgagggatgatttttcttctctgactgatgacagaaagatgaggtggtttcttttgctccttttagataatactggtgtcagcattatcttttgattatttgtccactcaagttcatattagggattgacaatttaaattttagccaagaaaacataggcccttgttttaccaacagaactcttttacaaatgaatatttaaatatttattggaacaacatcagtgttttatatattattattggaatcgtaaaatgcttttagaactatcattttcctcttttccttttgttatatactatttcatttataatgtacaatcgatattctaaatgtgtcacgaaatatattcatggtgcagaatatatacagagtagtgcttccttaatattctttacattaaaatgactgctatcaaattcctgtcatttgttagagcactggttcatgccatgctggaaattctatttttatgcggaacggggaacagagcagttgtagcaaccattggaagtgtcaatgaagcggtaagtggacgtgttgaagatcaggtgactcgagttttttataccttcatcttcgacatgccagtgatactcttatgaaacttattgcagaaaactgctgcagtcttggaaggcctttctgttgactcagctatggatctgcagaaagttcttagaataagtacatttacctcaaggaaggatgcattcaacagtcttatagcaaacatttctttgtttgaaagtcgattaggagccatgctattccttatatctgctcttctctctcgaggattggtatgcctttgtttatcctttagttctcaactttttatgcattctgttaatccatgttcaataagtgaacacaacactatttaaatctgtcagaaatttcatgtacatgccctggcataaccaccaatgacttttgcatgctttgatattacaaaatcatactacagttaaaattatcaacatagtaatataatgacagggaaatatagattagttgattggtctagaatgtggtaatgataatgagtgttacataggttagcttttgggttaattcagttaggatcttatggacggctagtttagttctgccttgttatctatgaaggtaatttagttatgcttcctacttctcataagaaaacagtattttttttctatgattgccatcaatttgtttcttccatttgttttattaatcgtcacttcttccactcattgatggtcatctcaaagcatctcgatattatcttcattttcttgcaatttatacgtctttgtacacaggaacgtattcaagcggatagggatgatccaagcctaccattggtcactgccccatttgggcatgcttcacaggtatagatggcattgacatgcagatatttatttagcagagtagataataccgtgtcagttcacactgccacatactcttgcaatgtagtgaagtcactttggtaacagttatattgagccaacgttttcgacccaaatgtgactagtgtgatttttgcaggaagttgtgaatttattgctatgtggagaggctgtgtcaaatgtatttgatggcaaggtggactttggtggtggcatgttcctgaatgggataccaaatgatgttgaagttggtttccttacccttctggaatcactaaacttctgcaaggttggtcaatacttaaagtgcccgaaatggccaatatgggtggtaggaagtgaaagtcactactccgtcctttttgccctaaatcccaatgttcaagaagagaatgagctggaagagcgggaatctaaaataaggagggcatttgatgcacaagatcaaagtggaggtggaggctttattagcgttgaggggttccaacaagttctgagggacactgacataaattttccttctgataagcttgaggacctctgtaatgctggcattatagtatggagtgaattctggcaggcgctgctacaattggataaaagggctggaggcatgaaggatcctacaggccttatgggcaagaagcaattcactatctaccatttcaatggaatcgcgaagtccgtgcttaatgggaatgctaacattggaggttcaacaatacagagacccagactgtgcaagttaaatgtcagtgtcccgccaaggtggactcaagatgagtatctagctgatgttgtaagcgcgtccaccagcgggagcaaggatgacagtgttctttcacttgctccacctgttcaaacttctcagcatgcaccgttggtggactgcattagaacccgatggccacgggcagtttgtagctgggttggagatatgcctagtattgtctgatgccatgccgcgtgctagtctgattttaaagtggctattgcagagcaggctgcttgagcttcaaggccatgagggaaggaagccgcgaaagtgacagctgctcctggactcctggtgttatcactgttccagctgatgaatatatgatttttcttggttgcgtgaatgatcctttgatgtaattttatcagggacccgaacattctttttcctataatgacattagctgtatactccattttatgaatatgttttcagttcaagatacattcttttttgtacacacacacctgtggttctattttaaatctgatagagagttggtgactgaagttcgctgtagttttttttttttttaatttcctcttttgggttgaaacccgaagtcatgtgaatcaagtgaattaactataatcaaatgccagtttttgagggaaacatcaccgtcatgttattacggtaatttcttctcgttgtttcgttcctttttttattctctcagctggaaaaatactactactccctttgttcttttttatgatgttgttttagtttgtttttcttatgatgtttagtttgttcgtcaaacatttcaaaacggaaggagtactctgcattcatatgcttcctctgtagtttgtgagtattcatgtacttcctatgtagtttgggaacttgcattttatttttgagcagtagtggaataacaactaatatgccgtttttttaatgtataaactaacctgaaaaatatggaattacagaaaatgagtttaatcagtgagaaaacaaaactgggttcataaattaattcgacccatccagtactccctccagtaaaaaatatttcaggtcaatgaatttgattcgaggcagtatcaggctatcagctttccttggtgcatttttttagacgattttttttctcgtggaaacagcagatgattttagcgccttctttcttcgaaagcgtcatctcctggttggcagtgcacttcccctcctctcccgaaagctgtcttgtttgcacgaaagcgttacagagctacggcggcgagcaccggctccaacccctcccccgtcgccgcgcccgccggcgatgagctcgccggcagagccccctccaccggagcacccccctactccagctccagcgccagcgcccgcttccccgcctccacaccccgccgcctcaggcaatgaggccgccgccccaccaaaacctaaccccccaatcacacccgcgcctgcccggaatgcctccgccgcgccgccatccggatcgccggctaccgccgccgccgcagcccccgtgccatcccgaaaggaatccgggtctacatccgccgccgcccccgcggcggcgacccggaaggcctcgggggtagccgccgccaccaccggtgtgctacctcggaagccccccgggaccactgcccccgtcgccgcccggaacatcccggcgaccaccgcggcgtcccggaccgccacgagggccaccaccaccactaccgccacctcggtgtcccgaaggcccgccgccgccgccgccgcagtggcctcccgaattcccttgagggcaactgatgccacgacgacccacgcggcatcccgaaatcccttgacgggagccgccgccgccaccgccaccgttgccgcggtggggaggggcggattccgggccgctcctacacgcccggaggagtacacgccgcggatggggatggagttcgagagcgagcacgaggcgtacgagttctaccgctactacggctggaaagtagggttcaacgtccggaaggagtacgccaacaagagcaagaagaccggcgagatcacctcccggaagttcgcctgctcccgcgagggctacagggccaacgtcaagcggggcaaccacatggtgccgatgccggactcgaggaccggctgcaacgcgcacctcgtcatccgccgcaagaagcccggcgccaagctggaggtttacgccttccagccgcggcacaaccacccgctcttcgctacatcctgcatgcccaatcctctgcagcccaatgtcgtgcactggacgacattgcccgatgccgttacgccgcctgatcttctgatggacgggggtgaggtgggagggcagaattctaccgaagagaatagtaccgcgagtgcaggggaagggcgccggcagccgctgcgaaccaggaggcaatgggagatgaagtatggagaagctggtgctttgttaaattattttcaagaccagtctctggctaacccctcgttctaccattccgtgcagttggatgtcgaggataaggtggcaaatgttttctgggccgatccaaggatgattactgactacagtcagttcggtgatgttattgcatttgatgtggtgtctaggaacagtataagcctccgtcattttgcctcttttgtcggttgtaacaattttggtgagcctattgtttttgggttagcgctcatgtatgacgagactgcagagtctttccagtggctgtttgagactttcttgcatgcaatgtctggacgagcacccaaaactttcttttcacatcaagatgcggttgtagcaaaggctgtctctatagtgatgccagacacaacccatgttatatgtgcatggcacctaaagcatgctgcaacgaggaacataaatcagcttaaaagtgacagtgatttcatgaaggagttcaaggcatgcatcaatttgtatgaagaggagacggaatttctcacttcttgggatgctatgatcaataagcataaccttcatgataatgtatggttgaaaaaggtatttgaagaaaaagaaaaatgggctagaccttatatgagaggggtcttttcagctggaatgaaaggcacacgattgaacgaccgcttccagtctgatgtgcgggatcatttgagacctgaggtaaatattcttttattgttgaggcatcttgagacagttattaatgataggcggcggaaagaattggaggttgagtatagttcaaggctaaagttgctgtactttaaaattaaagctcctatcctgacacaagcttttgaggcttataccaatacgatctttccgctttttcaagaagaatacgaagaattccagtcagcttacattgtaaaccgtgatgaaagtggcccttgtcgtgagtatgtcgtttcagttgttgagaaagagaagcgatatacagtttatggaaaccctactgagcagactgtttcatgctcatgtaagaagtttgaaagaaatggtttcttgtgtagccacgcgctgaaaattttagatgcaatggatataaaatatctaccagacagatatattatgaagcgctggacaaaatatgctaggactttgatgtctggagatgttcaaggtcaagcaattcaagcagataaattatcagaatcctccagtcgctatcaatacatgtgcccaaagtatgttaggcttgttgctcgagcatcagaatgtgaggaatcctacagagtactggaccaatgttgggtagatcttagcaacaaagttgaagaaatcctacagaaacaaacttgtgtcgatgcaactctgacccagactgatgttcagaaccttaaggtttccttaccttctattacaaacggcactcaagcagaaaatatcatggacaaatcaagtggcacaacagcaaaagagtcaaagaagaaggggcagaaaaataagatccaatcaagaaattgcattgaaaaaggtttacgaaagaagcagaaggttcactcagaacaaccttcagagtatgctttgttaggtggttctcaatctggaaacatgtttcaggtatttttcgccaattttttgtttagtcaaattgtaagtctgaatatgtttttcatttcaaactatggattcgtctgttgtctgggattctacccatatcccacattttttggcagagaactttgttgggaaaagtttatgttttgcattttttaagttcgcttgttgtacagttgtgctgaggtactattttatctgatataaagttgttgtcttcatcacttcatgttaagctgcaatgttccatgcattggtgtcgataatctaacttactaacaattttgcattatgctgtgctgcatttttttacttagtgcaacaaatagtcatggcatttttcaacatgcaggctttcgagggtcctcctaacatgtccccactgggtacccaaactccgacctataaaacctacagggtatgaagttacatacaaattgcttccctacatatgatgttcttttagtggtgttgtattggaagttgtttatttcctattaatccaggggattgagatagttgtttatttcctttttaatctaggggattgatctttcaagtccgatgggcccaattagctatgatgaaatgccctctggcttagatccgactttcacgacggtattaagaacttttgattgaacccattctagcctttgagtattgaaatagtactaacgtgattgacactttttcagcatctaggttttgcaacctatcacacttctcaggtgtcaagtagcagcccacacaaccaggtaaatgatcataggatatgtgtgggtgcccttctatcacttcacatgtaaagcttgggaaattattgaaaatttgtttttgttgttttcttcagcaacctgatgagaatttctgcacaaaaacatctgagttgaacaatctccattcttctctgtaggccttgtagatatgaatgcctcattgcaaggtgctgtgcttctctcttttgagccagcacggaacatgtaagctccatcttggcgtcttgtagattggaggctcgagatgattagatgtcatccatcgactatagatggcatggaccagctagaaatgggcatatacatcattggtatgtagcagttcaattagtacaagtagctgtagttactagctactctttctttcttgcaacttgagttgattatttcttattgtagttggcaggttggtactaagagctggattacctctttaccttagcctgtatgaatgtatatatatattctcagatgtacaacttgtaggccataagatggcgtctgccttttgtgcgcaggaaatgcttcaagatgtaaccacaacttaacttatgtcattccccctagtctttctgtttttcattaccctagggaggtcgacttatgtacatgactactggggctgtctggttatctgtagaatcactttggacaagaggaaaggatgaatatttagttatttcattgattatagtcgacgttgcatataaactacctagtgtttatctatcaaaccctaaaaaagtagggtcaaattgatagttaggttttaaaacagggtcaaaagcgcaattgtctctattgctaaatatccaaaggtaggtcagtgttcagtataacctacaatgaggtctagaggtctggcaatatctagcagttcacc

SEQ ID NO: 51076 - DNA, 887 bp, Oryza sativa
  unsure (1)..(887): unsure at all n locations
tttatatcatttgatttattgttaaataaactttcatgtacacatataattttacatatttcacaaattttattgataagacgaacggttaaacatgtgctaaaaagtcaacggtgtcaaatattttgaaacggagggagcaggaacaatattgtcaacagaccaggaggggattgcaattctagcagtagatggatccgccggggaccacgctccttgcctagatcttggtgcagagcagaatacctcctctgacctctccctccactccttccgcgtcctgcatgaagcaaagcatctggtatgattgaatcttggacaagacgataatggcgaatcgtatggttcttatatgctttaccttatgtaagattgaatcgacctcagggtgtcagactcgctgcagtgcttgaagaaatcgctgccgcatggatgcacgagagggaggggagacggagatgatgcaccggtagcaaggtggtcgcggtggattgcgaccgtcgcctacatctgccgctgccgctgcagatgtcgaggtgaacgacggcgtgcgacggcgctagggctgaggggggtgccgttgcgtggaaggcctcgcgggcgaggtggcgcagggaatccccaggtggaaatcggcggcggagcgatcggagtgaggggtcgccggcgtcgcgatggctgggcatcggcgttgtcgcgggatgcggacggcgtgaggaggcgtggcagcgtcgatccggagggcgcatggccgggtacggcnngtgatttgcgggagtgcgggtgtagcgtggatgcggcggcgttaggggggggggggggtcgtggatcgatgcggcggcgcgacgtggatcggagatgctgtggatggaggttgaggcgaagaa

SEQ ID NO: 51077 - DNA, 701 bp, Oryza sativa
ttcctgcagcccttggttgtgtgtataaatcgagtagccagctcaattgatttagcttgataaacatgtctccgcttatgcttccagtaagggcattacatgaaaggttcaatgccaacaattgttggcacctcgataagttgcaggtattcttccagtcagttgattttctgctaaatagagttcagtcaatcgattcaagttaccaatggattgtggtatttctccagagaatatgttttgtgaaggctaaggacaacaagattgtttagttggccaagagtatgaggtatgctccctgtcaatagattgttaccaagataaagtagggatatgctagataggtttccaatctccaaaggaatggtgccagatatgtagtttgaccgaaaactagtgaagttaatgttttcggcaattcggctacagagctgggcatgtccccgcgtaggttgttttcgccaaagtgcagtttctgcaaattggagcaattcttcaaggatgacaggaatgcccagtctccagcttctaactggtttgagtacagcatgacgacccgcaaatctgtcatcaagccgaaagaaagaatcacccctctcaaagagttgttggccagatacaggaactgcatgttggaagcatttgctagagatttagggatttctccatgaaaatgattgtcagacataatcagaacttgg

SEQ ID NO: 51078 - DNA, 7985 bp, Oryza sativa
ccctctccgtctgcgccatcaacgcccattgcaggggcaatctcgtcatttggaaaaaaaatgtcacctttttgatccaaaaattataaaatattgcctccggtgtcctatagccaattacacaatttttaaagtgcccatcaaccgtgtcacatttttgcagtgtctcccaaccaattacatattttttgagtgtcctgtagcaaattttgctatgaaaaaaaaacctaaccaactagactaattgcgctaccatatttagtcccggttgataacaccaacctgggactaaaaagggttacaaatacggtaaaaaagaaagggttataaatcgggagtaaagagtctttccctagtagtgtgggtattatagtaaatatctcaatccatagataattttaacagaactacagaagcacaacttgcacaacaagccagttgcgaggatggaatgggcaggcttgcctgcctgcgccacctccgacgcccgtgcatcgccgcttgcgcccatgcgctgtcgcgtcgctagcggtcgccgctgttgacgtaaaatttcattgtgacatacaaagtcctgggagatttgtttactctagtgcaggtcctaaaataatgggcacggacatgccagttaatttgatcctataactaacaagatagatgaactgttgatcgaagagccaataagataataagccaatgtcaatagggttttaaacaatcgactatatatccgatgtagattctgacaatggaagaacttggaacaaacaatccaatcgactgataataatatgagaaagtagatgtccaatgaaccagtcgaccgatatcaatatagaatatgaaatgtaggctcgttggttaaaacatacatcggctaaaagtccaatgtaaatataacttattggttaacactccgattaaacatagaacaaatatataaacttagcaagacttagattatcagtagtaatacagaatatcggacccaaccaagatagttctaggttacttctgatcagataagctagataagccgatagatatatgctaacgtgatggatatggcaaatctatttaaaataatattgtgattgtagagatatatttactaagacagaagattggacctaaccgagacaatcccaactaaaccgacgcgtctctaaacacaatgcaactaaagatagaattggaatattgggtaggcaaacatatcaaccgaactagagcaatccaagagattgaagcgatgcagccttaaacaacgccaatatagccgatacaattgccatggcgcgaggaacttagggatttctccttcgcggagatcgaaaagatgcagccccgtatcaggtgtcaagtcctaccggtgataaaacctcagaaaagagggtggtgatgtgctgaaaattatattgatctagagatagatacagtgacctcggttgtacttatttatatccatgggtagatagtagcacaattaccccagttgtatatatttatattcacaggcgagctggctacgcgattttggagggaaggctgttacaaatggtatcaaagccgaccctcacgattgcgcgtatgggtcagtgggtgggcatatggcacttgtgggcactgtgtgaagcacatgacatggcatatggcgcctgcactagacgtacggacgtgcgctaacagggggcgtattcctggacatttgcctatatgcctgtgcccttcaaccatatcactcccgggttaacccttttacataaaaagtgtgatttccaagaaatgccatcgacaagtgttagtttcaagaaatgccatcgtataaacgactttgtcccaaaaatgccatcgccgttacggttacgtcctgtgccgttaagtgttataggatgaacattgtatttaatatcacggaatggacggaaccctaacggcgatgatatttttttggacaaaatcgattgtacaatggcatttcttggaactcacacttgttgatggcatttcttggatttagacgcttgtcaatggcatttcttagattatctcaatataaaacccgcttgcggccactaaattgtaggtatcaggtcgggtgtgcccacgggcaaaaaaaacatgtgcacgcccatgcccatcgggttgggtatccgcgatacccgaacccatgggcaatactgtcatccctagtgtttacatacaaaagtttatacctagaatgtgtgtgtatttgagaatgtactgaatgatgaacttgtgtgattgtgttggataaactggtttgcttcggttagtttcacttccataattatctactctaatgcttattattattggttgtgcggttcaaatattcgagttccgcttcatatttgagttcacgattttattcatgtttcattattttgttgaatgttctatttaaattattcaagtaccatgcattatcatcggagtacaatttggttctttatttattatccttgataagcgttgatcgcttatttggttccttattcttttctagtggtttttttaggagctagggtggtttggaatgtgtattcttttctagtggtttttttaggagctaggtggtttggaatgtgtagattatatctctattgatgagtggttttggtatgttttgccgtggcaactcgaggtaagtggttatcagtggtgttatacacacccatatctggggacatacgcttcttgtaaagctcattaacaaatatatatgcatgtgtcattgtctggtatgtctgagttgatcaatggctgcagcgatctatatggactaacttttgtaatagtaatacaaatattacagtataaaacatagctctaattcacagataaattactcataattaaaaaagtggaacgagggtagtcagactctgcagccgcatttgcagcatttacatggtggacaccttggatctgtggctgcatctgtggctgcaaaaaaaaaaaagcatcttataattaaagaaaaagaggacttctataaatagtatgaaccaaggataaaattaccacattaattttaaagaatatctaaaatggtaatagttgcgtagttaattatatagatttaaataggatattacgtacgcaagagagaatatatattgacaaattaatacgtatcggagtactgaaacgatgattagaactaggaaaaaagtccaaatacaaatttagatgaaagcccgtctaggaccctaaactttaaaaccggatatttaaccccctaaactttacaataccgtctatataaccccttaggatggttttgaatattttggaagcttaaacgaacaattttgaataactaatataatatatttgcatacatcagttataattcatcaatttattcttatacaacaatatcatactttatcatgttggtacttatttgtaagtgagagctaataaggagcaaaaagaagattaagtcaaaactttaataactaataaggacccggcgcaacggcgcgagttgggaaggccgaaggcgggtaggcccaagccggggcgcggggcggagcgccgctgtgccgtcggccatcgtgggatgctgccgcgcaggagcggcggttcggcggagcggcggagcgctgatggcgctgctgccgtcggccttcgcgtgcgtgcggcgtgggaggtgggactggcatagtgggagaccagaagttaggggttttttttttgttgcctgttgggtcaggctttttggatggtccaagaaaactgaatacctactcttttctgagctaaattctagggtagtcctgggtctacttggactaccctttagacccgccactggtttggtggcctgtttgtgttttcttattacgttgtctaaacctttgctcgacgtccgcgcgcgtatgtgagtccgattgccgagcgtcactgggaaagggaggtggaggatgtcgcgggctcaaatggtataatcgtataaatattcttaaacaaaaacagtttgatatgatttgtcatctttgatagttcttatctgaccctgaagagcccagtagaaaaaaaaaatctgtgacgatttacagaaccgccgaatataaggtgtgaaggacgactctgtgtactcacccgatgaacctgacgccgcgcttctgacaataagcataacgatctccatcgtcacaaatataagaaacaggcggtatctaaaagccatgatcaaataggggcagaaatgaatatctccgccttcaccgctagcttaatctttcttcgttgttctacatcctgctagtttccgttcaatataaagggtgtgaagaactcatatagcacgaagtcatcaccgaacaaaattttcaaacgccagctaccttccatgtataatatgtgatgtttttctccgtgatctaatctgttcaacgccctggtggaccagttactggacgtactaaggacctaagaagtttcttcgaaatattaaagcgttacagtacagctgagaactgactcacttgtaaaaaacgtttttttgcatacggcccaaaaggggattttgcttgcggtagggctatccgcaagcaccaaatggtcagcaaaaattgctatttttgcatgcgggtgcacccgcacataaaaatcggattttcgcgtgcgggttctgatgacgtccgcacgcaaaaataaaattatgaaaaaacaaatcacaaaccctagccctaaaagccacttactactagaaaaaacattttcaccactcacaacttagaaaaaacattttcacagacgtgaggtttttttccacaggcgggatgacttttggagtcaaatggctgcctatgaaaatataaaccggggtgaagctcgtcgttcgcctaaaaaatcattttttttctaggtggaccacttaattaagaggtccacctgcaaaaaacatgcctactgaaaaaaaaatttaagtcctatccttatcttctcctccagcatcttatcctctccaccactcattgccctcactctcctctctctctctctcatttccctctggctacctcccctcccctcccagatctggcggaggggaggggcgtcggcagtggcgcaggaagagggggcggtggcggtagcgtcggcgttggcgcggccggatgggaggtgtggctcccctccctctcctctccctcaactctactctcctccgccgccggccacgatgacgacgaagccgactgcgacgacgacgctgtctggatccgccgccgcctggattcagggaggggaggcggcagcgcagccggagggggtgtcggcggcggcgctgccgaacaggaggtgtggctcccctccctctcctctccctcagctttactctccctccgcggccggccgcaacaacaacaacgacgacgacgatgccaccgccgcctggatccagggtgggaagggaggccaccatcggccggagggggaggccggcggtgccgccggggggttggggtggtggcgcggatttcgctaaaaatatttttgcaggcgggtgtatctaccgccggccaaaatgattttcgtaggcggaccgcttggccgcctgcgaaagtcatatattttcgcaagcctttgcgtacaggcggttctttcccctgcctggaaaaactatttttggccgcctagaaaaacgttttttctagtagtgattgttgtcgtcctcgtcatcgccatcattgctgaagccgctgccgttgttgtcaccatccttgtcctcatcctcctcctcatcatcgggtgtaggggcgggcgggatccgcgcgggagaagaaaggggtgccagttccgctcctcacgttgccaccgccacatcataggggctggatccgtcgctgccaagtctccacagtgccagatccgccgccaccaagcctccccaccgccgccactaagtctctcgacctgcaccacctgatcatcccctctcgaggccagccggctgtggatccgcgagggaggcagcgaggcccatccgccgtcaccgtcgctgacctcctccgccgccaccggatccgcccctatcgtggccaactggttgcagatccaacctcttcattgacctgccgtatgaaatagaaaacacaatataagacccaaaatgccgagtagtgagcaaaggagatcatagatgaaatagcttgatagtcaactttaacctaagatttgcccgtcaaaccactgtaacactgtaagtagtgaccgaatgtgttatatatgccagggacttgactcaaaatgctaaatttcacgatcatctcaattgctcaaaaccgttagtccgttactcatgatcagctagcccaaggaagttactggcttcatactttcgtcttagccaagatatcaaaactcgtacaacttagaaaccactagatacatatagctaaatcatatatatacggtcgaccagccaatagtaaaggttcagcagaaagtatgtctaccttagttagaaccgtcttaatgatcaaccgttctagcatcactcaaacataagcaacaaatctattctatcaattagcatttgtgagttatgaattttccatgttctatgttagttatacgttatttaagttaaacttaattcttagtgtagtttatatctaagttcatgttaacgccaaaatttagttagattctttagtgggttcggttaaggaaagagcacaatcagccgatggaaatcttatccagaagagtccgagttcaaaaaggaatcatggggaccatgacatggcagcttaatttatctattaattaggcaagttttgattttagaaaagtttgggtcatgtccaatgaggactttatatttttccttttatctttagaaaagtttgtttagtgtccgatcaggactcatatctacccatggttacaaatatgtacacttggggtctctgtaaagtatatccagatcaatacaacttcggcgcatagccaccctttttattttcgtctttgttgacgagttcttgtttcgaattgggctacatcggctttgatctccgacgaggagtaaggcttgttatggctgtttatattggcggggctagggcctcgacattctaatcttgtcgatgtaaacacctatttataatatatctcagttaatctaagttgatgtctcaatttacctgtatcgtctagatctttagtagggttttgttggtatcagttaaattgttttatcgatccagattagctaaggtatccaccaccctgaaaatcagtcaaagacttgattgtttagattttatgtttcttttcatacttagtgctgcatcaattgagtttgacatactaagtcatgcttagaatcatagaaactaacttgccaataagggtttcatcggggtttcacacccggagatttctcctttcccttagtttttaattctttaataaatctctcgaagaaaacattctgtctaacctggagcaaacctcaatttaataatgcacgttataatcagaattgccatgggaatgttttttggtagggatgaaaacggatcgaatacggtcggaaactagctctaccatattcgttttcataattttttttggaatcgaaatcggaatcagaaacccggatatgaaaacggaatcgaatattatcgaatacaaatacggagcgaatacgaagcgaaacaaatacggtgacgaatattaatcggaatataaaaacctctcactactcacaaacgatttttgatattgtgtttctaaaatcatgctctatcatgttattgtgtttttaccgctattattttggcaattttttcgtgactttgttttatcaattaaaaatttgaatttcaaaacttcaaatgatattttgaagcagtaaataaattcagctaaaaaagtcatgaacataaaagttgtagaactcatcaagacatacaacttttattttggtcatttct

SEQ ID NO: 51079 - DNA, 1902 bp, Oryza sativa
taattcctgcagcccttttagttgaaatcatttaatatttgaaaatgttgtttgaagttatcatattttcaaattcaaattcaaattgttcaaacaaagtcatatagaaaaatgatcaaaaataaaagttatagatcttgataagttatacaactttatttttgacaatttttccatttgaaatcatttactacccgaaatatttttttgaatttcttacattttagaattcaaattttatatagttcaatcaaactcggatgaagaaatgaccaaaataaaattggtagatctcactgagttctacaactttgcttttgacaactttttcatatgagttcatttagtgtcataaaattcaattcgaatttattttttccaagaagtctgatttgcctcctctttgggttgggccggcttatgggccttatgtgtaagtcggatatccgatggaaaataccggataatatccgattccgacggatatcacctatatcatattcgttttcacatccgaaaaaaaatatccgaattcgtttccgaattcgaaaatttccggatatatccgaccgaaactatccgaatccgaaaaaagatccggtcggacggaaattatccgaatcactttcaaccctactaataggagtttcagatgaatattcaaggcagaggaagaaaccccgttaacctaataaaaatcatcaaggttcaatccaattaattcattgctctgccggtggttcgccgcaccatcgtttccttgttgtttttggcttcgccctgtgttcacgggtcgagtcctgtcttattccaattccgtcgccgttttcctttcctttcctaaaatggcaccgcctccttgtcctctccctctaccgcctctcctccccctgccgccaccccagccgcgcgctgcgccccaccaaatcctaccaccaccctagctgcccctctccacctctcccatgccgtgccgccgtctccccgccaccggatcgctgcagccatcatcgtctcccgtgagccctctccttccccttatccctcgccgatatggttcaccgtcgagttacctcatctaatctaaaatatccatgtttccctagttgtcgtcatcgccgtccgtgtgttcccgccggatcgccgccatcgtcgctcctccaccggtcgccgttgtttccaggtgaggtatccttttgtttcacctctttgttttgtgtgtcgccgtcacggtaccgccattgccggcgcttgccgagccaccgcgccactgcggccgccttgctgcgccgctgccctagcgtcgcctccgccgccgctgccttgccgcgcctgccgtgtcgcgccgcctgaccgcgccgtgccaccactgccctagccgcagccggccgcagcccttgccgcctgccgcgtccgctgtcgctgccgaccatcttgccgtcgcgtgccggcccatatcggcgaggcggccttgcctcgccgtgccacgtcttgccgcatgccatgtagtgtattgctgtgtcatcccagttcggtcaagccgagtcggtaaaaccctagagtccttcggttggttccgtgacccacccaagccgccggttttgttcactggttcggtggatcgtttgtgtggtcctgtgccacggtaggtcgattcgttgagtcgttgctccgtggggctcatctaccggggttctattccgttaatcttgtctgcactcgggcattaatgtttaataatggaataaggttaccggttaatagtaattacacagtgcatattgtaaaattcatatctaaatcattcgtgctccgttttaatccattcaagtctcagtaaattcataaaaatgtctagaatccattaaaatggttccttttgttgtctcagttgatttatag

SEQ ID NO: 51080 - DNA, 716 bp, Oryza sativa
tgttttcctgaaaaggaagtggaaatccaatgagcacatggatcacacctacatggaactgaaaacgttaacatatagtgatgtaagcaaagcaacaaataatttttcagcagccaacatagttggctctgggcattttgggacagtctatagaggtatactgcatacagaagacactatggtcgctgttaaggtgttcaagctcgatcaatgtggtgcattggacagctttatggcagagtgcaaagcactgaagaacatccgtcaccgaaatcttgtcaaggttataactgcatgctcaacttatgatccgatgggcagtgagttcaaggctctagtatttgaatatatggctaatggtagccttgagagccggcttcacacaaagtttgatcgatgtggtgatttgagtttgggagaaaggattagcatagcatttgatattgcttctgctctagagtaccttcacaaccaatgcattccacctgttgttcactgcgatttgaagccaagcaatgtacttttcaacaatgatgatgttgcatgcgtctgcgactttggtctggcaaggtcaattcgtgtttattcatctggaactcaaagcatatcaacaagtatggctgggccaagggggttattgggtacattgctcctggtgagtaggttttctgagcatactgcagagtatcatacaatataaagaaattactattata

SEQ ID NO: 51081 - DNA, 869 bp, Oryza sativa
  unsure (1)..(869): unsure at all n locations
aaaatgaccggaagttcctgccctgtaagacaggaactttcaaacattttgtcaagaagttccaaacttctaataagcacaaagaactaaccaacaacttccaaatataatacaaagaannnnccgcaaggatcttactatgattcatatgtaatttccaaaaattcacagggcaaaatggctgcttattttaatgggaattacaatgatgagtaccgcacttgtgtgggggtgccaaaggctttggtaactaacatcaagggacccaaacttagacaagtttgggttcctaaatcccaagcttgatttcttttgtaggcatactcctccggtggctcaatttgggttgtggacagtggctgcaccaattatatgatgggagagaggagtatgtttacaagtcttgatgaggagggtggaagtcgtgaaaatattgtctttggagataatggtaagggaaaggtaatgggtctcggtaagattgccatttccaagaatcaatctctatctaacgttctccttgtcaattctctaagctacaatttattatctgtgtctcaattgtgtatgttaggatttaattgcttgtttaccgatgttgatatgaccgtttttaagcgagatgactcttccatagcattaaaggtgtgttaaagggtgatctctatctcgttgattttgacgtcgatagagtgaatccggaggcatgcttgattgctaaatcctctatgcgttggctatggcanntangtagcccatgttggaatgaggaatttggcatctcttctaaaaggggaacacattattggtctatctaatgtttcttttgagaaggatcgtgtctgaccgagattgatctgtccgtctga

SEQ ID NO: 51082 - DNA, 2060 bp, Oryza sativa
gcgtatggatagagtcgtaggaagacaattgtatctatcaattaggatatttcatgtaatttccttagagatatgtttgggcaaagtctgccgcaaagacatggtatcttagagttgttagagataagagtcatgtccgatatggacatattttgtaatctcgggtataaatagaccccgagccccatgtaatcaaacgaacacacgttcaatacaatctcggcgcatcgccacccttttactttcgttttgttcgacgatttcttactctcgggttgagctgcatcggtttcgatcttcaacaagaggtaaaacttattatggtggcttacgttctcgggattagtgcttccatctttatgatactctaatcttatttatgtaattcgtcgagttatcatatatcttacataatctccagcaatatcgctatctaaccttcaatcggctgacgtctgctactagaaggcagccgattaggttaaataccaacgttgacttagattatataggatatctaccactttatgaaacatccaacgtcttgattgtctagatattgtccatcttttcatacttatagttgcatcagttgagtttgatcttatgagtcgtgattagaatctcaatctctagcctgtctttggttgccgattagggtagcatcggggtttcagccgatcttatctgatttaactacatttatcttatatgcttgattgatatgttaaatctaccttttatgttaagatcttgtcgcatttaaggtatattagactttctgtttggtatattctatttgtattaatatcttaatatagagtggtatcggagtattagccgatacatgctagatttatctgatcggctatgctataaacatatatagtcttgttgtagtatatatttcgatctaagtgatttataatgtctcggcatagtgaccgatctatctcaatcacttgatttaagtatatatcgacataagaattatatattgttaatatctacagccgatcgagtagatttagttctttcttacttattcatgaccgccaatcgattcacatatgacatcggcttaaagataaatgatatgtcatcggcaactagccgattggctatcatttatggatttaaccacggtttctttgtctttgtttcttgttgattgcaggatcaaatcaactggcacgctcatatatctgaaggcaagcttttggacctgcactggagttaagcatatctctcaggcttcgtgtttttacatcaacatgctgcctgatgttggcgccgcccggccgcctccacccagcgtcccctacagccggatctggacgaggggaggccacccggccatatgccgcctcccattgcaccgctgcccgcaacctcatgtgtggccgcggcccgccgtcagaggagggggtagggggaggagagggggatgggccggaggaaggggaggagaaaattagaggggagaaggagaggatgagatgggaggaggtgaggacgaggggatcgaataaggatgagctaggcagtgcgcgcaggctcgggaggatttttcgcaatttttttaatttaggtcccggctggtataaacaaccgggactaaagatccagcgttagtcatggttggtgttaccggccgggactaaagataatagtggtctgatatgtttttgaaccaggactaaaaatgatatttagtcctggttggtatcactaaccgggactaaaatcagaaaaacaaagtacctgtgggttttcacagcaggactaaagatattagtagtgtcagtttttactcaaatcggaactaatcaatacgctggatcatgtcatgttgacaggcccaaaccttcacctttgacaggtttggcaacgggttgtaacctacgacacgtcactgatgacaaagcaagaaatacaatttttgaattttaaacgcaacaaaaaaaacctcaaaaagatattttgaattttacaagccgtcctatatacatggttacacatcactacctacaaattcacaatttttcgcgtaatataga

SEQ ID NO: 51083 - DNA, 1009 bp, Oryza sativa
tgcccgccttatataggatgggggacaggattacaagatagaaatcttaaccaatacggcatcgatttcctgaatctactttacaatattatcaaatcaggactttaggccgttctgtaatatataaggaaacgtaatacccaagtcatgatctgtacatattccatagatataagttatctcctataacttgtcggataaccataccgtgtgggtattgggtacccataatctccacagtagcccctgagaccttcacggtcgaaaacataatcttctctcgaatagattactccaaagctgagtgcttcaatcatcttcgccatggtctcccgagtacttttaccaaatctgaagactgtggagggctgaaaaataattaaatgtaaacttaggtgcatcgactaataggtgtaatccccgactatttggttagttgaacaaactaaacatatagtcaaggagtaaataatccaatcaaccgagtggttttcataattgtcgtcaaccaagtgacttaatattaatatgtagcatatgcggtgtgaatccccgaacaacatgatccgagtgatatacctaaagttgtctacatcatggaaaattcgcatagcaaaacaactataaagaagcttgtatgttgtgaataaagaaattttcaaagtattggacatataccatgtgcacactgctttaacaaatgtgcttgagtccctaaaagacacatgttttcaccgcacatggaaatatatggcatatgtggtgtaaaatctgagtaaataaactcataaaggatttaccaaccgcctggaaaatgaccacaatacataatcagcctaaaccataatattggtcaatacaaatgctcacttacgtggcaaaaagcaacgatattatatccaatcaattgctttataaaaccaaacaatgccttgactatataaaaaagtcagcggggcagctatataaagcttcactacgtggcaccttttaaaatgcattgtaccaa

SEQ ID NO: 51084 - DNA, 743 bp, Oryza sativa
ccacgaaccaaactcatactagaagtcctaaacaccttatgaaaccttctagtacaacaaacaaactttacataaccaatcataccaaatttggactccttccaaattcgactccgcatcccatacgcacacaatacctccatcgtatgccatatagaatctccatcaaccacgtgcatcaactctagcctaagtatcccgcatgatctctgaccaccacggacgtcgtcttatccccaagccgactcccggtccatcaccgcaaatactctcccgaggcatcgagtcacctacacatgaaataaacaaagaaaccatattccgagaccaagctatctccaacttgactcattagtagcaagcaacagtattacatacgtatagtatccatctagaagccataatcatgaaataaacacggatatccaaacaaacaacccgaaaccgaaaccaacacagcgtcggccggtcagaccgcaggctagccagtctgaccgcgcacatatagccggtctgaccggcaaccactgcccggtctgaccggtcacataaaatcacagcacctgcaattcacctgtaaatccaatcatctccaaaaccacttcgtaaataaattccaaataacaaaaccaataatctccaatgccaattgttcatcacagaataataatcaaaaacacctttgatgattttacaagatggacatggggtaaggtgctatctttctacagtggtgaagccag

SEQ ID NO: 51085 - DNA, 1547 bp, Oryza sativa
aaaatatcccagtcgattttttataaaactggtagacccattacttatatcccattagacatctaacgactttctatcaacttagttatttttttctcagcgtgtatacaaaagctatttacccatacgttttgatattgatgcttttatcaataaatgatcattttaggagataaataaataatcttaagatgatcgtagcgtctaaattatatatatgatctatgaagtcatgtggccagttgaacaacatactgatcgtactaagcatgttggttgcaccaaggaatcttaagagtgaaacaacctgatgtcgcctcagcaatatataacccaattccatataggaatttaaagaccgtatccatttactttttggtaaaacttgctgcagtacatcgtgaatttgtgacatatagcatggaacaatctacaaacgtgtgattcttacctgacgctccagtttagcggtaatttgctaagaaaatactatggcctctatattaattttttttacataattggagcgagataatttagaattatggatgcctttacaccatgccaagttgtaggatcaacccacttatattgagatcaaagcatttcaaagatgcttcatatagtggatttgtccaaaaaaaatgaagataaaatgaaatgaaaattaaacaaaatttatctaattttaaaattctttttgttgggtttataacccattctagatagaaatattcaaacattttagtaggaccaaaaaatgaaaatatttaaaatttcaaataaaatctaacaaaagaattggacattcataggaaacacatcaattgtttcgttacaaaattttctcatgaattaaaaacaacacggtttgatgtaattttagttcacaatttatatgttgcaagtaaccaacgttcaaagcatgttaaataagttcaattttagtttatgataatgtaaaataatattttggatagaaaaccatctacacatggacattcgtaataaaattttacgcacatgcccgcgcatatgcgcgggctatcttcctagtttaaaaataataataaaaactgatagcaccattttcatccagctgccactgcatggcagcaccaaccttgcgctcttctctctcatcactctccagcttcccccagccaaagccaaagcaggggaacacgccgcgtctcccctctctctcctgctctctgctgctgctggtggcggtggaagagagagaaacgaagagcacgtgatgcaccacgcgcttctcacactccagaggtggaggggaagaagagcagagcatcgcgcttgctttcctcttcctccggttgcttccccgcgtcgccattgccgccacctccaccctcctcatctgtccttcccctttttcctaatgcgtgcaagccatcctcccccacatcctcaccttccctctttttcccacactactcccccactcattaccattctactataaaaactcaccatcctcccaaatctttcttccgtttcttgattttgtgtgctatcttggc

SEQ ID NO: 51086 - DNA, 2170 bp, Oryza sativa
atctgggagagcaggcagaccggtgtagccgggacatccgccgcgcgaggaccgtcgtgctgcaaaggatcatccaccatcctaactgacccttggggagcagagttcaagattgcgaggtattgctcattgttgtgatgcaattcatgttgttaaattgtgatagatgtacatatgaggtgcactttgctgaaattttggagcaagtgaaattgatattgactattactctattagtatttggttcgattttggtgctatggtgaaactcaatttgaatgaaattactacaaatatatcgaatcttttgagtgcctaggccatttcgggattcatggtaatcgaggtatgtagttagcagttatactagtgactgccgaaatttccgaagcattagtgcatttgaaccaatctaaaaggtatggtttgcttggataacaacaaaaaagaaggaaccatgatggttgttgtccatgataggttagtttcgatcttgctggaagtttggcagactggtacgtggtatcggtacaatatgctttcttccgtgcacactcatgcatagtgtctatgtttttgagaatatttgtgaaatcacatcaatttgcttttgccttttggcaagccttttttccgatcgctaacacagttgtggatatcatctaacatagtaataacatgaggatgtgccacattcttccagaatatgtctttttcataaatctagcaaatggcaatgggatgtctgagaggtattatcattacagttagggagaatcaagtgacttaagttgctgatagcagccacaaactgaatcctttgtcagatacagagattccatgcaacagattatgatgctttgtgagttgataacttgcagcatcttcttgcaagtgccaactgaataatgaaatttatgagttactttctttctttttttaaagtactgcattcaaataaaaggggcatacttgtcaattgcttttccttgtctgatatgtcatctgcagcttgtttgagatgatgaatgcatttcatgatatatgccgcaaggacattaagttcaagacatcccattattacttgaatgtatgttcaactaattattgaaatcatcatttgtttggtgatctgttactctggaacagggagattgtgggccttggttgcagcagtactttctttttttttcaactacatttttaatcagaatcaaaatacttggtagcaggattaaatactattaaaaagtcttcacatgattcaaacaagtttctttgattgaaagttgtattattggttaaagtcaggcaacgaaaatcgatatacaaaattctcagtttgtctgttgcatttctaaattcaatatatggtcatgtaaatgtttccttaaaagtaagatatgctgagctcttacaatgcattccatggtgtttgcagcagtagatttagattaaaagttggttcacatgacaaaagtaaaaggattcatagttcacatagtaaggaaattcagctatgtgtgtgacaaattttgaggccactaatcaggagtttagtttctgctatctactatttattaccttgacctaatatgtttactatatgaactatatgaagccttctactcaattatcagatgactaaatgcaagtgtcactgggagcacatagttcactttcttaaatgagaagcgaccagaattcacctgatatgatgaaaatacaacggcacaactgatggcatgattgatgtaacaattaagtttgaccccagcctcctaagtttaattttacctgattaaaagagcagtccatcatatactttcacagctccgactgtgctttgcagtttcttagctcaagttatcaggtttacatagctgttgcttgaccagatacactttctgatgcaaaggttggagtacgttttcatgtttctagtttatatccggctggtgcatcttatattcgaatgccacggatgcttctttgtaaatgttgtcaagagatcctgaaaatatgaaaacaggagggcacaggtagttcgattcatgtgggtcggctctgatcgtttaagctacggtatggttgataaaagccgtgaaaagataaacggggcaaataaaacttttatgtgtgttattaggagggaatctaatacttagaa

SEQ ID NO: 51087 - DNA, 730 bp, Oryza sativa
catcaaggtcatgatatcttcacactatgaacaaaacaaaaatgtaactttccacagtttgtagtattgttggtcattgttgcttcaaaacttgcagtcttctttgactatgttctatcagaagatctggcataaatctgttgaggcgaccagtccgtatcaaaatagcatggcgtaatgtcatgcttcctgtacagagtatagaaatgctatgcaatggactataatgatccacaacaccagtactttcctaattttccaatttttttggtagatcgctctctctgtctctggggagacttgctgttgctggtaccctgagagctactggaactactagaaaggcttcgtttcacatgacttgggaaacaggaagttgtaggactgtgctgtggatgctcctcacttgagtgttcgtctactttatcatttttcactgacttttgcggtgaatctccagctatggtggcatggttatcgagattgttaacaaaccctgcacgcacagagatgccaacttcagtataaatcctactaacaaattattgtataaacaagataaataaaataagttaatgagctgaaaagtaatcatcaactctctagacaagagtaacttacatgttactcgtatgcgaaacaatactgttgaacaagcatgctaatcaagaacttcaccagtagcaataagaaacaaacaaataaacattgcatatcagggctgcaggaa

SEQ ID NO: 51088 - DNA, 2338 bp, Oryza sativa
  unsure (1)..(2338): unsure at all n locations
ccgaccattgcctcgccttcatcatcgagtggccatggaggtgctcatcaccatggatagtaatggggactcttatagtgtcacacccaaccttacccaatctactttttaacaacgatggtaccatgctcttttactcctctctctcttctcactcattttctctttttttcaccagattggtgtgcaatgaccaacaagcgataacgttgggcttggctttgatggatccaacacagatccactagggtggcgatggagcatgagctgctgcactagggactcaagggactcgagacccaacagatccactagcacgatgacagaggagagtgagcagcgatggatctggtggccggggctcggtctcccttctcccaggcacacgatattatggcggctcgaccaacagcgaagctcgagtagacaaggagcatattagagaagaagaaatgtagtgtaggtggtaggcagctcacctctgatcaggcactggtgccgtgcaccccttctctaaccatgcgtaaaaacaaaaatagggcccacatgtcagtggcacttacataacattgcatccacaaaaataaaaaaaaaatgtaatagacccacaaggcagttacacgttggcctctcttcttccttcccatatctcctctctctctctgtgtgtggatgtatgtctcaacgatgagatcgatcgatcaggccgtggtggcacccaagcttgacgaggggaaggtgtaccatacgaacaaggggacgggatactgtaccttagtatattaccgttaattaatctcaaacggataagagcaaggtgcctcgtcaaacattactttaaaatccaccattcagtcttattccgtacgaaggtttcagtgaatgtattgatcgtgttgtcacagtcagcttactagtatntgacaactactagtaagttgtttatagtggttggcagcatactaattaaaatatgttggtattaaaagtatcctcagaaatggtagtggagcatgtgctggagaaacattatgtcacccgttaattaattttacaaacatatgattaattggagccaattaattgtacatattgtcttcgtctcaaaatatagtaacttttggctatgatatggacacaaaagtaaatttatagcatatatatgcgcaacaaagtaagagcctaaaatttgctaaatctatgcttacatgttatgcattagggagagtcagaatttgtgtgtattaattagtacagttgtatatatatcttagtttggtgctgaaaatccatggaaaacagataaggcgcgcatgaacgaaaagtttggtttcatatagtccactactgttatctcagaaaagaaaaggggcaagaaaagttactgagacttcaatgtagttttttttccttttttgagatgaagtcaatgtagtttgtttttctttttcagatcgatcagtatgaacagatcaaagaatgaattttcaactaacaccaagaaatatcttttaaaaaatcgaccagaatatataactgaaaaggtcccactaaaggcatgatacgatcgtacccaaaatcttacccacaattgtattttttggcatgtcatgatggatgtgcaatcagtagtgagatgatgaaacaattaccctacatatacattttgcatgcatatagatgtcaaacaagacccatttgttgccctataaagtctaaactagcaacatctcatatatatggaagcaaccacgaaaaggcatgtagtctagtggttgcagtgacctgagtagtaccccaaggtactgagtttaaatctccatatgagcgaatttcagattgggttgtttgtggagctaagttccctatttcagattgggttgtttgtggggctaagttccctatttcaatgattatatatatccagttagatgtagaggctgggtaaaaaatacccttctctaaaataaaaaaatatagaagcaactaaacaccagctctcagcgaggtgcgtggattggcaaattttatctcatggcagtaaccaaataacccctaaatccatttaaatgaaactaattagaaacatataacgtacaaataacgtaaacatgcatcgtcgtagggtgtatctattgtgcaagacttttttggttaacgtgtgggtaaaattctcgagacttttttggaataaggatccgttttgataagctagaggtgaaaaggatagagttgctaatcagtcatcatcatatggagtagattcatagtgcatttgcacggccaatcgttggggcgaccagcagcctaatgctttggacccatggaggagccagga

SEQ ID NO: 51089 - DNA, 7808 bp, Oryza sativa
  unsure (1)..(7808): unsure at all n locations
ctgcacccctttgaaatgaaggagccgcttgcccctactctgttaattaatggtaacggtgttaaatgtgtggtgaatagacaaatatacccctggacatgttttggtatacacactggatatgtttcaagttattttgtgcgaatttcatataaacgatgacagaacacagtttataaagtagtacatacttattacatatgattgcaacattgcacaagatcaaggtcctttatattgggtagctacagaaacaagattgaatcacaagcatggcgtagcaaatcaagaaccccaacttcattatctagaaaagaaaaaaaaatcaagaaccccaacctgcgttcggttctgggtccgcggatgtggatgaactaaggtggcgggctccggcttggaggaggaggaggcctccaccgctgcctgtatggcgccgacggtgacatctctgagccacctgacgttgcctcggagggtgaagccgtggagctccggtcgacgaacgccggaagccacaggagaaggcccgcgcccgcggctccgtcggctggacgacgtgctccccggcggtgttgtcgatgagggagggagtagcggtcgcgacgtcgtcaagcttcctttaacagcgccatcccgccgccaagcttcctgctcgctgcttgctggctcgctggccgacggagccgccgctcctctccgccgtgcgctggccgcggggccgccggccgccgcgcctccctgcgcgtggcagccgcgtcgcgcatccctgcgcgctggccgcggggggcgccacgcctccctgccccgcgcgcccgccgatccgccgccgcgcctccctgcccgcgcccgactccaccgactccgccgcgcgctggcccgcggcagctgccccgcgctgccgccgccgcttgtcgcgtgcgccgccgccaccgcttgcaacttagctatagcgtttggagtggaaatcgggagttcgggacagggattggggatttgcctctttcattgaagggtagaatggtcattcacaaatgataataacattttgtttcatcatttaattctaaaatttcgggcccaccatacttctgtcaaaaccaggggcagacgactgcttcatttcaaaaaagcaggggcaaaatcacaaaccctaaaaaacaagggtaaaatcacaattgaattgtaaagcaagggcagaaacacaattgcccctaattttatttatctgcgtgaacaaaatatctgaattgctaaaagagagttcaaacagtttttctcctctcgagacttttactccggcgcccctaatgactcatttactcctcgagacaaaacaatcaagagaattgcttagactctgtttagttcgtgaaataaaaattattgggtatcataccggacgtttgactagaagtcggaggggttttcggacacgaatgaaaaaactaagttcataactcgcctggaaaccacgagacgaatcttttgatcctaattaatccgtcattagcacatgtgggttactgtagcacttatagctaatcatggactaattaggctcagaagattcgtctcgcggtttcacccctaactgtgcaattagtttttatttttatctatatttaatgctccatatatatgtcaaaagatttgatgtgacgtttttgggaaaaaaaattaggaactaatcatagtgaatatgtttaaatgcataatatttatataaattatattaatgtatgatatccacaaaagttatcaatatatgtctagatttattaacatctatatgaatatgagcaatactagaaagtcttacattatgaaacggagggagtatttattactccctccatttcaaattgatttcctaaatgatctacatatttgtgttcatttattaggtctattcgttatttatgcattggagtaaatggacattgatacatgcatccgtgaacacatgtatttataacccatatgcaatattttgatttgctattggctaggaaatagtggggatggtgcatgtattgagtttgttgctagagtaaatatagtatgagagagttattagcttttcttggtcttggtataactatgaaatatgtagatcaatttgaaatggagggagtaacatggtaaccgcctcagccatgttgtacttgtacatgcctagagtgggcttttcaagttactccataggaagcttccaatgaaaacatacagtattgactgtactatcacagcgttcatagtattacttgacatactctacatgtattttaaattttagtggttgacattattatctattaaaatatgctatagttttacgtggtaaaataataattatgctatagtttcaaaagtatcggtaaaaaaataattatgctatagtttaaaaactatcattagatattgggaattaacgtggcaggagaaacatagtttcaccacttaatttttcaaacaataaatacatagcaatttttatagctgcccattcgcattatcattacaaggcactacgtttgcgcaaagattattgcatgcatgctatgaattatggagagtacaatttttcatcaactttggtggagaaatccactgaattaatagataatatcccaaccaaaaagtcatgttcctaggacatgtcatccacccccactatctccataaaaaactgaaaagaatgggaaaaattgtacggtaaagtcaatgcagtttgtttgcttgtctgaagtatgaacacaagaatgattcttcaacaaaaacataagaatctctccgcaaagctggcatgtggacctatacaatatagataaatcagataaggattgtatcttttggcacattcctaaccagcaatgtatattaataaaacacctaaaacacataaaaataagagaattaaggagtagtatatattttcagaggagaatacgcatacgtataaaattccctaaaacacatgcacaaattaaatgaggctaaaaacatactccatggagttagcatgcccacagcacgaacacacgtacatttccctggacatttttgtgcaatttggatatgcataagtcatcctaattaaggtagattaattagatacattatattacattctacatatatagaaatgttccttcttagctagttcactttgaattcaacgatgaaaggcactaaagatgtcaatgttgaaaggaacggatcaaagggctggaaagtctcggtcatcggcttccacgctctaccaccaactaacaagatgacaaacaaaaatgtcacagtacacatcagctaatttacgtgctgtcaatacttgtgagtttgtccacgtttcaatttactcatgcaaccctattcgagtacagttattgctaatatcttaattagtaacaaaaagaagttacgtcgcctaatcaagatgaacatataaaaccatccaagattaaccacatgctgcatgtggaagtggataatgacttggataattactctacacccatggagttaattagacaagagtagtatagtactaggaatttccactagttttacttcattaaagagagctagcagcacaattaatcggtcttatagtaaatggccaaagtggcgcagcacaaatggtacgtgacatgttaatactacagtagaatgaacacgtagtatgaacggcctttttgactttctaccctaacacacggctttaccttcatctctgtgactctgtcctcttgcacggttctgtttttgaaaggaaaaaaaaaccaaaacccatacatatcgtccagaacattcgtcccactgacatgtgggacccagacactgaccctctcccctctccgacagtatctggactggatcgtcatcctacggccacgattcacgcagccgccgccgcttccgtcaccatccccacgttggcgcggggcccgcacccccacccactgacgtcagcggcgccagagcagcggcgtgcagtggcaggcggctgaaaataacggtgaactcgcggttccagacacgtcttttcttaaaccgtggttaagctgctaattgtgggcgggtttaggcgaccgccctaaaccacacggcttacggtttaaccccgcacgcgcccctcgatgacagcgtggccccaccgtgatgcgaccccacttgtcagcgacggtcgcgtgggagggggctggaggcggcgcgctcaccgcggatggcgcggcggcaggccactcctgtcacgacacgtgggatggtacccaccggtggcccacctgtcagtgaggggagggggcagtgacaccagtgagagacgaggagtaattctataaaacggatttggcgcacgcggcacgcccacccgctcgcgcaattcgcacgctctcctcgcctcgcctcgccttctcttctctcctcacctcgcccgcgtcgtcgtcgtcgtcgtctccgcggcggcgggggaagcagcgggaggcggaggcggagcancaacagcaccaccaccccggggcggggccgcggcgcggtgctcgcgcgcgtcgactccgtgtggtgcgccgatggtcctccccgcttcactccggggttcgtcatttcggtgggcggatgcgggtgggttggattcggtgtggttcgtggggggtggggattcggatcgggggtgattttgagagggggggatcgggttcttgattcgaggtgcgattcgggaatcgggagttggagcgggggagggggaggaatatttcgtgtggggtttgtgcgcgattctccccgtcgcttttggggtaccatccaggggacgagggagtcgtttgatatggtcgcgttcatgcttctatttttgggtggcgatctcctgtaaaatttggacccggatcggggtggttctgtttgtggtcgagttttcctcgatttgattgctgagcggaatattttgttgggtgttcttgaatttttttttttgcgtcttatgtggttgattggtttgcgattcttcattagtttatcttcgccgcgtttgtgtaaatgtgggtaatgtaaagaacaaaaaaaaaattcagggactaaaattagtgtgttctgttatggcttcagcgttgctggtctgcagctgctgcggaagtagtaatagatgaggaaatgcccaccgatttttccagattgtttgatttcttcttgccctgttgttgtggccttgataagatccggttatggctacttattttattcttttatgccgtttaaatcaattagttcatgtatctttgctgtacaaattgtgtgttatcattttgagttgtggcattttgtcagtccaagattccctgagacaacgaaccttactaatgatggcggtgagcagctactgagctctgcgtttgctttacctgatagtgcttaatttggcaattgttagctctgcatagtgctactgtacacgtggtagtgttcagttttggtaggaagagcactaaatttaagtactgctatgtatcagttatttctttcagattgtttgaccacagaacagatacgttttcatgttatcaatgcacatccttttagaaatatgccttggtatttgtatgtcaactaaagaagcttgtcgtttacaattggttctatttttttcaggacaatcatgtgttctaaaggtattgggttagcatcatttaacaccagcataagcaaattttggagcgatgaggagcttgtccgattcttagcagagaggaaagaagcacactctctgccagagaatgtatttgtgggaatgaacatttctctcattgatccacgtaactcaggtttgcatccaatctatacacaggataattaatggtattttccaacaagattatggcatatgtggaatttgtggtctgactttcataattcagtcattatggaccctgaaggcttctttgttttgtcctttttgatttgttatatacttactttacagcattgtattgtatggttgagcagtattgcaacattttaattctcaatagacaactaaagaaaatgaattctgcatagaattgataactatttagggttgaaaggcataaacaatattttatgcaatgccagaaagaaatattttgagctctgatgaaagtgccatgttaagtgcaggaacacatacttctgccccattgattatggcacaaattgccagcatgaagtgctcataaactatagcaggatgttatatgagaaatagtttggcacttcacattaaattgagcattttgtttttcatttttcttagcttgtgcaccaattgcttgcctgcttttgctggaaaagtatgaagtacactctttgatgattaaattctgttcactgtgttgcttggctagaacttactctgccatccttactagattctccaattatgcaaaatcattgtttccaagtgaaaattaagttttcgaagatgtcagaattcagtatatgcaattaattatcaacttttgtttttagttggagtcactatacaagcagatcatgtgcttagattttggggcttcagttcactttccacactaaaatgtgcacctaagttgttgatatgtgtctctgcactcttcagtatcccacatcataacacatagtacataaatctactggaatcatatattaataacattcttgcatgttttaaattggtaactggtgcctggtttcaataaagatttgattgcaaattttctgaggtatcagaactaaagtttactcttttttgcatagcacaagtccacagttcactgtgaccagcggtgctatatcctagagttaagctattcctacaatgaaaaccacaatggtgcttaatggcttattatcttgttaaacctcaataaaagataatctgacagagataacttttcttgcagaggacatatggtacatgaatttttcagatgatccacaatcccctaagaatggagaaaatgctattataaagtcaaaaaccggatactggaaagttgttggcactgttagaataccgacaagtactgttattgtgggtatgaaagtttctctggaccattataaggcgaagcaccatctggtaagagaactgggtgggtgatggatgaatatctgattgaacagaatgacgaagctaatctaccacaggtaacccatggtggttgattgatatcatttttttttctatagcatataagctttttttccagggttgttgattgatatcttttgtatttttgacaggactacaagaatttgtgtacaatattctttcagggagacgacatattaaatgctggagataagcagatatgtctgaatgcaaatgttcctaatgaacgcaaggaattttaccttcaatatcttgctgaactagaagagcaaaatgctgcatggagcaaccaggtttgtattgttttctttattatgtaaggcatccttagcaataccctggatcttttagttttgcacatattttttctcattttagtgtaaagtataccttgatccatgattgtctgtcatgtaaaattaagaaatactccagcaatcctgtcattgtaattcacttttttattttgattttgaagtatttaaggttttctccttcataaccatacaaaatctgttgtttgtgagagcatgctcctatccgatcatcatttactacttattgctttcttctgcattacaaactgtgaatatttagatgtgtgataatactaatgaatatccaatctacatatgccaggctgtatctgtaaacgagcaagatgtctcttccagca

SEQ ID NO: 51090 - DNA, 736 bp, Oryza sativa
attcctgcagcccagaattactagccaagtgctatgcttactgctcatgtcactaaacgggttgatgccatacgtgctcagcccaaatctaatgcttcttggatcctttgtaaattcagaaaatatccgatcgatatttctctattgtacaacatctgcaggatgtcttagcataccatcattagtgcggtcctctttgtgccgcctaaaaagcttagcctctcttggattagcaaacaaccgcttcaaacgagcttttataggcaaatagtatacaacctttgccatatcacctttctttgacttctagtcttttgtgctactattttctctcttgtatcgagatgccttgcatgaaggacatgcttctaaattgacatttttcttgtagtacaatatgtaatcgtttggacaagcgtgaatctttgcacctccaaccctagtggacatagtaccttctttgcttcataagttgactttgctagcatgttcccctctggaagcatgtcacttagcatgtcaagtagcttagtaaaacttgtatctgtccatccattacttgtcttgagcttcataagttccagcacagctgataatcttgtgtacttcggtttacaatatgtacagagaagtctcctgatctgtaaccaaccgggtaaatctctcataatcttttcctttgtaactagagtcctctgctcacgtaacatttcttcgaggcaattatcaacatcaa

SEQ ID NO: 51091 - DNA, 6507 bp, Oryza sativa
tagatcaaataagtaatttaggagaagaaattgttcaaagtttgctttgcggatgtctgctccatgcatgcagaggcagaggcagtggtattgtttgttcaaagtttgtttgcgatcgaaatttgtttttggctgctgctgtatggatgcacaggtagtgccctggtttttggcatttcatcggcgcaacatgtttcgtccggaatatattcgttcgcagttctgcacgcattgatccaaaatagaagactctcacatacggaaaatatgaccatatgcatttccactgggttggctggagatcttattcaatttcctagtttacatgtgtacattgcttttgatcatgcccacgcgctatctagttattgacccatgcacctgcataggcaagtggtctatatttgttgtagttctacaaaatatgttgatattattaaatctatggatgtttttgaaaacatacacaattttatttaatgatccattattttttatttatatatagtattcccttccaaaacatcattctacgttgcccccataaaaatatttagttatatttattcatcattttcacaactccaaaataattgtctgtgactcactatatatattgtcatgcagttgataattttttagtgcttcggggcaaacaaaatgtttcaacaaaacattaattaataatgcgtgaatttatttgttagttttatgccctaacttccatgtatattatacacacacacatacacacctgcctgtctactggtaaagttaaaccttcggatagaataatacctcaagatgctttacatagttctttttttttcttgagaaacagatttgcagttttgttggttcatgtagatgctagtaataagttggattacatcatttaactatttaattagagagagctatagaaagcattaatattgtcttatgctatctagattgaaacaaaattatcttaattcatctaagccattccagattgaatttctttttaagagcaatattataaaagagctgtatttattgtagtttaactagcttctagtcttgtttgtagaacttttgacagctacaacttatggctactctagaatctctatagctattctaaatagtttagattctcacccgtacgtattcttagagtttgttttggcgagctttagattatgagaagaagtaatctagagaagccgacaaaccagcttttggcttctcattcattattttgtggattctacaacaacagcttctcagaaccaagacaaaagttggatggttgagcgctccacgccccacaccacatctccgcccgcgccacactcgtggagagcgcgggattcggttttcgaatcccagtccccctgtctctctctcctctcccatgtcggagagaaatccggccacctcccggccatgtccgcccctcccgagcccctataaatctaccccgcattctcctccacctttttccttctttcgccgtcctctcccactctccctaccgccaccgcaccgctctcccctaccgccgcctccggccaccactagtgccactgctgcgtcgcaccgtcaccgccgttggcctcgcgaggttgagggttgccttgtccaccccttcccgaaggccggaacctgctgtagccatcttccccgcgcgcgccgttgagctccgtgttgacggtccttacatcataaatatctgaccgttaatgcttgcatataatgaaataaaatatggtatctaacttagtggtagggattattactaatcatttccactagtgttggtgaaatatgtgtatgcaggtattttaaggataaaatacacccgtcatgcgaggaaacacactttcggccaatcaggcgcaagtacacggattgaagggcccacaagtcaggtgacaccgccatggaatgggtcataatcgccatcagggcccaccggtcagcctcctggccaaaggagagggcaggaggtggggcccagggttcatccgaaccaccaccggcgcctctgatcttggccttccacgtgtgcgttcttgatgacttctcaatgatggttggagggcagtttggacatttcccatagccataaccatcatatggagcctaaaaggaggtctccatccacacttcaacacacacaactttgagctgaattacaagaggctctattgtatcttttgtacattagaaaataagtagagagtgaggggaaactgtggagtagtgcccagaaggttggcctctatccgacttctacctcgatgagtgtagttttctaggaggaattctagaggagtaccagatctgtcggtacactctactctgggttcggagaaacttgttctgtaatataagcattcggaatccttttttttacataaaacagcaggggaggcttctactgcgcatattaaataatataatatagaatatttataggttacaaggatttacaaaaggcaaattaattaaaaatgtctagccatgattgccagctaggtttgtccatctcttttgctctgtccatatgcatgttaaactccctcagaaaatgagtcttccatttatcaaaactgagagcaacattgttaaaaatgaggtcattccttcgtaccagatgtgccagcagctgattaccaaaacttcaaagaagaaagtgtgctgaaaagagatctgagctaaagtgatcatgttcataaattccaaggccaaattccagtaataccaatgtgttgccagcattgttgagcaaatggacgggagaaaaacaaatgtgccatgctttctgtggtcatggagttgcacatcaaacagtttgtgccaccttgtatgttgaattgctttttatgtaacatttcctttgtgttgagtcgattcattagcatgagccaaagaaaaactttaagcttcattgtgcatttgcttttccagagtattgatagaggcctggcaacttgaagatgttcaaaaaacaatgagtaaactttcttgggttggtattgatctgagttccataaatactagttaggtgcccatgcgttgcaatgggaaatatttatataaattcatatatactctatcacttgtctctctctcgccccctctctctcgggccgacggcgcaggtcgagcggcggcggcggcgggtggtcgacgtccgtggccagacagcgtgggtcggctccagcaaaatgctcagcgaggtgtactatgccatcaccaacaaaacctcccgccttaggttccccagaagtgtcggcccgacgttcggcatcggcgggtacctcaacggcggcggcttcgacctgatgctgcggaagcacacagcctcgcctccgaccacgtcctcgacgccaccatggtggacgccaaggggaggctcctcgacagggccaccatggaggaggacctcttctgggccatccgaggcggaggcggcagaaacttcgggatcgtcttgtcctggaagctccggcttgtccccattccggccaccgtcacggtgttcaccgtccaccgctcaagaaaccagtccgccaccaacctcctcatcaagtggcagcatgtggcgtcgtcccttcccaacgacgccttccttcgcgtcgtcgtgcccctgtaccgtgtgccggcctcgtcgccaccatggccgacaccttcctggagctcaacgtgatggcaagcgactgcaccgagataacgtggatccagtccgtgctctacttcgcgttctacagcacggggaagccatcggagatgctcctggacaagggcaacggcatcggagatccatcggggtcatggatgcgactggcgaggtcgtcgtagtggtcgaccgggccgttgtcaatgaaaaagtcgacgccgtcgccgccgccgcctcacttcctccgcagccacgctcttccgctgtcgcctcgcctcctctatcgtgcttgcagagccaacctcaccgccgtagcctcgcctcatcccgagctctgcctccagccgcctccgccaccagccaccaccctcatcccgagcgccatcccgaccagtggcggaggcggagttcgccgctgccgcctctgcttcccgtgtggtcgctgcatctgtgtcccttgccgccgctgctccctcccggaccgcagcaccgaacgccttcctgccgccgcaccgtgcatgccgtcttgagtgccgacgtccgcaccgtcgtcctcgccgaccgcccgtccctacgccatcctcgccgaccgcccacgcccaccgcccgtccttgccgtgcgcgctgcaagagagagaggaagagctagagaggagagagagaggaagaggggaagaagagtatgataggtgggtcccatatttttttattaaataaatgctgaataggtactaagtacatagacttttctataaacttaattaaacttttaagaagtttgactgcagaaaatcaaaacgacttctaatatgaaacgaagagagtattaatttaaatccatagctaactgtagtttttttttctagagcaccatatttacaatctcaattcacaattaaattttacaagcgtgtataaaatatagacaacaaattctccccgggtttccacacatgacaaagaagttcaaccgattgcatcacattgtgccagtaatcaaatcacaaaaatctaacagttcacacatcacactcatattgtacaggacaaaaaatgtgaaccgattccatcacacatccaatcaataccattcaaaatcatagttagtcagtggccaagttcagttggtggaagtccacataaagattcaaagtgcagacctagaaggtgtattaatcagtgaacaactgctatagttacatcacaatatatcccagaaaggtacagaaaattattggacaagagattatatgaatagatgcaaacatattaattccatgagaacaactgtattgccaatacagattactgaaacaccaatagtagcaggaagttccacatcctatctaatttaaaaatatggtataaaataatatttgcagatttaaacagaatttctgcccagaacatgaatcccagggatataaatctgattgttctaattggtcctctgtgccgttatacatgtgaacgcatctttttttgctttcatcccaaatcctagctaagatctgtatctaaagaacaagatacacgggcatattactacgtcgttgaccaggggatcatcctccaagtatatgacttcaatagtccaagatttttaatttgtcacttctaaacctttgagagaaaaatagcccagcagacaacggcacatttttgtgctaatgcactgttatttgaatgcaattttttaaaaaggaactaaagcatggcttgcttaaaataggtcacattttatgagcaaaatgatcacattttaaaaaagaataaataatcgggcgtttgttaatagtaaatcgttaaatttctcaaaaaaaattatatatttgcaagagggcataagaaaggaagacatgggcgaaattagcatgcaaaaagtgcatcattcgagtcaataacatgcacatggctaacctgattttgtacttgatggtgtggagcccccaacaatcttaaccatttctgaaaataaatgagatgatagatcaaatattatgaatttgtgaaacaaccaacagaaatatgcagtgcacacatttcattgatgacgaggctagcatcttattatgcatctgtttgatagatcaaaaatagagagaaaatagtgaacaaaaaagaatattaaactactccccaggtttcctcacgtgacaaaatagttcaaacgattgaatggcatctcattgttctaattgctcctctatttaagtatcttaaaaacaagatgcaatggagtgagacactcaacttttgagtcctgatagtacatctcaagaattttagaacaatagtaaaagctcgaaaattcagcagtgaactttcaagtgtacagggcatctttagaaattcatagtgatgataaaaactcagcataggagcttcatgtattctgggcttcagatgcacaagacttcaaagctcctatttctgtatacatgacaggagatcgacaggcttcctacagcttaaatgctaaattattagtgtgtaattggtgccctcatagacccattgagaaacccttcaaagatgcctgcatgttgccaatgcagattcagaatgttgacctaaaaagagaggtgttctccacttgagttcagagttgtaatcgcaccaagagtcttaagactgaagctaagttcattcaaatgctatatatatgacattccctaatcactcaaggccgatcgaggacttattgttcatgtttagaaggagtttgaagagatcaatttgctaaaggcactttcttacgtatgtttgctgattgcaagaagtggcagatccaacaaagaagtagtagatcctcccaatcaccctcctagtctcct

SEQ ID NO: 51092 - DNA, 936 bp, Oryza sativa
ctgttttttaactatataaacccttatggtggttctgagacatggtggataatactcactgggtatgcacctagcacccatatttcattcacacattggatggcattatggatagggaaacttacagtgatggtatgttgtacctagcattttaaatatgcatatggaaaaacttttggagagcgatgtcattgaatttacaaattgtttgcatgcagtttcggaagcaagctaagtatgaagatgtgccgccgcctgcagcaattgatcttttcaaggagcgccattgcagtagcaagactggtttttactaatgcacgttgtttgttttgctatggtcagtgccatgtacatgagcttgttgtggtcactgagtagtcggtgaacctgtttccatgtatgttaactgggtttgtatttttatattggatattaattgggcctgtgtaatattggatgttaattgggcctatataacctttgtgatatatgggctattatttggtataatgctttggtatatatgggatgttagtcttgagtcagttcctggaggtatctcgatccacagtatagagaaattaaaatattactaaaaaataaaaaaaaaggtggtatagcactttgtatcttcatgaggatcacaaacgaaattttactgaaaacaaggtggtacggcattccatgaaggtcacaaaagatatctcaagataaacagcagttcaaaacacactccaaaacataaaataagttgacatgttgctgaatgaatacacagaaattctttagtcaaaatcctcctcctcctcttctcgtagggagtccaaatgttggtacgacctgcaacgtaatcatcagttctagggtgcataagtccacaaccatagcaaatgccaaactccttgcgacaaaggaagatggggcagaacacgtgca

SEQ ID NO: 51093 - DNA, 10484 bp, Oryza sativa
  unsure (1)..(10484): unsure at all n locations
tggtgttctaagtcatccttgtagtttttttcttttaattggtggaatcacggtggctgcctgtggggaatctgagatcggtggacagaaggcgaagcgccatgcgtgcagagcgtggtggtatggagattttcccttattttcaagcatggcatggtgctcctgaaaatagctgctcttgccttgacacgcttccggtggtaatggttttctggggctcctgaaagacaaccaccaggatatgtcacctgagatatctttagcggtaaacacaaagcaaacaacaacaaatttgtttgaaactagagagatgttcatcatgccgaaagtaaaaaaatgttatgtgacgcagaccattgtgttgttttttttctcccttcgtttggtggggctatgatacggtaaatacggaaacgatcggtataacagcaaaaccatttccattttcatttccatattttttaccatttttatttttgtttcggtcgattaccatttccatatagctcggccggtagaaagtcgaaaacgaacgccggtcggccggtaattatcgttaccgttttcacccctagggctatcactatgtctattggaatccactatctctactacttaaaaaaataagaggtgcttccatcgtccgtcaaaaaaaccgggcgaaaaaaccaaatttgtccgatcaaaaaaactaggtgaaaaaacgtgcggaagaaaagaaaagaaaaaccaaatctgcccaatccagaaaaaagaggcgaaaaaaccggcaaaaaaacccaaaattgtccgatctaaaaaaaccggtgaaagaaaacgtccagaaaaaataggcgaaaaaaaaccaaaattgtctggtccataaaaaccgggcgaaaaaaacgtgcgaataaaagaaaagaaaaaccaaatctgcaaatatgtccgatccgaaaaaagggcggaaaaagaccggacgaaaaaaaaccaaaattatccgatccaaaaaaaccgagcgaaagaaaacgtgtgaaaaaaagaaaagaaaaaccaaatctgacgcggtaaaagaaaaatcgggggaaaaaacgaatatgtcttattcccaaaaataattgtccgatctctactattataaaaattaaagatgcttccgccattcgtcattcgtgtttgagtaggttataaaaattaaagatatttccacgatttgtcatccatgtttgagtctgttttgcaaaaaaaaaaaagcaaaaaaaagtctgtctcccctacgaaagcggcgaaaaaaaagaaaaataataaacgtagattcaattccaaaaggggaaaaactagacaacgaaaagtcgggaaaaaaaagcacggcctttactaccagtccaaataaaaaacaacctagaaaaaaagagagtccgattaaaaagtcagaaaaaagagcacggcaaaaagaaccaattttaatttgttttagtagtatgtatatatctattctctatctctaatataaacaaaaaaaaagaacgagaacaaaaaagggtttccttcatccgtaaaaaagcaaaaaaaaaaacctgcaggggaaaaactatcagaaaaacacaccatttcataaaaaatagtttgaaaaaatcatgcaaaaaaaataccatttataaaaatacaatccgctctgagaaaacggtcattaaaaaaaagctgaattgatggatgcttgggtcggataggatccatcggttttttccatctcctctatgacttttgtttcgtcatttattctcatgtattagagaccctgtgtatctctgtaggcaattatcaacctatttttgttaagtatagctactattcttgataacatattatatgaaaataatattaaaaaataaacatatttttaattgttatttagagaagagtgctcaatgactctattttgtgtagacttggtcatgcgagacagggtaagatttaattggtcctattattggttgcaggaatgagattgaaagagtattttagattatatgcatgttgtcacatgaataatccaattattttagataaagtaaacatcggtaaggttgccatcgtcgaggttggtctattatattgaagatgttccaattttctgattgttttagctacaaacgatccatacaaacattgccattgacatggttatgcatgaaaaatatatattatcattagaaatttttcacccgttgtaatgcacggacatttttctagtcaattaataaaacaaaaaagtttcttttaaagatgtatcatttcaaagatctaatccattgtgagcgaggcacagcagcagcagtagattgaggctctggtggatgcgattgagaagcagcagagatagattcgtcgttcggaaaatgaagtataaaaactagattcctcgaaccagaggcgcatggaggactcaccgtttgacggaggagcgtgaatccatggcgctggctggaaaaccaagcaggcaacccagaaggcgacggttggatggattggaatacgcggtgggtcgagactcgagagagatacgtaccgaggcaggcggctggtggggctatatgggcattgcgtggggaaacttggaaatcggaatcggattccgacgagcggcgccgattccgagactccgccgagagccccagtgagaaagaggggaacgtttcctccgtttaatttttatttatttttggtagaagaggctcacggcgcgaaggttcgatggcgtaaattttcgttcataatattcactctcaactaactataaaagagacgctgctttgccgcgtaatgggccatcgtgtatatactctctctgtcctataaaaaatcaacatagtactaaatgtgacacatcttagtactacgaagaatctggatatatgattcgtttttttggatggagagagtactgtataacatatgtaatggtaatattttatctaataaataggctatttgctcaacgagctttatcgaaagctttggtctttttagttgttgaataacgtacatatattattgagatgttgcttgcatttggtattggtggaaattcctggaacccgaaaataggacaagatcgagtggggtgactaaggaaaccatataaattttagtagtgaatttttaaaagagagatgagagcaacataatcattagttaggggacattttggagaatagctggtgcccggtatcgttcttatcccttctccagtagctattctcttccggtagaataataacaatagaccaaaatatctctaattaatagataagttatattggtggatagataggtaagggtagtgaatgattaaaatttctcgatttgcatattaatggtaggtaagaagttagaaattggtttttaggacaaatttaaactctagaagttgatttattttaaaacaaagaaaatacaactctacgctccacggtagcgcactttggatatacaacaaaaataaaagataattaggtatattttttaaataggatgaatagatccgatatgagtcttggtgtagtatgaggtctgctattgtcaattgtgataggggcttgaggaggaagaagaggggatctcaaaaaaaaaaaaattggatctccttatttatagggaacagggcatgtgacggtttttttttatccactggtgttacttctttatcttctgaaagggtcgggtacgttattctagcacaaaattttataagtactataccatccaaactgacataaatgcttcttagctaccaattccaacgcgtagcactattgcacatggtatcctcttgttttcgtgaaagcatcatacacacttaaaaataatatttcggcatcttgctgggagcgagcaactcagtaactataaacctttgttaacgaaagatggcacaaactgcaattcactctctgaattgaattgacttattatgatcacgttacattggcaaagcagacactgtgccccacacatagtacagggcttagacctggaacttattattaatttaagttactagcatgctgatgcacgcagagacaacactggtcgatggagctataggcagctacctcgatgatcatggcgccgctgcgccaatgccgcagcccctccgctcggcggtgagcatgtgcggtgcctcgtcaatggccagccactgatccaccgcccaccggtgcgtcatcgacgggaggctcccctgcccgagctgcgtcaccatcacgtagctcacgtaccacccgggcttgttgccggacccgtcggaggtgagcaccatgttgcagggctccgacggcatgcaggcgccggcgcccctgaaccggtcgaggttccccttctcgaagtagtcgtggccggcggccatctggccccacgactccaggttggtgatcgtcagcgtcggcccgctggcggcgcgcacctgcagcgagacgcgggcgtcggtgccggcgttcctccggccgtcggtcttgacgaggatctcgaacgtgcactgcgcggaggcggtggtcgccgccgcgaggaagaagaggaagcaggccagggcgatggaaagcttcatggtaagcttcatctttgttgggtgtgtgtgcagtgtggtggtgtatgagtggaggagtggagtgatttgctgtggtattgcatgctcccccaaggcaccgttttatagccggcagagagctaggaaggccaatggcacttgccattttcttaaatgataatgccgtgacctgtggggatgcaaatactatgagctgtgactgggtgtctattctgtgaggaatatatgatggaaaatgctcactgtcatgcgcccaatctcgtcaagaaaaaaaaaatcagacatacccccgctctcagctaactaacacaccacccactaatttctacccatctcctctctctcccatcgagatttccctctcttctgtcttcatggtagtataggagtgcaagtagctagctaagagaagctccacttaacacacttcaaatgacttttttagtctaaatgatgtagctgatatataattaagccggctgtatcattgtattcatggtaattaagctttttcgaaagatctctcgtgattctaactgaaattcgactatattgcatattctttttttttgtttttgcaaatgaagtttttcttataatgtgcccatgcacagtattatttggatatttttccgacgtttcgttacttagtttattgttaaatgttgcacaggctatcttttatattttaacatatatttatgatgtttcaacaattataactagatattttatgtatcataaatatttcaattttggatataatcatttatatttttgtgataaatataatcatgtaatattttaatttaaagattcaatttcaatgaatacagtggttaagtcggatcgtaaatcagataagtaatttaggagaggagagaggtgctgctccatcctccattcatgcagaggcagtggtattgtcttgttcaaagttttgctaaatttgtttggggaagagatagaaggatagaggtgctgatccatcctccatgcatgcagaggcagtggtattgtcttgttgaattgttcactaaatttggtttttggctgctgctgcatggatgcagatgtagctgccctggtttttggcatttcatcggcgcaacatgcatagtttcatccggaatatattcgttcgcaattctgcacgcattgatccaaaatagaagactcccccggcccatacggaaaatatgaccatatgcattccacacactaggttggctggaaatcttattcaaaatttcctagtttatttacatgtacacattgcttttgaattttgatcatgcccacgcgctgatctagttggccactagttatcgacccatgttcttttgctttgcttttttcttcttcttttttttttgcccttttttccttttttcctctccgtttttttttcggttttgctataattatatcgccataaatcttgttagattacagtcagatttgtatccctgggatctcctattagattcatgccggagtacttccgtgtctctaccataatgtgtgttcacacgctagttcataagaatatgattaacaccaaattattacatcaaaataaggtaatcatagaaaaggagacgctatattgttccttgtaaatacatacgtaactttagaactcacattataaatacactaaaattacacatgtaattttgggacttacatatgtaattttgagacttacaatataaatacacgctgactatttttttgataaaaaatatgacggtataaatatagttagacctttttttcgttttgtctttttcccgcgcgccttttttcttagtttttttcagttttttccatccgttgtttcttttactttcttttttattcccttgccttttttccggttttttttccatccggctttttcgctatttttttaccactagtaaaaaaccctcatggagattagctttataggtgccagttcatttaaaaccgacacctataagttttttcccacctccacatgatgaaaaaaaaataagaaccggcgcctttaagatgcataggtgtcggttcttattataggtgttggttttttaaaaataaaaaacaggtaccaatattatagatgtcagtttaatgtattataagggccggttcttttaaacaaccagcacctatacccaatcgagccgaaaggggtgagctgagccggccgcctatatccactcgcacgcgcacacgagaagcgcttatccactcgcctctactcttctcacttctctgtcgcacccctcccccctcgccttctcctctaccgccctccctgtcgccgcccccctcccagccgtcctccccttcctccatctaatcctccctccctccgtccgtcctcctctccgttcattgtcgggagcggcgggcggcgatagagccctccccttccattggatccggcatcccctccgctggatctggtgggaggggaggcggcacccgatgggaggcggcagacggcggcgacgccctcccctctgccagatgtggcgggagggggggagggggcggggggcggtaggctgcggtgcacgagggaaggcggcaggcggcaagtggcggcgcctgaggggaggaggcgggcggcaggtggcggcgctctcccctcccctacgtcaaggaagaaggtggagcagagaaacccagtggccagccctgccctcccctcccctcctctccccagtctccattgtagttttctttagatgtttttgtgaatttctaaatgattttgatgttgactgttcattcgatctgtgatgtcgatgcggggatttaaatttgatttggggatgtcgatctgtgatgtcgatgtggggatttcaatttgatttgggaatgtcaggagaaattaatgtggggcagacgtggtgacgtcgttggtgagttcggcttgattcgagccggctcttttttttttggctcgtgcaaacctatagatgccggttctattttttttcatatatgttggttttcgctattggtgctgactaattggtgccggattaatggacacttacaaaccggcacctatggcatattctgagtgtaccctgcagtttttcacacgcggtaaagatttgtttttttatcttccatatttttttcatcgccgagccgaactctagcgccgccgccacgtcaaactacctccccatgtgttccctcctcaaattgattgaaaaaatcattcaccactattttctcatcattttccccatgattttcccttacaattctagttcaattcaccgaatttaatctcgatttaaaagtcactgttttatcccgaattttgtggattcactctgattttgataataaggaaagaggagatcgggtatatcaaaagagatgagaaagatttcaactggatttgatggagaggatcggttttggcatcgtacagatatgagactgtttttcgaaggttgaagacggtagtcggctatgcaagctagacctagagctctacttctgacttgggtcaaagagaggcatgcaaacaaaggaagggagcaggctgagactaaaaaaagaatgaaggaatgagcttttggtgcaaaaccaactagtaaatgtatagccatccaaaaatatttttacctattacaacgcacgagtattttttttctagtatataggaggaattaacgatcatatatagacaaccaccttactattgatttccgaaaaagaaaaaaagcatactactgttcatgctcccagtttctagtccacgagcacatgtgcatgcattcacccatgactattacgtaccgctccatcaacttgtgcatattttggcagccttgttctcagtgttcggtgcaataacaatgattagacggctattatccatccatcatatctagacaatatattggtcacacgcgcatgtaggttctccattggtctatggcaagttttgctcatttacagcatgcaatttacactccacttataaattaagtcattattacattctatctaaacataattaattagtgcgcgaattgaaagaggaatagttaacacttacaattatttagaaaagggtgaagtatttgatcactattaatttattattacatagtggaggtgcaaacatataatttcaattctatgaacttgagataatatactcccaccgctcattttatattacgtcctagaatccatgacacaccatcctctagaaactttgactaatgcatgtttacgttcaaacctatatcgatcgtgaccgagacatatgaaaaataatttgagttttgttagctttgcctatgaaactacttccacaatacattgtacaattttatatatatacacggcatctctcattatatcacgttataacaagttatcaaaggcaaatctcttaaaaaaaacatcgcataaaaatacggagagaatatataacaatttctaatattgaaattaattaaacgatgttccgtagttatatattcgtgcttacacgtgtgaattactgtatatattttttcacgaagcacaatacaaatgcattactttgggcggtttattcgtaaactacatcaccaataattacatgtaattaagtgctaaaaaatcatgggcttattatcttacaaaaatttgaaccaactttagtatagcaaaatgtaggacgaagctgggcggcaaagcgagtccgtcaagataatcaacgatgttgacgagtctttgaagcgtgcgcataggattattcccgtggtccgggcgtttgactgtagatatatgtagctatagctagttagctagctacgagagataatataccacagctcattttgatcgatgcaaaccatgagctgtgcacggtcactaggacacagagaactgctcatttgtgagggggtgctaatgggcgggtgatcgctccccctctcccctctatactctactctttcnttcctcctcacttttttctcttcccagtacaccataaattttaaaaaaaaataaaaaaacaaagttgaaaaattttatgcatagaaaatactatatataaaaatatttgaatttaaatttaaatttcaaacgggtatgtaaacgggtctataaactaatatttgaattcaaattcaaatttgaatcgggtatgtaaacttttgacaaaaaatatttgggtctataaatttgaattgatataatttaaattcaaatttgaatctggtatataaacttttgaattataaactttgggtctataaactttaggtgtataaactttagatgtatataaatactatatataaaaaatatttgaattcaaattcaaatttgaatcggatatataaacttttgacttataaactttgggtctctaaactttaggtgtataaactttagatgtgaaaacttgaggtgtacaacaaaaaaaaagaacccacgtggaggagtggggagggggatcggatcatctgatcgctggcatttccgcatttgtgatggcctgtccgtgtcggggtttacacgaaccgtcgcaccgtccaattttcatttcaacaggttgtttatattctactaaagattccatttgatgaatagattatacaaaatgatgaggactaggtcccgatcgatcttcctgtgaggtcacgatcgatcttcctgtgaggtatgttgatatgttccactgttctttattttcttatgctgcatgattttactaggttgtatgctccagtggtagaattgcaatttcctggggaggggcatccttgtcctcactttcatgaaaaccaaactctaacggtgttagtctatgctgtgagtttgatggtaggtatgctgggttccaatcgtttttggtggcaaatatgtaattatgttt

SEQ ID NO: 51094 - DNA, 8182 bp, Oryza sativa
ttcctgcagccccttgagtgaagatatgtgttgaatatgtccaagtagaaaacttgaaaattggagcaccactttttggtgtagtttagtgcggcgtcgaatctcgtggcaaatgtcgagatgttgaagttcttgtagacgtcgtggttggtgaagtaacaaactggtagcgaagacgcgtaattgtgaagattaaaacaccagtcatcggcggcataaccagtcggcgatggaagaagcagaatgatgacgaaaacgaagacgtccttgaacggcagcataataggcctgttgtgaaagcgaacacaacataggtggcggaggaggcaagccagcggtgaagacgatgtcgcccattgacggcggtgtgaccaaccagccgaggagacaaagccaccagtcgacggcgacgaaggcaagccgatggtgaagacgtaaatgcccatcaacggcggtgtgaccaactagccatgtaggcgaaaacaccagtcagcggcgacgaaggcaagccagcggtgaaaatgtagacgcccaacaacggtggtgtgaccaaccaactatgtaggcgcggcgatggcaagccagtggtgatgttctgaatgatccattcctgaagagtaggaaataagcttaaagccatgaatccctactatgcacatctggatttggatcctgtagaacaaacatgtaggatatgagtagtatctgatgtaaatatagtacttgaggaaaattcaagtatttaaaatgtttataaatatgtatttctcctcttgtcaattttaatttccctgagcagatgactccctacgtttaaacactctactcgactagtcatagcccccaagcaccgggaatcggccaaggcacttcccaaacatgcatatgagtggcatgagttcgtcattaatggaacaaagtttcacgggtctgaatttactacttgggtacttttgcaattgttaagagcagaaaataaattatcttatctctatacttttgatttcttccgagtaatatttagcacattgcgttatacactccatccaacgatcccccaggtgctagcaatcggcccaaaggcaactatccatcgacaaaccaaatggaaagcatagggaaaaagagctccataactcgataggcactttatttttactcggattattttgcaagcaatcaagataaatattatgaaaattattgaaaaaatatgatataacatctgtaacccccgactcactactcaatggagaaccaattgatatagtgaggcagaggaaaagaaaaatatcatataaggaataaatgatgacttagcttttagtattccccttggtaatgccagatgaagccgatgtgaggagaaagtcgtccatcaatgccaatgaaaacaccagtcggcggcgttgtcacgaccggaaataaccaacgggcgttccttacgtgcgtgtattattccttgtccaaggaggcaaggtacaccaaaagttgatacatttcagagtttatcaagcggaagcgtaaatagttactttattacatgggcggcgaaggcccagcacacacaaagacaaacgggaaacagcggaagactagggcgacgaccacaggcgcttgacggtaggcacgagctagacaccaaagacttcatcatccagtggctcctcttctgggtttgggaaaaattgagcaagactgagtacaaccaccgtactcaacaagacacacccataagtgcagaataaatgcaagggagtacaagggggttataatataaggggttagggtttgcagtaaacagcattaaaagacacttagttgctcaaagctattttgtaaatacggtcctagagctatacaatattattaatcaaggccgtgaacccacatgaacctgccttaacccaaggcctatgatgattcagatcgaactgcaacccgaccctgggtcccagcccgtcccaagccaacccaggccaaccattccacattttagttgttaagcaggttttaagaattaaaacactaacttgggtacattgctcggcttgtccataaccgagggcgcggctattcgaataggttatactctgatcagaggtgtacatctttacccacaagacacatcttcctcacgtgtaaccacgtgccacataccaccacggcatacggacggaagacatgacatagtttccaacccatcctagccatagacaagagtaccgacccaaccccacctacggccggaacccccgggacaggtaggcaggactgagcccctagcagcaggacaccggccctgtgccgtgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagttctttgcaatagaggcccgaagaccggtccttatatggccgagatgctactatcaaaaccatacaccccgagcccagcctaaaaccattttgaggattttgaatagagggggaggtgtgaatccaattccacaataatccatccattccatagtgtccaggtgatatgaatattcccaaattctagagttgtaaaaccacctaatgttacctaattaaccagcgaagcatctacctaaattcatactagtggtaccatgagtagagtgtccactagttggggttttgtttaatctagggtgaacaaggtaatattaacagtaacaatcataaggtcataacaaaggtaaataggcatggctagataaaacagtgataacgcgggaatttaagtaaagcgataatgcaataatttaaatcaaaataattttataaactgggattcaatatgttcaaggatgatgtgacttgccttgctcgctttcccaaacgtcggcttcaacctccacgaagagcggatcttccaaagctgcagcgtctacacgaccaacggaaaagaaaaggcttttactctaataaactccatataaaaagcaggaacaaagcacaaaaatgggttcttgacttcttaagaaaaaattagagacttgaacggtccaattccgagttcaaatggccaagttatggccatttgaagtttatatgctctttaaataaatatttgcgaatttcttcatttaaattttaatttaaaacgggtttattgcgtcagtcgagggggaggggcgcgcggaccgggtccacgggagtggggcccacgcggcagcctcacggtccacggtggaccgggtgcacccgggctcacaccggccggcgccgtgggtcccacgcgtcagccgcacccgagggcacgggcggctgacggccgggccccacgcggcagccactcggcgcgcccgagggcggccatgccggcacggtcggcgggagacggcgcgcccgcgccccgatggtcgccgccggcgaccaccggcgcggcggagcagcggccgagagaggggagggaagggggaaaggaggcgacggtccacggctcaccccggggcgacggcggcgacggaggaggcggccgaagcggagggaggcggtggcgcggctcgggtcgacggggacgacggcgctccggcggtcggcgaccgaaacggagaggtggacgaagtcggcgaggatgcggcgaagccgaaggaggcggcgcctaagtgggaagcggtcccgggcgaccgcggcggccgaccggaactcggcggcgactgcggaaaaagaaccacctggccaacttcaattccgcgaagaagaaaggccgctaaaagccgaacccgaccgaagagtgccgggagggtttaaataaggtttgaaaggggaaagaaccgcctgggaggaagaaaaccggcgcgggaggtcggccgccattaattgtcccggccagatttgcgggggccaatcttgccatttgaactcgagagagagagggaaaaaatgggggaaaagggagaggggatcacggggaatatttccccccactttattgcatgcggggacgacgggaggcggcgggattcgcggcggcggcggcgctagggcacgggcgaggcggcgggagcggcgggaggtcggggatgacgggtgggccccacccgtcagcgagggtggcgggcgggcccgcccgtcagcagcgcgcgcagggagaggctgagtgggccgcggggagaggagagagagagggggggtgggaggagagatgggccgggctggcccaagggagggaagggggacttttagggtttttctttttataaaactttttcaactttgtttatttcttaataattattatttgtgctctgaaaattccactaaaatttatttacacattttaggtttttaggaaatatacaaaaatcctctaagccttatttgacttttaactttgcacattttaattgttggaggctttcacatggattttaattattctaggcataatttaaaggatatattttagagtcgttttgggacgtgacaggcgttgacgacagccgatagtgaggacatggtcaccatcagcaatggcggcggaatacaccaaccgtgtggaggcgaagaaaccggtcggcggtgatgacggcgggcggcggtaaaggtgtagatgcccaacaatggtggtgtgacgaactaaccatgtaagcgaggaaactggttggcggcggtgaaggcagtcgatggtcaaagcgtagacgcccatcaatggcggtgtgactaaccaaccgtataggcgaggacaccaatcgacggcgacaaaggcaagccggcagtgaaagcaaatacgtccatcaacggtggtgtgaccatccaacggtatagacgaggacactagtcggcggtggcgaggcatgccggcggtgatgatgaagatgcctatcaatggtgctgtgaccaaccaaccatataggcgaggacagcagtcggcggcggtgaagaccaaccatgagtgcaaaggcaccagtcggcaataatagtgccgcggcattacattgaacaatagaaaatgccaagagattaatcttatatttagatatcaatatgataaatgatgctagattggaaggtaaaaactctggtgatgtcggcgttctaactcccgcgagcaaccagaaactccgtagaactcgggtgaccatgtgcacgacgatcgaaacgcggccgacgacagcgacaaacacggccgacgcggggatgagatcgccgcctagcatcatggaggcggccgccggccggtgagcacgtcgcccctggtggtacatgcaaaacaaacaacagaataatctaatttattagcaccgtagaaaacagatgcatatatagagatgggaaaatgctaagcatatgatttttttcttccgatttttgtacgatcaaacataacgacgcggacggtaggggaacctaacgcgagcgcacggcgcacgcacacgcggaaggagcgcttatgggcccgaaagcccaattaacctctttgcagcatctgacttgagattatatctatacttgagattatattagaataatctaccatgtagtattcaatctaactaaatttactgtctaatctgaagggaaaagaagatattttgggccttctgtctcatgactaaaagagtgcaatatgtttgaaagaagttctgcttcgtcaccatgtgacatcaattaatatgttgagcagcactatactttggctttaagtttgtctctaggaagtctctctgtatctaaacatatgcaaaccttgtttaacattggttcatatatatatatgaactttttctgcatccaattctgattgtggccattagattctacttccaactatggttgatgctatccaggaatcctaattggcgcgtacgcgccggcggcgcgcacgcgccagcccacacggcccaataggcggcaagacacggttagtttttcttttttccgaatttttctatatatgtgtaaacattcaacccagatttgaatactttcaacaccgacttgaaaactttcaactcatatttgaaaactttcaactcagatttaaaaattttcaactcaagattcaaaaactttcaactcaagatttgaaaactttcaaatcggatttgaaaactttcaagtacggatttaaaattttttaagttaagatttgaaaaatatgaaaactttcgactcagatttaaaaactttcatcccatatttgaaaactttcgactccgattcgaaaactttcgactcgagatttgaaaacttttaactcagatttaaaaattttcaactcaaaacatttttttaaaaaataagcgtgctaaagattaaaaaaagtaataaaaaagcgaaaaaaaagcgaaaaagaaaaacgaaaaaaaaatcgtgaaaaaaagaaaaagagggctgatgggcttatgggccgggagcagctggcgcgcgcgcgccagctagcaacccctgatgttatccatgtccaaggtgtaaggaacatatatgtatgagtaatttgcttcacctgccacataacaaatgagcgctaagtacaattactatataagatataattagaacgaaaattgcttaatatataattagaaagaagattgctttggttggctacgcaagcatgccaacgagagagcagactagcacgatagagcttgggctttggatatgggctcaacagggagcgatccgtttcatcgctaaaaaacattagaagttaggagagaaacgtttcatcgtacaaacgtcgtacaaaaacaatcgtatatatagcagtgctgataaacatgttagcagtatcaaagcacgaaggtgtatagatgagcatttatatatccgcagccatcacgcgggtgaatcgatctaatctgcttgcacacgaacggacttgctcctgcatcataaccagaagatctgaggaccatgcgagagcacaagtactgctagcacatggctgaacggccttgcggcggagatgacatcatgaagctgaacaggctgcccacggtggtccgtcagtgaaagctccaatctgcaccgatccgagaagcccgggtccgaccggcccccacgggtgaagattccggggtggattgcccccgcaggaaaatcgcagggagacaccggtgatgatcggcatggagatcgcgggcggcgcagcgtggttgatggctgttgcgttgccttttttctcctggtaggctgtgaccagcgatggccaccacaaatccgtcgtctcccgcgatattgcaaattggtttcatcgcacttctggataggaaactcgacgcactcctacctagcacgctaactgtcaaaactgtttggggatttgaatccgccggatgtagtattgatctgacgatctagttgtgaatcctttgccctagagggcctcctgcccacaatagagggcaggattataagataaaaaccttaaccaataggtatcggtttcttaaatctactttacaatattatcaaatcaggactttaggccgttctgttatatacaaggaaacgtaatacccaagtcatgatccatacatattccatagatataagttatcccctataactagttggataaccatgccgtgtgggtatggggtacccataatctccataatgtgacctagcaaagatcatttctccagtagtactagttaattagtacccaacgggcatgggcatgggcacgaggttttgcctaatagactttgcggacatgggttagacacgggtgcgtgggtctggggccgagcatggattcgctctgcccgtgcccgatccggtccattgtcatcctagtaaatacgttgctagctaagaaaggaggaaaaatacgtgggcttattggatgtatgtaggagtaaaaatgggatgggtacttcccgaggctcgcgagaggaatatgagagaaaaaattagatacccgattatccgagttcgaatctaaattcgttaaaaaatataggttaggatacaggaagacatgtatctgctcatatatcccatattataaaatatgtatgaaaatttattataaatccatctaaaaacatgataaaagattggttaatcattattttaagtgctcataggtaatattgtatattt

SEQ ID NO: 51095 - DNA, 6863 bp, Oryza sativa
atgggataggatacgggataagtgatatgttatttggtactacttatacccggctctaaatttaaatttaaaagataatatgagttaggatatagaaatgtcataatccgatcaccataccctacccgtttttaccactagatgtatgaacctagaattcttatgtcgattgttgacatgtgttcattggacacgcggcttctttttcttacatgggctgtcacaaactattcgcgtgggccagagacgtccgtccgcctgctcgttagaccgatctcttccaatctgcagccctgtttggcactggcacagcttcagctccagctccatctcttctagagctagagctcagccaaacaatttcagctacacctataatgagagcggagctggttggagctctctcacaaaataaactaaaaatgtggagcagggtttaggcagtttcacaactctactccagaaccagctcctgaagctaaatttaggagttggaactctactaaataggtcttgcatgtcacacgaataataacgaataataaccacattaagagcgggtcgatgactggatgtgttccggattagtaggttcagaggctaaggcattgtttagttcctaactttttcttcaaacttcaacttttctatgacatcaaaatttttctacacacataaatttttaactttttttttcaaactttcaattttagtcaaacttccaattttaacgtggaactaaacacaccctaactacgtaccgatttacattcatgattatacgtacattacggtccatatatatatatatatatatatagcacgtcacgcttaatatcattctggttataaaactggtaaattgatgagcgcgtctaacggcggtcgatcgatcgaatggataagcccaaatatatacaacattccggttatatattcaacaagaacaactactagtagatagccaaagcgttccatgcagtttaggagagttttccgccggaaaagagataaattaggagagtttcaacagtgacagcccaggcgccagagccggatgatcgtgcatgcctatcgtgattagttagcccagtcagctcgatcagattatttcatataaaggcaaggacgcaaggtgaggtgagagacacatcgatattatccaaacaccatataaacctttctcaccttccggattccggccatcttcgtttctcgtcttcgccggcggccgccgcatttctgatcggccgatatatatcggatcttcagactggtcgcagcaggttcgtgtccattctgtcagtttgatctcttttttgatcgcgatcgatcgtctttgtcatttcaaattcattcaggcgtgcctgtcgtaatcgaactcgattgatcgactacgtagagttccatttgggcttgattggcctcaggtttgaactgatcagtcatctattcatcgtcggcttgaaattagtcagccgttgttaggcaggttttgcttggactttctaggattctgaagaatgaagatatatatatatatatcctgaatgacgattttgcaaaacaaaaattgtttacgacgatcgaggaggataagtattagcattattatatatggtggtgtaattaaaaaggtacgatttgtttttcccgaaaaatatgtacgattcgctaattactaggcgatcaatatattgcaaattaaccaaaaggaatattattcgctcgtaggaggactgcttaactagtccatgaataatcaggataaggggttctgtgctgtgtcagcgtataataacagtagatgcaccgtacccgtgtaattgtgatagaacttaattaatttcaaacattatcttttactttgtttctagtactgttccggccacgtatatacccactagaccaatagtacataggtacatgtgctttgcatggtgacacatatgcatataaggttttttaagttagtgcatgcacaccgaaatattattactcaattattttgtataataagactaggtatttgcttgactctttttcctaaacaatatggatgttgatcttcaaccagttgctttcagtcttgatgttgcttgattttgtacggatactctaataagtcaaagatgctttagctgcttggccagccaataagaaacaaacaaacacaccatggatcatgataaatatgcattgctactctaataaggaactaaggaagtcagcaaatgcaggtgttgtgtttttttttctctgcatggtcctagctgtttaattaacaactagaatgcacactataaagggaggaaaaggaggcagctaacatgaaagtatctcacaaagtcacagctaatgtgctagtcaatttgttctctcacacactgagaaagatgttttttttttagaactgagaaagaggtaaagactccctattagggggttgggtacaagtatagtaaaatgaacatggtgaaaggagctcacaaaatggtagttagccaccaaattttttcaaacatttagaccatccatgcatatgtttagaaacttatctggattgttccagatattcttaaaaatattcttttaatactatggttgtaccatagcacatatatcataacgcaaagctacaaaaaggcagtgaccatctatcctctcatgtttgacttaacaaacacgtacacaaaaacccaaaaaatgtgaaacaagcaagaaccgaaggagctgcaagccacatcatgccttgcattgtcaccaacaaatcaataaatacctttcaaaataaatagacaccagacatatttttgtgtcactagtataatacaagaataaatgaatagacaccagacctattattgtgtgactggtataatgtatttatatccacaccaacatgatagagagtacacgttacacgtactttgttttggtctcatctgaagtctgaaatctgaagcaaataaacaaagaattgcagagaagaaaaaatgtgctctctttgtgttgaccacttagctcatccatggagataagcccagaggatgcgtacaaagcttctctcctccgttgagctgtatccatggttgttattgcaaatttaacaactccttgtcaccattgcacacagccaaaaacgcccctgtattcctgtacagaaaacatgcacaaactgtattttatttcttcagcatgtgctctgcttctgtattttcgtcagggagaaatgtctgacctttggagagaggctcagtgtttggagactgtcatttgcactgttttatccaatttggagatagtggtatgctactgtctactaccattgttagtagtactgtactgttttagagtcttggaccataaatatcttacgagtttataagtctcccaagatctttttgccgtttactcttcactgtagtgtccagttgtccactccactattgcatcagctaatcgaaatcgacaatggtgtgcaacctagtgcctaccattacatagtctcaaagaaagtgtacaattatttcagtaaaggacagatcagaaaagaaagaacataaataccagccatctgcaaaagttattacaactacaattttataataacttctttaatttctctctgcatggcttacattacattgtacactctgtattccttgtggttgcggctataataggagagcacaagagttgtagcttcccttgtcttgctcaagtgttcaattttttgtgtgcgtttttcagctcgtgtgtgattgagaagtacacaaggagaagaaggagaagacgacgcagctgccatgggagaagagaagcagaatgacgagaggaagaacaagtacgccgtcgggtgctccatcatcggctccatcatctcggtcctcatgggctatggtaaactacattagaacacctaattgacatgttattataacattttcgatatcggtgattttagtgagatcagtgatttaccgccgatctctgtctcgttcagcatgtacgtgttagcgggattcacgtgtcacgtgagtgcggtgtgtgtgcgcgtctttcatgtaatcgcgcgcgaaaaaataaagaaaaagaaggaaaattggcatgatgaaaaataattaaattgcagacactggtgtgatgagtggggcgatgctgttcatcaaggaggacctgaagacgaacgacacgcaggtgcaggtcctcgccgggatcctcaacgtgtgcgcgctcgtcggctccctcaccgccggccgcgtctccgactgcgtcggccgccgcctcaccatctccctcgccgcctgcatcttcctcgtgggctccgtcctcatgggcctcgcgcccaacttcgccacgctcctcgccggccgctgcgtcgccggcgtcggcgtcggctacgcgctcatgattgcgccggtgtacgccgccgagatcgcctccgccgacatccgcggctcgctcacctcgctcccggagatctgcatcagcttcgggatactcatcggctacgtggccaactacctgctcgccaagctgccgctggtgtacgggtggcgcgccatgctcggcctcggcgcgctcccgagcgccgcgctcgcgctcggcgtgctcgccatgcccgagtccccgcggtggctcgtcgtccagggccgcgccgaggaggcgctctccgtgctccgccgcgtgtgcgacaggcccagcgaggccgacgcgcggctcgcggagatcaaggccgcggcggggctcgccgacgacgacggcgccgccgccaacgcgggcagcggcggcaagggcgtgtggagggagctgttcctgcacccgacgccgccggtgcggcgcatcgtcatcgccgccctggggatccacttcttccagcacctcaccggcatcgaggccgtggtgctctacagcccgcgcatcttcaaggcggccggcatcgccagccgcaactcggtgctcgctgcgaccatcggcgtgggcgtcaccaagacggcgttcatcctcaccgccatcctcctcgtcgaccgcataggccggcggccgctctacctgtcaagcctcgccggcatcatcgcctcgctcgcctgcctcggcatgggcctcaccgtcatcgagcggtcgccgccgcaccactcgccggcgtgggccgtcgtgctcgccatcgccaccgtgttcaccttcgtcgcctccttctccatcggcgtcgggccgatcacctgggcctacagctcggaggtgtacccgctccgcctccgcgcgcagggcgccagcgtcggcgtcgccatcaaccgcgtgatgaacgccggcgtgtccatgacgttcgtgtcgctctacaaggccatcaccatcggcggcgccttcttcctcttcgccgggctcgccgtcgccgccgccacgttcttctacctcctgtgcccggagacgcagggcaagccgctggaggagatcgaggaggtgttcagccaggggtggcgcgcgcggcgccgggcgtcggcggcggccgtcgagatgccggcctccggcggcggcggcggcggcggcgccccgatggcgtagtgcgaagtgcaccgcggtgcgcgtgcgtgaacaaagtgcaacgcacgcgtgtggatgacgtggaagtgtttgtcacttggggaaaagaacgaatattcgctagctagctagtggtacagatggctagagattgaaatggaagggacctgatactactactgttgcatttgtaggaaacgactactagctaacaatgtcattctggtgtcgtgtggtgtttagaaaaaacaaaatcgttgaaatacagtaaaaaaaattaagaaaataaaaatttgtgctacagcaatggtaatagtcatcgggtgtcaagaacaaaaaaagcatttcataccgtataattacaggtggacaaggaatggaccagcatgtccctcaatgcggctcaaatagtcacattatttactgaatttttgtcggacatactccaggccaataattctggaaacattggtagatttgttagagagagagagagagagagagcagatttggtgcctcatctaatctaaatgctaaccttcgataagctactaaagtccaggcgcacagcgtattgcatagttaatggttgggccaaaaaaacgaagtgaaattggaccggaagttaggagatataggaataagttcacctaccgtcccttaactttacatcaggtctgtctgaggtccataatctccaaataccataaatcttcacccctaaactatataaaaacgtgcaatttcgatcccaagatagtatggatccgtggtttcactgacgtggcatcctagccagcaaaataaaagataaaaaatttatggggcccacatgtaagtgagaagggaaaaaatgtagggcccgcatatcttctttttctcttttcttctcctctcttatgttttcttacctctcatctcttctcttctcttaaccggtggcagagaggggagaggcggccggtgagcctggcgaaactccgccgcctcgagcgcctcgcaatgggagaagggaaaggggaagaggaggcagccggcgggaaatccatactgagccagcggaacgccgccgctgtgacccacccgaacagctactggcggtcattgaaggagggggtatgcgggtgggtgttggtggcggctagctctgcgaagtccaggagacgggtgtgggcgaagcgctggtcatggtagtaggcatcggtggcagcagagtggcagcggagggtgaggtgggcattgtgcctcgtcaattccacggtggtggcagtagtgcaccgctctagagaagcacctcgtccccgccacctccaacaccgatg

SEQ ID NO: 51096 - DNA, 1588 bp, Oryza sativa
accacctcccccacgctcgctcccgctacagacgcccccacccagggcttctgggcgcttcccgcacgggcggacttcggccagctctatagcttcgtggttgtgttggagatgatggccgccgcagcagccgcgcccgccatgcctggggaggcgtccggaactacctccgtcgcgacgcacgcccgccccgcacccccatccaccatcgcctcatcgtccccgtcgctgcaccacgccccttgttccccaccgccctaccgcgcctctcccttcccccatctcccgctggccacttcccctctcccccattccctcctctcgttgcgtggcgctcgaggcttgcagagcttggccaggctcgccggccgcctctcccctttctgccgctggtgaagataagagaagagaagagaggaaagaaaagaaaagagagaagaaaggagaaaaagaagatacgcgggccccacattttccccttctcacttacatctaggcccataattttttttattttgatgactaggatgccacgtcagcgaaaacacggatctatactgccttgggatcgaaattgcatgattctgtatagtttagggcaacatcaatgtataatatggaagtgggcattagtgtgggaccatgtgtcagtcagtagtagttaaattagccatcacaatgtatgggaataagatagggccacagaataaaataaatcgctacccccaacctcccgggtcttcctcccgcggccgatgcgatccccacttccccagtctcgactccatcgctaccttatccaaaaaaacaaaaaaaaaaagaaagaaggagactccatcgctgccactactcgcatcgctcgatccggagcggtcggccgccgcatcaggccagcctccgagccgccgacgcctcgatgcccagcagcccaggctggcggagcagcagttccctaacctggaacgcctctccatccaactatctcttccgatcccgatccaaaatccttccgctcaacgccgccatctattccggttgactccgacttgatgtcgtcctcatcaccgccagtcccccctctggttgtaaccaatgtgcttgctgctgaaatccgttgaagcttggagtagaattgccatttggttgatagttggtaggagccccaaaaggatggaagttgtgaaaagtgggtgttgaggattgagaaaactgtgtttgagagaatattgaggagaattgtggagaagtggagttttggctaccatttccagaagcttggctttgggagccctggctaagcatgtgcataaaacctctgttggggggattcatcttgtttgatgaaatgcaggaaaaaatgactttgagttgtgtttgtatttgtagaggatgaggttgcagcgttgctgcaagaagttgcaacggctacaaatgtaacggctaactgctactctattattttagtacaactaacagaaaatcactgtacacatgctattttttgttcctctcttgccggcagtagcactactacctggatgttgctattatctactcccacaatggctactacctgcttagatgggtg

SEQ ID NO: 51097 - DNA, 2454 bp, Oryza sativa
  unsure (1)..(2454): unsure at all n locations
ttatgttggtactcgttctgtaagtgagagcgaacgaggggtaaaggaaaaaaaacttaagtaaagatctttaacaaatatgttcaatgtgtatatcacgtgatcaaactcatctaacttatatacaaattagataaaaaaaacactatccgaaatcaccttaggggttatataaatatgtcggagcccaaaaccaataacttggatccgactgagattaatgtatcaatccctggatcagtaaaattgatacatacaatataactggttcttcattacatatgttaaagtcttacaatactaagggttttacaataataggtactcacctatctaattaatacacagcggaagtttctatacattctgactagtgaggtataaccttnannattttctaatttatcggggtcttcgtagtaatagtcataagggtcctcctcttgacccagatctgaaaaaggggttataagagcaagggtgagtatttacaatacttagcaagttatcacgggaatatgttatgcattgacatataagggagagtctacacatctgtcgacagatttttcatcataaatntgtcaaattttgtacctttggattaaacccataaacgatagatggatgacacgtgtacagcactgctgaggtcccgcatctactaatcgatagtatggatgggcttccgacgttaattcacactctcgtttcttaatcaaaattagttggttatgtatccatattaattattaatccttgagagctcatctgctcatgtatgtgtgatatctactagatattttttagtgcatacaaagatattaccaatccatctactaaagttacattgttgttacactataattataccatagttacaaatgtaattatggatagttacactgtaattttaattacattgttgttacactataattacaccatagttacatatgtaattatggtataattgccctgtaattttaattacattgttgttacattataattacaccatagttacatatgtaattatataattatagtataattgcactgtaattttaattatattattgttacactataattacaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacggacttgtctcttttatccatcgtattagttagcacaaatctccacgcaaatcatatggcccaaaaatcgacaaatctttaaacgaaaatctgtcgacagatggatagcgaattcggacatataatagggttctttgcaaaaagcagtattggacaatctggaaaagttatagcaagaatttataaaacatataaactttagatttctaactagggtaccatatgagtcccggtactcaactccatgagtacggctattcgaatagtttcaaagatattctactgcagtagatgtacgctttacccgcagtccacgacctgctgataatcatcgactttagttgtagcccagtattaagttattaacaattttggcacctgttctatgaatttatatcctcatatgctctgaacgtaatgttaacagcagcaagaggagttctggcgtttccgaggtatttaagaggaactgatcgtatgacaccacgtcatctcgatcagggtttagaaatataccatatagtttatactcgagtatcacaaaccatttacatgtacatggtaatggttaaagttgcccttcgcggctatagttgcctcctgcgtgaggacttaaaaataagaaccactatacagaggtgccatattgctaattaacataataactaggtctgtccccattctagaaactgcggtcgtacccgttcgttcaacataagtacctggcgaaacttatatcgatcgagacaatactagccacccggaaatcatccaaatcttacgtattgtcccaatctaagtatagggtattttaaccagattgtaagcaaaataagcaatactaaattatctgagtttctatgattgatttatgcatagaaaatagaatattgaatagaaggctataaataaataatttgtaaaatataggcttaaatgatcaacaggtatatggtaacttgccttgctcgatgtcctgagattgattgatattatctagtgtgtcagaggaatcctcaagacctagggttagacatataaaattcaaattcaaaaggaattcacataaaatccaaaaataagaaaaatagagaaaataaaataaaattcaaaaatataaaaaaggggctcaatagatagagaatgatttttgaagaatattggtccaagtttcactgaaattg

SEQ ID NO: 51098 - DNA, 4400 bp, Oryza sativa
acctgtacaaacaactttccaaatacttggatgcaaagaaattagatgcaacttcatcttgtgcttccaagcggcgtaatgtgtcccatcaaattgaggaacacgcccggaaggcacggagacaaagttatgaggaggaacattaagtttgccgtaatcaaagtgaatagtagctcccttgggtccagtatccttggtgctagaagcgtctcccttgtcatccaaccccccggttccctctagatgcgacatcgtggatcactccaagcggtgaaacttgaatcaagagcaccttgctctgataccaattgaacgtgcagagatgtagcctagagggggggggggatgaataggctttcctgaaattttctcaacaatcgcagcggttaaattgacagggcccgaaacctcctggtgatgaacaccggaacttccgggcaggatgagtagcccggaacttccggagttcttgagccaggaacttccgggcagcagagataatttgaaaactgagaaaaaaaacaggtcctagctaggaagttcaggcacacatatgcacaagatgaagatcacaagatatcagcagattcaaacaacgaacatgcacaagagagacaaagacaattttttcccgaagttcggatcgcacggatcctactctccgttaaggtgctccaaagagccgggtctcgattaaccccttgcctcacttatgcaaagatcccagaagaggtccacagccttcaactcaacacttctagatcattttctagaattgagtgaccaccaagatccaactcaaaattccttctagaaaagaccacaagtgcaagttgctctacctaggacaacctctgaaaactcagcacaagaatctttactcacttacctcgtttccttgcggaggtgaggaaaaccttcacaaactttcccgggacatccataagatctttggaagctcacgggcgacacctaaccatctaggagaagatctccaagagtaataagcccaagtgacagcccacaaggtatccaaagtgctcaatcaaccctaatcttcaagccatctcaaaacactcctacgctctcatctattctctcaatctcacaagataggctctaaatttgagtggaggaaacaaaggaagcttgggagtgactagaaaaccctagaacatgaatgaactaaagtggaatggccaaagggtgaccttgggacgaaatccatatatataacggctaggtgacgtcatctagccgttacttacaagtttgaacgggaaacctgccaggaggttccgggcaaaagtgccaggaacttccgggcagcacttaggaaattttttgctttgaaacaacgcccggaagttccggccagaaccttcgggtagccctctctgtcctggggagaaaatcatttttcaaaaatgattccaaaaatcttttgactcatggatatgactaagagcactgtgtataccctagaaccacacttgaaacccctcttaatagtacggtttttctgaaactcaatttcgaaagtgaaaaacctagtctaatcaccttcggtcctttttgcacttaggaacattcaaattggggggtcgccttgcattcttagtcatcacaacatgctttgggactaaactcatgtaaataaacttgataaacacgttagtcccctttaaccaccttgtcattaatcaccaaaacccactagtgggtttaagtgcaccttcagccagtggcgtagccaggaatttttccttgggtagtcctagttcgcaggttcacatcacatgcttaaagtttctaacaccaaaaagccgatacacaagtacaaatttagtaaaaatgcaatagaaataatgccttgcaacattcataagtggcttacttaacaagcaagttctcatccaaaatcttaggcatctaagtgaatatgtcaacctagccttattctcatccgaaacattcactatggtattatcaattggtgcatctttcacaaataaattatatttctcttgagctttattgtgtgcacttgttaccgcacccacatgtttgtcaagtgcattggatttgttccaattcctccaactacccttaaaataattactacttccattgccaaacaaatacaacatactatgcaaaacctagcatccttcgccacattatattcaagccaactatacttatgaaaccaaacaaagcagaagtgacgttgcttaccatatatatttcttgtggtggatcatcttcgagtacaggagcttcgtcattaatatataggaacttgtggtggttcctcttcgggtacaggagcttcatcaccaatcctctttgcttttgcttcatggttccgaaataacgatgcaatatatctgctcatcttcatgttttaccaatcctacaaactatggcatacattcactaatcaacattcaacaaccacaatttacaaagtgcatactcaatcattctcagattcaggaatcacaaatcgatttatgaagcaggagtggacactggacagaggaactgaggaagatttcattacctaaagtagagcagccgatgagccgagcaggaggctggacggtagcggagagccgaagacgggcacgggcagacgggagatggccggcggcggctctgcggcaagccggcaaccggccgacgtccggcagcgaggcgcagctagcgacatgaggagcgaaggaggactggaggagtcgtgctgtcgtcacctcgtcggccagacagccccaaactcggcgcggcgccggcgtggatggcggtcggcggacccacgggcgtcggcggcggtgtggctcggcactgggctgcgccggcgttgacggcggacggcgaacgcggacccacggccatcggcgcggcgcaggcggcggtcagtggcgacgtggagcgggcatcgggcacgaagggagtagcggctggaggtggaagcgctccagcctccaggctcccccaactcaaccctaactcttcgtgggctgttactattggatttgggccaaaacggctggctgggcctaattttttctgaggggtgggggtctctgggccaaattctagggtagtcccgagcccaccgggactaccccttggctacgcccctgccttcagctacatcacatcaaccacaaatcattgcattacctagtgcaatcaacactagatctgcatcaaatcaagttcaaaaataaaataaaaattaactaaccattaatgaaaccaccagatacgcactgtaaacacctaaacaaaagtcccaaatcacaaatatagcaaatacttgcaaaaaaaaaaacgagagtaacaaaaataacagaaatcgacaatgaacaaaagcaataacaaatggcacactcacatggctttgatcagcgatgcatggcttcctcatgccgtcgtttatgcagagttgctgtcttcacggccgcactaccactcgcggcactgctcctagaacgtgttcaaatctagaatgaaaccatccgcctctgcctccacctcctcgtactctcatcatggatgttgcggtggctactgatgccgacaacaaacgaaggggaaggaagaaggaagcaaaacatgaaagaatcaacaagggaataagtactcaccagagaatctccgttgacaacgagctcctcaccatcgaatcgtctagaagtcgctccggcgaaatcacctccctttcaccatggcgacatcgccgctcccctgcctctcttagagcttcgactatatatatctctctctctcacagtctcggagtaaatgagaaaaatcagcagtgggaccagaaaacaggctcagatttttcaaaaaaaaagtgaatagtggttgtgggacccaccaagcccaagaaaacagaacccttcaagcccagcccaaagaagaaaagaaggatggcccgaacaaaaaagtccatcccacaaccccgtgaatgcacgtctcctccctctggccacgcccggttcaaatgccggcggtgagcagaaagccagagacgtaacaaacttttctccctccgctacggctacttcttcctccccacgccaccccaccccacgcagagaagccctcgcctcggcgcctcgccaccgcgcgcgcgccgcctcgcccaccaagtgctcgaccaaagttccgctccgcctcccgccgagcggcgagccaagccacgccacgccacgccgagaagcgagaagccgaggggtagctactcgccaccgggcgcgcgctcgctcgctcctgctcgcctcgcctcgccaccgcgacgcgacgcgacgctgcgcctcgcctcgccaccgcacggacatcgatcgctcgctcgctcgatgatggaggttttccgtggtgtggag

SEQ ID NO: 51099 - DNA, 1671 bp, Oryza sativa
caggtccgggcgctacctgcgagggaaccagggtttcttgtctcgccaccacggcgtctccgtcgacgtcaacatcggcaacgagatgacgttgcggtgggaggttgtgcgcgttcgagtccccactcgtccggagcgaccgatcgtgcctgtgagttccttctcgtccccccggattattgtgtttgttctgtttctaatacgcaattctacgaattgaagcaaatccttaatgttaattgagctgggaataaatcttgatttgttgcgaattaacagtgtgcaactgaatcgatcaaattcgttctaatacaattcttgattctgtctgtgcagcacttgccgtgctggccccttctgaatagggagatccaattcgtgactgtcgatgacgccgataacttcggtttcggttcggttcgattcactggtcgatcggtggatctcctgagagaggaccttatgcgacgtattggttacgacgacttcaccatgtgtgtccgggccggccgccatgggcggctcacccctctgttcattgacctgcctcacagccgggagacactgtgcattgttcttatcaggcccaacaccccaggtaagcatagcagcttagtttgatatgcgtgttgctgaattttctgaacatttgtttgtgtagttcggtaagcagtgcactagatctgttcagtaatgtgaattgcctttgtgttgaattttgtggaaatcactcaagcagtcctgtactcctgtgtgtgcatgctgagtatggattggtgataggaatgtgtttaattcctgcaatacattactgctcaagcttaactaggtagaaatattcatgatgttctgatgagtgatgacagtaactgaatcttctgaagcattcagggccttcctctaccttttatttgggatttttgatgctaccagtttgcagatgccacatgctatgcgaaatctagttaattactggtgttacttgttctgctcactatcccaaaccaattgttaaataataattaaagaacagttctgtttttcaggtcgttttcattcagggcatgcccctgtctttttgacgcgtagcatctgcaatttaaattggcagcgtagtactgttttttactatcatctgcaaaaatcccaaatactgtttttacttgcaagagtagtactatcacactgacagactaaccaactgcatgatttctttactatggctgcagtgaatgatcggttgctaacatcaattctgaaagctgaggatgatgctacaaaggctgctgctgtggagctgcagcaccggcaagaattgctgtgggagagggaggaagcgctaagagtccggacggagacagcacttcggcgatgggaggggaggcttcaggggagggaaagagcaaccagagtccgggaggacgcgtcgctgcagcgctggatggagggtctggggaggagggagctcgccctgacgcagcgagaggagagggtgagcgggatggaggcaacacatcgagcggctaccagcagagataaaccctctgcacctctactgaagaaggtatgcatttggatcccttagaaatatgtgctaaagtgtttaactgaacagcagcatttgttagtactaatgattttgagactcttcacaggaggataacatctggg

SEQ ID NO: 51100 - DNA, 7557 bp, Oryza sativa
tgccctggtcctatacactcttcacttggagatgatggaagcgaagggatactctgcagcacctttgtcaccattggcagatgtcagtaatgtcaccctgttcccagtggtactggatgatcaaacttggacagtgattttctggatctactttgtgctcgtgctttccggacatctgtatgcttgggctacggtatatatcttcgactcttaatttatgcagtttattttatatttaactccctaataatatttgtctacgcgcaggcttacatcacagggtctgacaaagatttggagtagtccatgccttcacattttcgtgagatgtttgtttttttcacggcccgaggacaagtggcccagtagaggataagaaatcaaacaaccaatggaccagatgcatatattagtgtactgttgcaattgcaccctctcttgaccttttttcctgttaggataaacattcacgtcatgaaacttgttcttcttagcaatattatttcacccttaggtggtgctattttccttatatgatgatcatactgttgttacgactggaattgagtaagatgtatgcattcaaaataccgcgacaagttcatatttgtgatatatgctttcagacttattaagttttgttgcatgatcactgggtgaattatcaaaagcaatgcataataacagagttcatatatgtaggacaaggttatcgtgctgttttgagccctgccacaaattgagagaaatggtccactatatattgtttcatgttattctcatatctcaaatgtcaatgtaaaactctttgcagtagaatacaaaggttgatgcttgagtattctgtattgcatacatatgaaaatttagaaataatgtctcactgaataattcctttttgttgtggctgagcaaatggtgcattaactggatactggtattttgcatcagacggtcactgcatgttcttctggtctggctcactggctgactggtttgccttcttttatgattaatttgatgatgttattttgggtccctgggaataaacaaggaacgttctggttctaatatattttagaagctaatatactactccctcccttcaacgtttgaccattcgttttatttaaaaaaaaattattactatttttttttgttattattagatgataaaatatgaataatacattatgtgtgactaatttttttaaaatttttcaaataagacggacggtcaaacgttgaacacggattttcacggctgcacttattttgggacagaggtagtagcgtacaagaggaatatacagcaaaagaaaaaagagaaaataatcctacacctaaaccaattatcagaaaaatacaatcgtacacctaaaccgatttcaaaccggtcgccaagccgtctccagatcggacgagattgacacgttccaattcgactggattatgcatggaccggaaccgcgcgattccaactccgattcagtatcaaaaaatatatatatatatatatatatatatatatatatatattactccgtgtgaccttgccgtgtatcgccacaaaatagagaccgtacgcgtcgccgccatcaccaacacgacgtggatcggacggacggacgtcgttctgcaacggtgccgtatgggtggttcgtcgtcggagccggagtcgtccgatctactgtgcagcttgctcgaggaaggacgtcctcgtcctctccatctttgcaacacggaggtgatggcccctccccttcctgcctgggtcatcccttacagagtaactactccatctgtttttttttttaattttccaacagagttttttttttcttcacgatgctttttataacacaataacttaaatagagtaataatccattctccttttttgtgtgtgtgtgtgtgtgcagtggacctgcttgcccgtgtgctttgccctactgattgttttcttcacggttgtgtatccaagaacaggcaggtgtaatgccgatggccttggaaatggaatgtttctatgtgcggtttacatggtttgtgcctctattgttccgatcgtggctcttgcgactttcacagctagtccacccgttaattagagatgtgataatcagtcggggcctctaatgtgagaggggcttttgcgttcatttgcacccacttaattaatttttgtaagttcagattatgcatgtatctgtttatgattatgaaggctaatctgatatttgattttggttttgctataattatgtcgccataaatcttgttagattacagtcagatttgtatccccgggatctcctattagattcgtgccggagtacttccgtgtctctgccataatgtatgttcacacgctagttcataagaatatgattaacaccaaattattacatcaaaataaggtaataatcatagaaaaggagacgctatattttttccttgtaaatacatacgtagctttagaactcacattataaatacactaaaattacatatgtaattttaagacttatatatgtaattttaagatttacaatgtaaatacacgttgactattttttgataaaaaatgtggcggcgtaaatatagatagacccgacaaaataatcctatatgctggtggacattgtgttcctgaccggagtttttggaggaaacatggtcacgtaatcatgagatctaaaatatctcaaaatccatccattggaacccaaaaacttatcccaaaattcctattcaaatatcaaaatctaaagctcgaattttccctccaaattaattctcccttatctccaatatcaaattctatcaaaattttccttgaactcctttctttgcacctcacttaaaatcctgatcctgagttcaaatattaaattgaaaccgaattcaaattcatcaacatcccttcacacaaattcctgaaaaaatctaagatcattgttcacatcatccctttcctcatcccagcccacgcagcctccttcctcttcctcccctctcactctctcaagctcggtctcccctcttggaataagttcactttaatttgacacctttaattagtggccggatctaactcgtatccctgaaccacgataccggatatcttgaccacctcaactactaaaaccgatggactttgactcccttggcaattttggaggacggtttcatcgacatgacgcctacgtggcggtgttgatctagtcttcgttccacgtggcattgatgtggttcttatggcattagaattaaaaaataaatacgggacccatttgtcattcgcacaaaagatattgtgggagccactgacatgtgaggcccacatgtcatcctctctccttcttccttcttctcctcccgctctctcccctctctctctttctatccctatttctcttccccattggacgtacacggggagcgggggccggattggtggcggcgatgggtgagggccagagacgggcgtggggatgaaggcagtgacaggatggtggacactgtggcgaagaggaaggaggtcggccgcatgagagggagccacagaggagcactggtcgcgataccaccattgtagagctccagccctacctgcctccgccatgacgcctgtgcacctcgcgccttatccacctgaccctcttcgttgtctgcacacacaagcaacaacaacaacaatggcatcacggccaatccccacgccacaacacaaacaagaagcatacacgtagagggtgtgcgcgtcaccttgatgtggtagtagagcgtgtggaattcgatggcggaggagacggagatggaggctggagcaacgggagagggggaaggacatgcagacgacgacgacgacgacatgaaggtggcaaggcggagtgggagggggtggtggacactccagtgcccgcctcgcgccggccgttgccacttcggtccccgccagacgccaccgccaccgccgccctcgccctcacgcagtcgttgccgctccagcgctcgtcgccgctccaaccctcgctcgcatgccaccgtcgttgctccagcgcctgccactgccactctggcccccgccagctgcaaccgccgctccagcagcatccgctcgttgtcctttttgctcctccgatgaagatgtggagcacctcttcctacgctacaccggagtggcaacaatctggcacgcctttggcttggacgaacaacaaatcgcctccctgccgcagcttgaaggtgtctgggacattcctccgccgggacaacccgccactccaagagtctggcacaccatcctgcttgccgtcatgtggaatatttggaaacgccgcaacaacaaggtcttcaattccgttgacgatcctgcctcgttagttctccaacgttgtgctagtgacattgacctttgttcccaccgatgtaaaaatgctgagagcaagcaacagctccgcaactgggcctctacctctatgtaattatctcttaatttattttccccttctcaccccctgtaacacctctcctgtaaatgtttcttcatttcaataaaaagtttaggctagtactttaacacccgcagtagtttccctcaaaaagaaaatcccttgtgtacccataaaaactcacctaatcccttacataccctcgaattttactcaatcctctctgtacccccaaatttttcactttgattccttccatgcccctcccattatgtttccgtttgatccgtgacttaatctgtttgttacattggcagtattttcaaaaaaaataccaaaatgcccctggcaatcctagcaaataagatcgaatccaatcccttctctttccccatcctctccacgcgctggcacgaggcgcgccgccggcccatcccctcccgtcgagagcgccgccggccaccggcctcccgtcgcgctcgccgccggcccatcccatcctgtcgagagcgccgccggtcactgccatctcatcgtgcgcgccaccggctactgtcctcccgttgcacacgccacttgcgatgcccatcctgtcgcgtgcaggcggcgtgcggtggggcgtcgccggccactgccctcccgtcgcgttggccggcgtccaaggcgcgggggccgccgtccacggccctccgtcgtggactccactggccactgtcctcccgtcgtgctgccgaagtttgctgccctcgcttcgcgggcgccgccggccacggccctcctgtcgctgcgccacccatcatcggacccagcactgccctagtggtaggttagttcttcatttcttcttcttgcccaggaacctaatttggtttgtcgatttgcaacatctatgtatggaatggaaagttggtttggttcctgcaggcatggaaatgaaattctggtgtgtgcatgatatgaattacagtattctgtatggatgatggaaatgaaattgatatgaagtgctctgtgaatgatgatgtatgatgttcctgatgctcttattgacctaattgtattttgtttcacaaatttctgcatggatgctcttctcatttcattcctatcaagtggtgctattaatggtcctaatatttttggatgctcctgatgttttgcaatgtattttctcctttgtccacagcaagttttgcactcctgctaactgtaccaattttttttttacagtggaaactgatgtcactttgattttctaacactattattttttttcaaaataaaaagtttaatgtattgtattttcttcaataccatgataaaattcttaaactcattatttagtctcatagcatacatatattgtgcagtcaacatttttcaattattttccaatctacttggtgctcctccatctacaagagtattatggatatttgcaaccacagttagctggaaaatgaaggaaacataatggggggaggggcatggaaggaatcaaagcgaaaattcaagggtacagagaggatcgagtaaaattcaagggtataaaagggattgagtgagttttcatgggtacataagggattttctctataagctaagttgatagcgacacacctgaggataactttttctttggtttgatgctacaactttcagcaaatacatacataattggcactacaattaagtgcgtgcagctgaaacggttagggaggaactgtaagagcaagtttaatagtatagccaactactagctccaattcatatatagtcaatctaatagctcattcatataatagttacatactacactattaatacatggtcccacctatcatacacacaccgcgtcttggagtccgtgctacagctgactacaaatctgtagcccgctggccttctctctcctcatttatctccttaaaatatgtttacagctggcttatagcctgctattgtatctgctcttaggagtttatgcaagtgaaacacacttttataagataatgattaagatggcattgaagtagtacgagcaagtttaataatatagcccactactagctctaaaatttaaaacatcatctatagtcaatctaatagctcattcatacaatacttagctataaaaatacactgcatcattaatgtataatccacatatctctctcacatactttattggagctcgtgctgcagctggttacaaatctgtagcccgcttttgttctctctcctctcctctctccttcacacaagcacaaatctgatgtggcaacttatatagcccgcttagggcacccgcaatggttatctataggctctctacaagagatccatgtcagcatattttcctacttggaagagattaaatgaagagagagaggaaagctatctactaacctggagatagtctatagagaaaaacgaggcaatggattagagagctatagatacccatgtagacataccattgaagtggtttactattaatctagtctattgctgagatgtacatgttttatagatagcaccttactttaccattgtgggtgctcttacgttaccttattgtatttgctctgaaatctaatacattggatgtgcaaccaaccttttaacctcaacttttaatgcgtgctagtattttactatgattgaaagcgataataaacaatgtatatctcatttcggattcccatgcatgcacttgcgtttacattactcagagcatgcgcaatgtggaatttagagagattctataggagagagacaaataggatcggtcctacacgtatgggtgatttttttcgctgatcctaaagtacaaccgggcactagtcttgatgcccaactcttaactgctcctaaggtagaaccgggcgctagtcttgatgcccaactctatcgagaaagagtctctgtcccacctatcataggcagtcatctacacaaactttattttaggcaaaatttgctatagggcatcgaaaaaacgtgtaattagtttgtggacaccgcaagaacaagaatttgctaacgggcatcacaaaaaacgtgtaattagctcctggacactcggggccttatttta

SEQ ID NO: 51101 - DNA, 2265 bp, Oryza sativa
agagtgcttctcggttcccgtcgacaagagcatgcctcctcctcgaccacggccacgggccggagcagctccacctgcatcagcccgcggcggccaccggcggagctcgtcggcttcacggacttccacgcgcggtcgatgcgcagcatcttgagctccacggcctcctccttcctgtcgtccttgtcactgttgtcttcctcgtcttccagctcggcggcgcagatggggggaaggcagcggtgcgcgcgtgcgtcggttgctgccggcggcggcggcggcctgcgcaccattggctggcggcggtggcgcggatgtgcatgcgatgtcatgcgttggcggcctacgtgggcgcggcagcgggcggcgcagagcgggctcgcctttctccccctctgcccaacgcgctcgtcgcgccgccgccgcgcggaggaggtggcagcggtgctctggccggtgtgagggcaggggcaaaatcgtactctcaccagtgtttctctctccaagttcataggaaatattaaaataaggcctcgagtgtccaggagctaattacacgttttttcgatgtcctgtagcaaattttgcctttcttttattaaccttgatgggtcccactcatagcacttctgatgatgcctatacattacaaaaattttcaccagatgctatccgatccgtgctgtggggcccgccatatgagccccttcctgcactatacattacagatgctcttagagcaaggtcaataatataacctctgttcagctccaacagatagccatgtcatctatagtaaaaagtgtagctaatgtgtacaatagaaatagtatagcactaatattttattatcttaatggacccaccatcttctataatctccctctttctccctcccctccttcccttttagtgggtctgttttcttggagagcgtgggtagccggcgcttatttagtcgcttgctctcgttctctctcttccgtattctcctcgagctaatcgttagaactgacgtgtagttttgatcgccggttctggagccttattgtacctgcttttaggcgatcagacagtcatggtatgaagatttaaaagtcatattcgtcagcgcacaacgaaccgacgatgccgcaagggaggaggctgccgcttcctcacggtggctgcggcgcactaggtcgaggtagggctcggtttcctcgcatcttgcaacatgttttgtccatcttatttagtactcctttcgatgatccagtatgaaaatcatccaaagctttcaagacgtccctgaggattacgaccattgggcgcccggatcaagacgtcttcaaaacaggctttaccaaaggcatcgcgccgccgtgccaccggccacgccgccacacggcgttgccgagagccgcgactaccgcgcgtgctgctatgcaccgccgccggccgcgccccgcacggcgccgccacccgccactgtgatcaccgcgagccgccgccagtgtgatcactctaacattggtcattcatatgtgagcccatagactataggattcacatgttagcctctcaaagtctatttatggtatcatcctgtattataggagtagaaaccatgcatgtcttcttaaacttttttttttcacaacttaactggctcttctatttattttcctcacatttattttttttagagcacacgtgtattttacgtatttttgctactgttatgttatcaaaggtaggataggctatgcaattatttaagtgcttataagaaaatttccaataaaaacgagaaaaaaaccccccctaaataagtcgcataaagctagtgcgcaaccctccatagcgagcggttcatcgccgcggcacaaaatgctccgccgcagccgccatttctcccacccagaccccgccgccggccgagacctcgccgcgaggcccccgccgccgagccgcccaccccgacctacacccgcgacgtcgtccgccgcgtcgacgccatcctccgcggccacccctggtcggcggcgcggccgctcctcctctccctcccgggcctcgcctgggactcccacaccgtcgcgcgcgtcctcaaggcgcacccgcctctccacaaggccttcctcttcttccgcctcgccgccggcgcaggcggcgggttccgccacgaccgcttcacctacacctccatgctccacctcctcggcgaggccggccgcgtgccggccatgatgcgcctcctcgccgagatgctccgcgcggggg

SEQ ID NO: 51102 - DNA, 707 bp, Oryza sativa
aactctctattgctcttggctgctattgcaaaaaggtttcacgaaacttgaactggggcagggtaatttactatcctgttcagcattctcctgcaccttttctgaatagttatctacaggtatgttatatgaatggctcaaattcttcataaacagagaaactagttaccaatgtcaacatgtcatggaagctgagttatcctcaaaaagctccaacagcaattttagtttttgctgggtagacatgcccatgaaatggtgataaacgattgggtaaatatgagaagctgatttataatttgtcatgtcaattcacatccagtcagcaggagataactgagctagaggttgcaagatcctttgccagcatactgcatatctacatcacagggagctaacataaagacgatgaaccaagagagttctagttgtgcattaatctagccatccaaatctaagcagcctcatgcacatatattacatagcatggccaacattgaccaaacatgttgcatcctatcttgaatctgttagttgaagacaaccagttctctccatcaggccactttcacgtttgtcttcagcctctttgcagcctgcacgaaaccaacgatgacctgcaactcatccaattgcttaaacatggcaattgggattcacaagagacgaccaagatgtcaatcaagcatggttatgcaaagctgctg

SEQ ID NO: 51103 - DNA, 1024 bp, Oryza sativa
  unsure (1)..(1024): unsure at all n locations
aaatcctgtaggcataagtggttccactcatgcgttgcctctaggagaagagtagctttatgatgttcatatcgatttttgaaagatgtccacaaagcgcatgggtcctcatacatgtactccattttcaaatcctgatggatatgattcctcataactttcaaggcagtgtatttagacatgttagagggggcaacgttcccttcagctgttttatttatacatttgtatagtccattggttgttagattaactttgacatccattgcccaagcagggacattggaactatcaagagcgaggatatcaaactctttggttgctatctcacctacattgtgatagccaaaatttttgataaatcatggcatatttatgccattttatgtaaattcataaaaaaataaagcgtgtgtaaaaataaaggacatggaaatgcatagaatgctaaaacaaactcatatttataataacagagagttacatggtgctgaaagcaaatgtatagtctctgattatttgcggaaagtaatttgaccaaagatcaggagctagaatgtaaattttggataaatgaagataactgggcagtgggccgatacaatctcggtttcaacccaccgccgctttcggtccaggaaggcgggatgggaagcgcgggcgcacaggggccatcagctggcaccgcaccaccctcccttcaaacagtcgcagccgacagtccaccgtcattgtcgatctgtcgccaccgcccgtctctgccaggacatgcggcaaaggccggggcacgcgtttgccgccccggggnnnnnnnnnnnnnnnnnnnnncagtcggacggctggggaacgaaggggccggtggtggagatggaggggagagcacggagccgttggagccacctactgccatgtagaagggcggggctccacggcacatcacgatggtgccactgagaaggaacaacggcggttcagtcggtgttggagtgtacagcggtgttgctggtgagtactctggtgaagg

SEQ ID NO: 51104 - DNA, 1065 bp, Oryza sativa
gaatgatgtgttggacattaatggctgattcatattcatgggcatcatgaagtttggctgatgaggcattgaaggaaacatgaaaggcgcattaggcatcatttgctgtttgtcttgactaccatgctctgattcttggcggactggagtcgccccaggtgcattttcatgagcccagttgtagggccgatcaaatccttgaggcgggttgttctcacttggagtatcccctggtggataagagtgacgaccatggaatgatggtggtcttgatagcatagggggcctctgtggggtctggtctctggaatggtggtagcgagatcggtcatcacgatcttgcacatgagaacttgaagagggtgaaacaccagtccgaggaggagcacgtgcagtagacatttcaggcatctgagattgtctttgatcacccccagaagcacgggaaatgttaggagcatctggctcattacgttcttccctctctggagtattgtgcaggaggttggcatgaacttcaggtatatgagaatcaaattcagatctcttaaggaaagacttgagacacataggtgcagcacagataaaaatcccttccatcattttcacagtttgaatcttctgaatgcgctcatcacaactgaaaaaaataggttaacaaaagtttaaaagtggcaggcgccaaaccaagttgatctgtaacaaaatactagaagataacaatgctagctagtaagatttctcacttttagtgcaatatttcttgaaaaatcttatgagcatgtgcaacatttgattggcgaagagacacaaaaagtagcattccaaggcagacagcaacatgaagtgtatcactgcttacccagtgtccatagctattgatgtaaaagattaacacatcccatgaaagcaataacagaatgcaaacaagccatagtttattagtagtaccaaaccatttgaaattcatgcatactataatactccctccgtttcaggttataagacgttttgactttggtcaaagtcaaactgctttaaatttgactaaatttatagacaaat

SEQ ID NO: 51105 - DNA, 9305 bp, Oryza sativa
  unsure (1)..(9305): unsure at all n locations
ttcctcctttcgttggggcctttcgttgccgagtttgggccttttgggctgcactttggcctgctagaatgtaaaaaaggctttcggcaaaatttaaccattttgggcttgtttggcagagctccaactctttagctctagaagttggatctatagtggagttgttgagcaatctaaactcagctcaactcatattttaggtggagttgaaactgtttggctgggctttagctccataagagttgaagctagagttggagccgtaccaaacatgcctatttttttataaaaaaaatagggttagagtcgtaattgtagttgaaaataggggtgtcggacacaattgacttaaatatgtatatattttattttgtttggaactaaaatcattggactttggttaccctgaactaatccatttgtcctaaaataagttcattaccaatacaaaccaaaacaaaaattagaatactcctactttatcaaatattatgtgattatttttcattttatttatttccaatgcaattattcctaattgcataaactttggtgtaataattactcaaaatgcacctattttggaacaaatgggagggaaatatgaactaattgtggaataaagggagtatataaaattaataaaaaaagatttgggattgtcataggaaacttaacagggttagttttctaacagtgaaagtacatgtaccaacctcttcataaaaaaaagacagccatttcttttccatgacatgagagtatagatggccatctgggctgcccagcatggcatggcccaggcccggtcatgcctgggctgaggcttgtcgggccggcacggctcgaccgacacactaggccgtgtcgtgccaccccaccggcggcatacacggcccaatactactcgggccgtgacgggccggcccgaaggcacgatggtccatcgtgcttcctcagagaaaaagtctatttttggtccctcaactctgtggggtgtgtttaaatggctggaaaataagtctattttgtatacctcttgtcttgggccttgccttagacgactatttaagtctattttgcatctctatattttttttatttgatcgggccatgctgggccagcccaccgtgccgagggtgcagcccaggcacgacccggctgtcggtatcccgtcaaaaacttccagggtaaaaatttccacttctcatgccgtacacattataccctaggagatcatgtagagaggtcatcccccaatttgctgcaagcctgcactgctgtctctgctgccggcaatggccggacaactcacgatggcatccttacaacttcaaccactgcaactgaattcattcaaacccatccgattcctgtcgttagatggtagcatctgtaaatgttcttggaatatccgtttcaaaatatatttatctgtcattgaggagatcaagatggagtttttactgtagatatatttcagactttgtccccaaatttagtgctttgattgatgaatgccatggagtactactattaggtaagggtatgccttgtcctttctcattaagtttttttcaacaatttgcagtttgccgtgttcatagtaatgatgcaatttggcattttctgttgtgaatttggacgtgcaatcaatgaatgaataaatgaatacatccaagtttccaacaatttgatgcctgttcagtagtacttcagtcctcacatccccttctgttctctctgtagatgagatgagaagaagagaagaacatgagctgatgaccatttcattagttctcaaaaaaagatgaacacttcatttccaatcacatcttctattatattcctgtctgatctctgaattctatcctaacctctgtagaaaaaacatgcaaggacattggtaatttagttgaacatactagcaggcttccaaaagcaagttagaaaatattcctcatgccacattgccactttatgccacgcatgtattcgcccataaccagacaattcacacaaaccccatgatctactagaatttcagctggctaagttggcaagattcagtcactgtgccagtaaagggttgtaattgcacaccaacttcagacgcttcatgtcattggattaaccagcatgctatgccgtgctgagaagggagcctcacctgtctcacatgtcttcccctctgaatgcagcaagcacaagatttaagcgcaagcagctgcttgctctagtcgtaaatatttgacgtttagaacaagactcagttaaacttttaaaattccaaacaaataaaatggtatactttatttgccttgaaaagtacgatcgtaatattataaaactaacacacacatcacctaacactacgaatctggacagggagttaggcggtatctaatctagtactatgttactgtattttaggatggagggagtattagattttatatacttgcttcaatgtggaattggtggtcggaatttttgaagtttgacgaaattttgttctcaacaaataaatgtatttatgataggagggagtactggtgtactaccatcctgggtttctcttttaatttattggatctcttcagtcatggggctggctcatggtggcatcatgccatcaagatttccatctacttttgccaagatatttcctgcacaagattactactactatccacttttgccaggatatttcctgtaccactgttcacaaagatatgacaggttcctgtgctttctatcctttcatcaaaccgtatgacatcttgtgcccagttgctgctgttgcacaatggtttcatttgtgtttgttattgcaactgctcactgcattaacttctatacatgtgatctgcagctagcatcgtctcagctcatgctgctgctgccaccacacctagggtgtgtttagttcatgtcaaaattataagtttggttgaaattggaacgatgtgacggaaaagttggaagtttgtgtgtagaaaagttttgatgtgatggaaaaattggaagattgaagaaaaagtttggaactaaacccggccctatccattgcaatatttcattgaggtcacagagaaaagatggatggggatcaacccattatcaccaatttatgttacaacagtatctttgctttttcaaacagttacagtaacaaagccctgaagatagaacagcttgtcattactgatgaacatcgccaaaccgcttcttgacaggccacaggatcttgttatgttcagactaatcatgggtcatggaactcgcaagtagcatatatacagtttgttcttgtccaaactccaaactgcatactgtatactctcctgacaagatagaatagcttgccattactgataagcattnnnnnnnnnnnnnnnnnnnngccacaggatcttgtgatgttcagactaatcatggatcatggaaatatcaagtactactagcatatatacagtttgttgctcttgtctgcatacaaataaactctcctcacatgataaaacagcttgtcattaattacttatcaacattgcaaaattgcttctttaacaggccacaccatcttgcaatgtgtttagattaaatgatggatcatggtacaagcaagtagcgaacagtttgctcttcaatactcataaatatcatatgtcctttcttggatgtttttctcttgcacaaccaaactgcatactgtcctgacaagatccttgtgaaaatcttcagtaccttgctgccatatgcatcattgccaatctgtagcagctgtagctccattttggacaaacccactgctgcaagatgccatccaaacaaaatggaaccatcaaatttccaacttgaataagttgttactactaactgcagcaagatcagagataagacagagacctgaaactaagcactagctaaacttgcattcagctgctgatatacaccttgatattagtaattatcaatacaatacaacaacacagcttgatcgattaattaagcattgctactactataacacacaattatcatatcagatattcaggttcttttttttttagttcagttttagcctctccctctctctctttttcttcctctgtctccacttgttcagttgaggagttcagagtttcagagttttcagaagccgtgtctgtctcacgggtggtcaggccggcggcaggtcgtcggcggcgtcgacgacgtaggcgcggagcgacggcgagcgcgcggcggagaggtccgccccgcggccgcgggcgcccttgccctgcacccggcgccgcgcgacgtagccgcgcacccacggggtgacgtcctcgctgaccttgatcatggcgaagaagaggaggcggtagatgaagatcatgctgaagagcacggcgaggtccagccacttggatcggctcacgtcgatctggaacacgttctccaggatgtactcgccggggatcttggggagctcgtcgtcctggttgtcgaacaccaggcccttcaggtcgttctggtactgaccctgcaacaatgtcagatggaaaaaaaaaaccagtcaaacattcgaatctgcacattttttgcttgaatttgttgctactcgtgtgtaattctccatagttgttttatgttctattacatgtggtggtgaaagctgataacagatgtataataagcagtttaagagattgacaaaaattatgaaaaatatcgatcaaacccatcaaaattcaaatttaccgcttttttgctggtagtttttccgaatttattgttcctcatgtataattatcaatagttgttttatgttctagtattacatatactagtgaaaactgacaacagaggtataaccagtttaagagattgacaaaaattatggaaaatatcgacgaaacctgtcaagattgaaattggcccatttttgcttcaaatttctcaaattcgttgtttctcatgtcatgttctatacatgtacttgtgacaacagaagtaacagcagtaacacatggacaaaattttgattttgattttttggtcttgggtttaaattttcctgatttgttgttttaaaccctgatttgagttcactggttgcttcagtttatgagctgtaaaaaaagttgaaatttttacctgcaatgcccagtagtggaagctgatgtatgacatgggatacctccagaatggctttgggatgtcatggggaagcctgaagtatcctgaaaccagcatgaatatcccctgtccatttccaaaagatatttttctcttcaataaatgttgttgcatgtcatgatcatgagagaatattaacaaacatcaacattatgttgtgcagttccaagtacagtgtcaaaatttaatcccagtttgtatgcgttgcaggactccaaacagtgcctgataaagatggacaggatcaagttgttgtgatggatggtaattaattcacctgaattcctgcaccgatgatgatgcccatgaggaagttggggatgacactggcaatggccatcatcaagctctcgacgacggtgacgcttgcgtagaggcagaggacgaagaagaggtagtgcgtgaagcccgggtggaggcgcaccatgaagtagcacattgtcccggagatgaaggtgatcaagatcaagaatggcattgccgagatcgtgttgcttatcacgaatgccagcacgccatagtgcccattgagcctctctctctgaaacacctgaaagagcataaaaaagattctgtgagcatggtttgctgtaatctgaagaacttttctaacccatttgttgattcagtggtgacacaaaccttcatgtcttccacaaaagacgggaatcctccaatcgacatgaacgtgacaaagccgaagacgaaagaagcacatgcacctcttgcctaattgttttcacagttttatcagatcaccaagcttaacatcaagtattcagttcagggtagctagatacttttcagtgtaagtttgcatccaaatagaagtgacaactgaagaaggaaatttttaccagaattgagctgtatctggtgccaacattgaggtagattgtcccgatgcagactgtcacaacaatgtagatgataagcctcagccagtagtacccgaagtcccgcgacatgttgatgaacgatcgcttcgtgagtgtgaaagcctgcatccaaaagctagcctggctccctcctgcatccagcactgtccctttctgcaacaaaaataccatgtgagtcctcttagcttgcattacaatggtctagctgtggttgaatgtttggggaagttgctgtagtaatctagttacttacaacccgtgccatctcattgactttctgctgcgcagcaaagtagtactgtgagttcttgtagtaggtgatcagccttctgatggcctccgaagtcataatccgatcaagtgggtcatcggatctttcaaactatgtatgcaaaatgtgagcacaatttcagtcaaggcatgcacaggtaagagtgccagttgtaggtactaggaggagactgactgaatcctgaaacttactcttctcttcattgatcctttcagagtggccttcaccttgtcgaagtctgcgtttatgcatctgaggaaatgatccgatggattgcgcagcggtgggcaagggaagccggcttgggcaaagaactgcaaaatgcaaagaacagtacatgattcagggaacccatatagatattagcattgcagaagcaacttaatagagtttgtgaaaactgacatacctgacaagcttcagaggccagcccaaagtaaacagttttgcctcctgaaaggagatacaagcggtcgaaaagctcgaaaacctcgctgctcggctgatggatcgatgctatcactgtcctgccatccctcgctagcccacgcagtgtctgtgtcacgaagaacgctgaagcactgcaacagattaatcatctgcacatcagttacttagacagataattgctactgtaacaattacaatcacttgacaaatgacaaggcatagtaaccttctgatagttataccaggaatgagtttgataaacactactggttgaaagcaaagcaaggtagagagctgtgcaaatcaaatctccacatctcaagttcagctagattgctatcatgcttgctagatagctagattgctatcatgctgggcctggatgtaactaaatgtttactttattttctcccaatcttaatgaaattggtcggccagcctttggccgacccggcatgcttgcatgatccattaattaatgtaataacaaatgatttgccataaatataatagcagtacctacctgtcaaggccactggttggttcatccaggaagagcagcctgggcctcatcagtatctcaagggcaatgctgaccctcctcttctcaccaccactgattcccctcaggtgccaattgccgaccaccgtgtcggcgcagtcctgcagccccatctcgacgattgtgccctcgacaagggcgcgcttctcttccatgggcatcttgtcgggaaggcgaagccgcgccgagtatgagatggtctccctcaccgtcaatgtgccgatcaagttgtcatcttgggtcacataggcctgaaattacatattttactgaaactttcagtaagctggagcctggaggtaacttcttttgttactttgagattattactgcatcagacgaagtaagataatatatgcacataacttcaggtatcaccttatcatttttgacaaggtagaactttttacatacagaaattttgctctttttttccttgataatactttatagttattgattggtacagaagttaaactacttcctacatattaggttgacagttttgacagaaacaaatgaagcacaactgcacaagtcatgaaaaatatcagcaacaaccttcttttggactatgttttttcttttaaaaaagctcctgttaagtcataaagaaatgattttggacaacatggtgacacacgctacatgtacaacaaataatcaggattgtcaacagatcatgagtttttgatgagcatagtttctgaaaaaactggtaaaccacatcccatctgctggggaagttcctagttttccttgccaacaagctagatgactgaatgagtgttaactccattaccaaacacatacctgaaagagcttttttttttcctatctaaaaattaacaagcagaaactagttaattgattgagccagatcccccaattaatcttggccagaaatgggtgatctatatccatgaaagggagttattaatgcagtaaattacatctgcagagaggcagtctgtccaaacacatgcagaagccagaaagcagcaaggttccaagaaatggcacgtggcaacaacaaaaaaatgacccatttctttctcattctgaaatcggttgttcaggtgattcagataaagacccaagtaatgaaagcaacagaaaggaaaaaaaatatacaatacacattctaatcaaacacacacaaaaaaaaataaatcttcttcaagaaaatgaagtactgcaaaaagaacacacacatattccatgttttttttttcttttgtactacaagtattctccctgtgtgcagttatacttcaagaaatgaactacttcctccgtttcacaatgtaaatcattctaacttttcccatattaatattgatgttaatgaatctaaatatatatgtttagattcattaatatcaatatgaatgtgcgaaatgacagaatgatttacatcgtgaaacggagggagtacttctttagtttaatgtgcagcttttaatccagaaaaccattttctgaagcagaatccaatcccatataaaagcaaagctgattagtatttactagtatttagtactattgtactactactaataactgattaacttagcgttgcggtcagcagttcagcacagtggcgacgggtcgccggcggcgaggtgtgcgtgcgtaccgcggcgccgaaggagaggttggccttgcggccgttgaggaggacggtgccgtcgaggaaggcgttggcggcgaggcggccggcgagggcttctagcttggtggacttgccggagccggaggggcccatgagcgccgtgatggtgcccggctcggcgtgccccgtgagcccctggagcacgtcctgcgttgtccctcctccgccgccgccgtcgccggcgccgagcacgacggtgacggtgaggtcgcgccacgccaggcgcgccgacacgt

SEQ ID NO: 51106 - DNA, 6525 bp, Oryza sativa
cgacgccggcgacaccggctcaccgtggcatgcgatgcgagagctagtgatggagctagctagctagctaagcaaacaccacctatgagggaggagaagaggaggaggtggtggatataaaggccagtaatggaggagcaggttagagagagaaaatctagggagagaagctagagagagaaggagatcaggtgcagaagtaatgaggggtgtaggggtttgacctagggtcaaggtagctagctctagagagttggaggagtagaagcagcagcagcatgcatgcaatatgcaagcatgcaatggagatgaatggcatgtcataagggggggctagtagctgtttggtgtgatctagaagcaatgcattgtgcatatgcatatgcaatgcaagcacaagagaaagggcatgtttaattcaagaaaagaaatgtttgggtgtcacatcggatgtttgactggatatcggtaggggttttcggacacgaatgaaaaaactaatttcataacttgcctgaaaatcgcaagacgaatcttttgagcttaattaatccgtcattagcgtatgtgggttactgtagcacttacggctaataatggacttattaggctcaaaagattcgtctcgtgatttccgcctaactatgcaattagttttttttattatatatttaatgctacatgcatgtcttcaaagattcgatatgatgttttgggactaaaccaggccaaagagagagaatagattggtagagatgaaggaaattctctgacttagctgtatgtgcaattgagccactgacatgcgggtcataacgaaagtggaatatacatgtcagtggctcaaccgctggattcttggccatgtaatgcatgcactggattgcaagttgttgggttgtgaacagccatatggtatctcatcactatcatgcatgcaatgcagccacacacggtttaggttctttgtgctgcacaaatgctatcccgaccatggtttcttgttatagtttttttttttcatttgcaaaagagagtattccctctttcagaataatatcatttatggtttattttcagttatcctaaaataagagaaatgcccagggttttccagctagctccacaaggtggtgtgggctagacgacctgggttcgaagcctcaccccttctaattatttgataataggtccttccctgatattcgtgtttttaattatcctaaaataagtttatttttagctatcattaaatcaaagtttctgaaagcagtggataaatgcattgggggtggataaagagagaaataattgcattgagatttgataaggtgggggtattatattattattattattattattattattattattattattattattattattattattattattactattattatatatgagatgggtgaaaataaacttattttggggccgagggagtagaggataaggtttttattttacacctagtgcaatggtgcctatcatttacgtgcgattaagattttatagcaaaagttgagaaattgttaacatcgattagaatgagataaatatttaatgtttaggtcaagattcagttaagcttttaaaattctaaaaaaaataatatattacaataagttttataaaatataaaattccttatgtccacgaattttcgccaattcccttatgtgcccctaaatttagcctcatcccctatatagccttgagtttttatttattttgatcccctccatgtctattccgtgagtcgatagttaaaccattagatttttgtaaaaatatccatattacccttgtctgttagtgtacttgtgtgcaagttgattgaaaaagacagcccttaacaaaaaaatgatttatttttaaaaaaacaaacataatatagttacttgatcgtaaatttgaaaacaggatgagataaaattcagaggtatagaagggattaagtgaaaactcatgtgcacataagaaattttctctttataaaatctagtgagcttgtgatatatatgatagtagtagtaatttttcgaggcaaaatctacatatatcatttattttgtttttaataaattattgatggttgaagtgtcattaaaagtttaactgaattttgttctaatcataaaatatttttaactggatagagtatatcgtgttcggagtataggaatttttttcctcgtgaagtccttgtgttctctaaaatcctagtgtgtaacctacgctgggttagatatgttggatatctcgggaggaaaataactttccagaacacaaaagcatagacgttcggttacaaatttaattgatacattcccttttaccaaaattgttggacaaagagggtccttgtttggataatgaatagttgaatactttgccttgattataagattccttgaacgatttaaccatcgcacgtgaaaactggtgtggcacaacattggaattggttggcacatcaatgatcaaatttcatatttgtcttgcaccaaatttgcatgatctctggtccaaaggtaaaagtgacatgcaaaacatcattaactggcttctaggagtaaaagttaaatccgttgaatttagcccgcaaatctctactccctccggttttattttaattgacgttttggacaatgacatgctctacaagatatacctttgttcttattttttattataatatatacaataaataaatgcatgtttacttttattatagtgttttgaaagacaaatatatatatgtttttctagtttctttaaactaaatatttttaaagttattgatggtcaaagttataaaaatttaatctcaatcttgtccaaaacgtcaattaatatagaactagagggagtaattaagagtagcatggaattaattaaacatgtgacatgttgggctaaggccaaacatgcctcacacaaaagtgttactccttgatctcattattggttccaattacgaaatgcatgcatcagttgctaacaatgtactaacatgtaagttctataccaagatggcactcccaacaattaattggtagctaaagctctcttattatatgggccctagcttctgtacttaaaaaaccgtgtctcaaattgtccccgtgtagatgatttttattaaaattcaacaatattgttttcctcttctataaaaatatatgattcaataaagcaaaacacatattgtatttgcattaaaccgactgaagattagaccttacttttaggatttataatcactagaaagatgtatatccaagaagacaaaaaaaacatttcaattagttaagtaaagagtgtatgaacggccgagtttagttccaaactttttattcgaactttcaatttttccatcacatcaaaactttcctacatacacaaacttccaattttcccgtcacatcgttctaattttaaccaaacttccaattttagcgtgaactaaggctgtgtttagttcagcgcaaagtttggattttggttgaaattggagatgatgtgactaaaaagttgtgtgtgtatgacaggttgatgtgatggaaaaagactgaagtttggatccaaactttggatctaaacacagcctaaacacaccctacatgtagagtgctcttgtggtaatgtgtgaaccaaaggaggaaacaagagtttgtgataatctaatcttctactctctccgctccaaaatataaaaacatttcctagtataacgtttctatatagcctccaaaaatatcttaacgttcttatattttgggagggggtatagtactttactaccactgggaagaagaagcaacagctatagcatggcaattggtagtcactaggaaagtaggaatagctagatgcatgcagattcaggatgaatctctcatgcaaaaaaatgcagtgcagcccaagcccgggccctgatcactcaaacttaactgcattgaagctgtggcaggtggatgttggtaggcagcatgcatttactcattttttagtgctgttctgctgctagctgcagctgggactgctgtttactgtgcatgtgtatatatgcatggattaatggatatatatgtaggaaacctagccagtcttctggattctcatcaagataatagttttctgaactctcatttattcaattagcaattaaaatataatatagatagttatatatgtttaattatttctaggaaaatgacatgtttgtaggaggaatgtatcagatcaggtagtattgtcgccagtataatttatagcccatcctttcattatgctggtgaggttgcatatacttggattccatgttattttttttcagatatttttcatctctttaatggaagaaatgctggtggttgtgaaggagtatatgcacgcgttcgaggtcccgtgtggatcccagattcagaacagtgtttctcttaattaacttgatattgatccagggaacatctagcatgtttgtttctactttctctttcagtgtagtcgattaattaccagcgatccaattatacttctcataatctcatactcttattatgttttattgaactccgtgccatacacacaaatctcaaagcaaatctgacgacaaaccaactataaacatttgcattgcattgtaaattaattgattttcccttgattggttgactgctgaacagatccttagattaattcgagcttgcacttttgcagtacactgtaacaattccggcaaaaaagtacaatgtaataacaaacccacccaactctatcctgacatgggaattaaatctacccaatggccaatatattacagcaaaatagtgaccagcaattctgaactaagtactactgtttactgttactgcatgacctattcactctattctgatgttccaagataaagctatttctattgcataagatttatcttaaaagaagccatttcttcacttatcctaacatcttaatcaatcataactatttttcatttaccttcttattatatttttcctctcggccaattacaatcttctctcaatcattgccatctatttttctcaatatatgtgcaaaactttagaaatgcttgcatttggggatagatggagtaaataaatatatacaccctgtggcactggcctacatatatactgtgtcccctacacctggatcatgtaatactcttaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccttactttggcccctactacattgtgtatgagtgagatatttgcacatcaagtaccctgcagtttctgtgttctgatctacacagtagctagtgtccaattaactctggaagttaatgtaattaagtgctcttcataaaaaaccaatttaatgcaagcatgtttacaagtaaaaaaaaaccttctagatgagatagtaaactctcataaggtatttcacatgcatgagttctgacaggtagctgcaatggtgtagtagtagttgtgatgctgcaggggtagtatccatggctgccacactgcaagtactgcaaaaccacaggacacagaagtggagctcagttaattactgttgttttacagagagggatgatgagaaaaaatggcgggaaatgttgatgattattgttagtagtcaacattagtcttaaggtattaattaatgtgggaagcacatgtatagggaaagtaactttgatatgtgccctctctctcaagaaaaaagaaaaactttgatgtggtgccatagttagcaggattcaaattctgatatcacgattatacatatgtgagtgttcttgctagaaagttagcaaaatcaggtcacaagagtgaggtcgttcgtcggtcagcgaatatggtggcatatatagcaaaggagtgttgctccaagaaatgtgttacgacttattgtcggtgcctcccaatttttcttaggttttttttcttgatgaggattgtatccaacataacctgattgtataatttggctttaggtttatcctcaaaaagtaaaaaaaaagttagcaaaaataaccaatttaatcgttggtctctgtttttttagcgagtagagtatatacctagaatttacgacatcgattcctcataaggacttgaagaacttttaggtactaatgatgacaaagaaactaagctcatcacatcaacataataccattgttttttagatg

SEQ ID NO: 51107 - DNA, 36245 bp, Oryza sativa
tttgagtagctagaacctagaagggagcagaggaccatgcatgcaaaaacacagcaatggcacaaggatgccactccaactgccagcaggcgaggcgtgtgtgggggtggaccgcggacaggcgccatccggccgtccgttctcatcatcgaacggctcagatctcatccgtacatttgatgtgctgccacactcgctatctaggtacgtagtaatgccttttatatgtccctctccctccttgatcacacgttgatcatttcattgggcggatagtacatcagatgagatgatatcactcatatcagaggaagagatcgattggatgttggagtaattaggacaaaagggttagtgttatgtttcgatgtaattttggattaattaaccaagctagattcaagtatgatatactctctctatccacaaatataaaaggttatagtttttttttgacaaattaaggatcaaaagtaaagactatgataccctttattagacaagagatggttggagagtgtgaatataaatctcttatatttttagacaaactttgcctcaattttccttttcctttgtaaaactccctttttatagttttctcctactttattcaatgaaattggtgtggtctaagtaccggttcgttaaaaaaagatatatttatagactgaggaaattaagtcagattatggttgataagtaaatgctcaggccgacatatttgggtaggagccatgtacaagtgagattgatgtagttgttctgctttgccaattaagcaagggctatgtgtacaaatgcatattttgctgaggttactttcaaaaaagaaagttttgttgaggtgtaaaaatgacaaacaaaggccttgctttattgaattttatttgatctgatgacaacacgagagcacatggtatatagccttaggattttccatggcagaaagccactcagctaatgctctcactactgaactgccaactgtagctaatctctacaaaaacaacagcacaaactgagcaatgcatttgagcaagcttggttttttcacactccgatgataacatggctcaatgaactcagaagcaccatcttgacagaatttcatatgaaatggaaacgtaccgatgcaaaggatcatggaaataggggctgatattgcagccctctgttctcaggcaggcccatcatcagattgaggtttggacagcctgaccagacgctcccttcacaagattatctatctgtggagttgaagaacaagaaaataagaatttcgcatctttaagtctgaagaaactagtttgacaatgggcataaagatggttgaagacgcatacaacagagatgatgatggcccttccaggaatcctgtcctcgaagacattcatgaagcagtaatttgatcccacgacatggcgcgtgtgaggaacagtgctgccatgtaaaagcttgacaaactcttcgccctggggaagatacaggtagataaaattgtgatgctaacaagaggagatgctctcactcacaacattacataatctcaaaacattttgatgaattcatttcagtagaaaacgtctgtattcaaatagtcagacagataatttagccactggtcagacaaacaaacctcataagtagacttgagatgctggtacaaatcaccggcagtcactccaggtgccatttcaacaaacatggtagattgcattccacgtttctgttcaacgtaaatatgaagaatttgatttaactaatgcacacactccaggtgcgttcaatacagtacaaaactgcagaacctggagttattaagtcaacaaaaatgagaaagtaagtgcttaccatacagatcagatttggagtaaaactgatagtgactttagatttagcagcctctgaaagtccttgttcaatctcgggagctaacacggttttattgcaatgtgtcagtagggccagtttaaaagcacttggagggcagatagccagatataagtaaacattctgtaaccactttatcgactatttgtttgtccaagggagaataaacaatttcgttaaagagctataacacagtaactacaacactgatgttgattccagctttttggaaaatggcaaaacaagggttaccatgacggtggccttttattccataagcatggatgccttcagctatctcagtgtaaagattcgcctccttcgctccacgtcctacacaaatgcatgcattagagagaaagattgactagtaatcatggcagatatacaaccactaaatttgtagccatagtagtacagtacgtcagtatctcaagttacatgcctgctccacaaaccccagattttgcatcaatgataatgttgctcagcttgatcagttttgcctgcatggtaaaaacaaatggtaaaagatacatcaatgccatgtaaattcaactgataacattttaaaattttgcatagagttaagggtttagaggagcatggccaacaaactttacactatggcaactatcctttatatgctaccaaaattggttagttttgtacactcaatgtgattatattttgttggtttcattagaaatcagagaaccatatatgactaataacttctgttaatcttccctcatcacctttatcagaggaacaagaggaagctgaatagatgtgggataacatcctggatttgcaacaagtcgtgcatttcttatttcatctcgaagaacttcagttaaaccatacacagcctcttgctgaataaacagagaagcaagccacagagtatgagttcataaacaaacataatttaatgatacataacttaagatcttactaaaagcaaatgctcataaacaacgctgagaactaaagatcttataaatagtagaagtgcataaccaacaccaataactaaacaagtatgtagggacaggtagccaggaaaacctgaagttctggtgccctatgtgcatgaccataccactcagcgtactcattgatatcacgcaaacggaaatcctgtaaagatggtcaattagacgtagtaagaatggatattagatagcatgaaagacaatatctatgcaaataaactgttagccttgtgaagcataccgcagaaagatcaacaatcttcagttgcttcggtaaacctttaataatttcctgataaaaatattgcaagcaggtatcgctttaaaaattcctccaatatgcagaatagtgtaattgtgacctctaaatgattcaggaattggtaggaagaatttcagagaagggcatggcaataatagacaacctgggttgttccatgtggcaagcaacaaaaaaccgcatcaacatttgaaaaatctgcatcttttattgcaactaaatttgggaggtcctgcatatcaaaagataaccagcagagtcttacaattttgatcagcaaaatgactacaatatggcccagaaattctaataaaaataaatgtactaccaaaaggttcaaccgattcttgatgtgccaaggataaaaaaaactcaggtcatttcttccttttaattttttgaagaaacaagtgtaggcaatctcgggtaccaaggagcatggatcaagaaaaaatcttacctgcgttatcaaatgaggaaatacagatccgaactgttcgctagcttttctatctgcggtcatcactttgatatgaaactgagggtggtttgccagaagccgaacaatctgtcaatgcaagcgtacttcaataattaacaaacagaaacaaaaaagaagtcgaagatctccatataggatatagtcatagaaaataaatgcggagccggatagaagaaacataagaacagaattacaagtacattcgttgaaaggaacccacttgtataagataacaacaacaaacgcaattggaaataacacgataaaatggaactacctcagctccagtataaccactggcccctagaaccgcaatctgcacctcctcccctgatttaacttgtgttgtcttagaagagtatagtttctgtggtgaagagacagatgccctcacacggagcgaagggcatccgacctacattgcagaaccatttgtattagtattcagggcactacacttattattttgaaaaatgggatgaaaaacatatcacctttggagtcgttttgagcatgaaaccactgcatgacttcaaattaagcccacagactcccttctacagaatgacaggaaaaaaaactcatttgattataattaaaacatatgtaatgaagaaatggcacgtataagttggaacaaggatgactctttatgaccaaccagatgcaagatgcagtggtggtggcagattactaagtcaaacttcttcaagttcaaccaagtttatatcaaaatatagcaacatgtaaaaaccaaattactgatacatcaatctaatcgtgtagaatgccaaacaccaacgttcgtaagaatccacacctcggcaaattcagcactgcttgtaagttgtaaccacacactgcctaagaaattaatcagcattgctaaaatctcgattctattcttccttttcgtttcagctgtcatattacatttcaaattcgcacaatcgcactaagagcaatcaattcaacgaatcaactcaaccccattatacacgctaatagcctggttagccaattaggtagatgctccacgatccccgaacaggaaacaaaaaagaagaagaagaaagaggtaaagctccacatagacaaccatgagatcaccatctcgagggacacccatggaggggtctcgcggggacaaagaaaccaagaaagaagaaagaaagagcatcgtcaccaccaccttgggggccggagccgcggcgccgccaccgagcgccgtcgaccaccccatgcaggtccggcgtgagccgcggagacataacggccgctgtcccatgtcagggactcgggtgggctgcacatgggccgctggctacaccacgggttggtcagcccatcgccaagaagcccaagcaagcccaagctaaaagatatatgagcagcagcagcttacaggagatcgatcgaacagattcatttggccaaggcggcgaacagcagcggcggcgacctagaggctggctggcctctttgtcgatctctcctctatctcccttcttctctactagtctagaagctactagaaccttctagcccttgtatccttccatcttccacctcaaaaccactccactattgtaacagacttggttgttccctgtgttggatttggcactgctatttctgaaattatattgttgagtgggtctctaacaatttggtatcagagccaatccccacgaagctcatcaagcaagctgccatgggaagtgaggacaagtttgacatgctttttgaggatgctcgaggagtgcgagcgaaggcgggaggaggcagaccaaagaaggagagcagatttcctgtctctcaaggcagcaatagactcgtggatgccccaagaatagaagaaagctgaagaccttcagttttttgttgaggatgagcagtccaaggtgacgcccaccacctgttcgatggagtgctccaatggcagcagcccgagcacaatagcgagatccatctacgacgacgagggggctactccgacgatcatcctggaggttggggatggtgaggggaaggatcgcatgcccttcatcattagcaaggaccttcccgagttgacgcctatcatgtgtttgacaaaatgctcaagcctcgacgtcgagcctgatttcaccgtggctgcggtggttacatgttccaacactgccgtggactccaaagagttggtagccaccgatggcgcaaccggcaccaccatcattgacccccgtgtttgttccaaggagacgcacaccaagtgtttgttgttcggccccgatgtcaacggtgtcactgatagaggtgtgattgcgttccaaagtaggatgggtgtgttcaaggtcgttccgatatcaagtcagtccatggagttgatggttgacgagaaagcaacttgcactgacaccactcaccttcccaaggtgatgcacccaagccatttgatgttgggccccaacgtcaacaccggtactgtccaggctggggttgcgtactcactattgcttggcgcgccagaaggaatagcatcctcgggaaaggccacactagtcatggcacaaaagctaaactccaatttctgcctaaaatgggtggcgctcaacaggtgttcgaccaaatgctccaagggctacaagaagctgttgatgagtcatcccaagagaaacccatggccacctccttgctcaggtggagtggttagaagatggaaggagtggtatgtgccctgggctgcgggcaattatttggggataatattttatttcatgccaccatggccaccaccaaatcaaattggaaccataatactttggctgttggtaaacacatggttgacggaagtagagctgaaaccgtggcctgacccacaaccaagtcaatataacggaggcgtgatgtggggtgagcaagtcccatggcctgcaccagtttttgcacatttgatgggatatgatttttgcagtgcaaattgcataagagaccaaacaccttctgttgcactatattgtgcacctaaaggagatttaaatcatgaaaaatctaatcgagctcataaggatacattggtggcaatatttaacttggaacagttccattatgtgggtggtgaggaaaaagttacagagggaatgttatatggcctaagtacaataagctgcaactacttgatcattcctgctgctacaatgacaacaacatttctgtcagttccatcttctactcaaaatatatatggagcttgttggttggaggctcaagaagggttaaatgatatagctaagggaagaacttacaaaatttgtaagtccatgcgcatgacacttaatcatgttgagagctggctacagaacccaacaaacatattatacaatggtcagttgtttaactgtccagcggggatacattttggggtcagaaggatttctgggattattgctagaggtgctgctgagaatcagaacaggaaggtcaagacatgtggttatgattccatttttgatttctgtgagaacaatcctagtgatggtagtgctgcagcaaggttttccattgatatcgggacagattcagagatgatatatgcatcaattgcaaacagggattattggtctgttaaattattggtggtcataaaagaggggtgcccaatacgccacttgttactaggtgatatcaagaaagaacaattgctgcaatgtgagacattcagtacaagacagacaaatacagagcaagttatcaagctacaggtgagcaattccaaggaaatacaagagctacaggtaccatgggatccaggaggttttcttcatcggcttggggacaagccaaatttcaagaagaggggattgtcagggactcgggtgggctgcacatgggccgctggctacaccacgggttggtcagcccattgccaagaagcccaagcaagcccaagctgaaaaatatatgagcagcagcagcttacaggagatcgatcgaacagattcatttgaccaaggcggcgaatagcggcggcggcgacctagaggctggctggtctctttgtcgatctctcctctatctcccttcttctctactagtctagaagctactagaaccttctagcccttgtatccttccatcttccacctcaaaaccactccactattgtaacagacttggttgttccctgtgttggatttggcactgctatttctgaaattatattgttgagtgggtctctaacatcccatcgcgccgtcggcgaggcgagggtggctggcggcgccggcgggcacggcgcacgggaagctgccgccggcgaagcgaggagaggagtgaagcgtcggaggagacgcagttcttcaccgtccgatcgatcaaaaccgacggcctagatcgagccagtgactttcccttttctatctaccccattgtaaattggatcccattgtaaatgtgattattcaaatagatgtcataataattcgtttatatttgtagtcgtgccactgaaattttataaaatcaaaactgtgctagtgacgccacattttccacccatatcctttattttccattttctacattctctctcgtcttcttccctcacctctcctctttgcttggtgcagcgagatgctcgtcctcatcctcttcctcctctatctacccccggcaagcccgcaccaccctagagtgtaccacctcctccgtggccccaggtggcgacgatgatggcaagctcgttgtggcggtgatgaggtctcagacggcggagtgctccatcgtcaatttgttttcctccttgtgatttttctggcgacaacaatctcgtcctgtctaggagacggaggtgtgctccatcgccatatttgtcctcctgttttttctgatggcagtggcgagattatcagacaatggcgagctccgtcaccatttttcccacaaggaggaaaaagatgaagagataaagaagaagacgaaaaaggaaggagatggatgatgtgacagcagtgacacgatccccaattttgtaaaatttcagtggtttagctacgaatagacgaattgtaatgacatttatctgaatatgtacatttgcaatcacacaaatccaattcacccttttttatagctatatacatttgacagacaaaatttcttataaatatagtataattatattataacttgcatgtaacggtaatataatttgtatgtaactttgaaaaaaaatttgtatgtaactttgaaaaaaaatccgactgtaacactccattttcacgaagcaggttgtgagaccgaatctccttaattgtacgtacgctataattttttttcttcccaacttgcacgaatcttgaaataaatccaatggtttaaaattatgtaaaagttacacataaattatattatagttacatacaagttataatgcaattataatctatttacatttagcaattagaggagaaaatttgtccaaaatcgtttttttagaggtgggaaaatattctgggccggaatagaatagttgggctcaaatgcacaatgtaagggagagctccctccacgagatgggccagtcccagaaaggcccgcatcacaatttccaaaccttcaattattccccttttattttcctaaataattgccgcttccttttctctatttctaatttctgtatgggtcaattgctcatgttcatgctcaagctgcatggatggtctcttgttatcagcattgtgccgacacagtacttctagggatcttacatatataaataaatatagggacccataaatatataacatgtcttgttttagtcaacttcatgtgcagatatgcaaataatgaagtactatgaaaaatataatatgactaatacacacatggcatgtataatttgtaacaagtagtgatatactaatatacactctctctgtcataagatataagcatttatagttatagttatgaatctgaactattaaaagttgttaagacgaacgaacacaaatgtgtttttaccagaatacacccctctatttgcagaaggatttaagcatatttggattcagctggtaggctgagctgatagagtgataggtgtcttgaaaatatggcagatcactagcataaaagatttatttgattttttttaagaaacttaaatacataaagttttataaaggacaaaatcaattaacaggcggagaaatatgcttacgacaatttagcaagtaggagtaggaagtagctcagtcaataagctgaatcaaacggtgccttaaccatttgttgtgtaggaaatcgtacacaattactacatcaatgtaggaaagatacactcccaattttcagacctcattacttatttacacggttaccatggctagtgataaaattaccgtgtgcttacctgataatggaacagaaatgttccaagcaatagaagatttcaattcttctctacaggacatccaaatttcaaagaaaatagaaaccataggaatgcttccccaattgcacatgccctctcatatctttgaacaacttgagtcctcttttcttaaacaaaaagaaaaaaagaaacccccaaatcaatctttgaacagttctaaacctgaactcctaaaagcattcagccagcttaatcagtcataacccatccttcatcacaaagcccaaatcaactcatcaaccaacctaatcaaagtactaataaactaccaaaaaccaatgtgctacaacacaggaatgggtagctagctagagcctagaagtgatcaacacatcacatgtgcaaggcttagctaggtcagtcacacaacacaggtcagcaaacgtgttaacacaaattaataaaccgattaatcaatcaaccaaccgtgttaattactgtgagctgactaattagtcaggaccaatcacatgggctagctagctattgctgcgggtttgcaaagaaaaggtcagctagatcaagatcaacacacacactgcatatattgcaatttgcatatttacaattacttgcaagcatggcacactagatacatgaaagggagaagcagaagctgtcccagactcccagctaacaataacaagcagttgatgatttttgaccaggtgattcaggcagctggataggttagctgtgccggccggctgcacagtatgggcagtactgcccatggaacgggaaaccgatcctatctaaactttaggttgtgtttagatctaggggtgtaaagttttggcgtgtcacatcagatatacggacacacatttgaagtattaaacatagtctaatcatgaaacaaattacagaatccgactgtaaaccgcgatatgaaattattaagcttaattaattcatcattatcaaatgtttactgtagcaccatattatcaaatcatggtgcaattaggcttaaaaaattcatctcgcaatttacacgcaatctatataattagttatttttttcgtttgtatttaatactttactcatgtgtctaaatatttgatgtgacagggtgtaaaattttgataggggatctgaacatgcccttaggtggctagtatatgaaccctacgaccaaatgattcacatttcagtgaaccatgttaaaagatagaaactcatctcatggaatgcctaacaatattaaggggtagtggtaatcttttcggtcaaaaatatttaacgtttatgataagattcagatataattttatagtactaataatcaataattttttagacacttagtttaaaaaactataaatagatatgcttagaaaaatactagtaacgtcacaaacttattaggttttataaatttatttgatgtaaaattgagtgctaaattttatatttttgactgaatatgatcgtaaacatgaaatgtttgtaaccgacaaaggtagggtattgccaaattaacaactaggcagcttgagtggatcaggcaagttcaaaaggtcaaaggtgactaattttgtctagatatctagtacttggctttctcttaaaaatatctagattgattttgactgtatgggtaggataggggataaggagcataacagctgtaggagcgtttgtttagttcctaccaaaaggtcaaggatggcatactagcttattttgttaactttaatatgcaaactttgtagtacttgagaataatattaaaactttggagtacatgggaataggcaagctgcatatagcagtggggaggttgtttaactttggcatccataggttgatgtcctaggactgacttggacgtgtctgttttccttcttttagcctaccatagggttcatggccaattccatttttttaaaagaatgtctcccacaattaatgtaattctcataagcaaattctacttgtttaataaaatatttcattgccaccggtgtgccaaattcttcctaacctagtccacacatcatagaaaagaccactgcatttttttcaaacaaaacatgtctatcatattgttttccactaccacaaaactaataacatagaaaaaaatcgaccgacaacgcatttcactccttggctgcaaaccaaacacgtcttccccacgagaggaaaaaaaaactaaatacacaagaaaatttatgcaaccccttgaaatccatgcatccacagaaatcacacttctactgtgccttgccatgtccccgagggacgtgcaaagttggcaaagctaatgacatggcactaaatactatccctctcatcagtcatcactaaccgaatccacacatgacaccaacctaaccttcgttcctgcctcatctaacaaatagctttgaaacaaattattgagtgcactgttgttgtacgtaggttatgtatttgacttatggataaattaattattttgaaaataaacttaataaatagcataaaaagttgtctaaataatttactaagaaaaagtttgtaaaaaatatatattgtttggagcgtgacacaaataatctgtttcaaatagtccagtgaagtcatcttgtgtgctactccctccgtttcatattataagtcgtttgattttttcctagttaaacttaaatctaacattaaatatattttgataatatgtttatttggtgttgaaaatactactttatttttctataaatttggtcaaaattaaagaaatttgactaggaaaaaaatcaaaacgacttagagcatctcccgtgtataagtaaaaccgaaccatgtttgaaaaaattgaatacaacacactacacagtgacttgatttagatgtttcagagcaaaaaatcgaccaaagaagaagagtcgaactcagcgatgaaaagatgatctgtagccgttggttggctgcataagagagggatggacgcatgtgattagagattctttttatacgtgggtcccacgatcgatgtcacacattgccgccgacgaatcaaaattttgctcgacaatactaatcgaaccaggactacaggtgcccttataatacgagacagagggaatagctagctaattagatcctgataacgataacgatggccacacacatcacaattcatagcatgctaaagctagggaagtagcgatgcacactgcccactgtccctttcttcaattcctcctctgcttccattggcctcggatgccggccggatgcatggctaaactggtgatacatatggctcgaatgtgcagccgtgctacgcgtgtctgaagacgttgtaatattaacaccgatcgaagcatgctctcacggcatcgagttgcggttccaaacatgcgatgtcgtattcttttattacacgaaagacgcgcacacgtagatttatacatcggtacacaaacacattacgcttatatcccatgaatacatgtgttatctaatgcactctcaaaggggcgaaggcaacaatttaccattgactttgttgaatttttgttgaaaatatactcgtatatgtgtaatatttgtttgcactaggatttgattttaattcttagtgggtgaaagctatgtacttataacttcagcaccatgcatctttatgtttttcttttaagactaagattcctatatttgttttggagttcggagctttcgaccattgggtacgttttgaatattggcacagtgtacaacaacgataattcttatcctctatttaatgtagttacgagaaaacacgacgatgaaaagggaagagatgtcctgttatatatgggagtcgtggagtgtgtcaaatggttatgttacgttactttcagccttacttgtccattgctaacaatcgatttaattcctatgttattaattgtgtgtaagtgacagttcatgttagtcgtatatgatgcaagatttagcaatatgagatcaaaccagagcacaaacaaggaggaataattaaaattttagacgactacctagatctaattaaaaagattatacttcatattctcatgaactaaactctaacaattgatattgtgaagaaatggactactccctccgtcccaaaataagtgcagttttgcactattcacgttcaacgtttgatcgttcgtcttatttgaaaattttttatgattagtatttttattgctattagatgataaaacatgaatagtactttatgtgtgactaaatattttcaatttttttacaaaatttttaaataagacggacggtcaaatgttgggcacggatatccacagctgcacttattttgggacggagacagtagttaccaagatgaggggcagtcaattgcgtgccaagatatcaataattatcacctacgtttcattaatgaaatgactaaagccatcagtctcattagtcatttcttctcagatttcttagtgtggtcactttcggcctctccattgcccctcctcttgtaatcccatcatctcttcgtatgtacgctagaaattttcgccactttttaaaaaagacaccaaccatttcacacacgaaaagaaaacacacaatcattaaaaaccacaaccttactacatggaaacaatccaaatccactaaaattacaaagcgcgcactctctcaaccaaaatcgcctggcccaaacctatttggcacaactctacatattttatattcttactagaaaattaaattatactattagtttaaaattctgtgtttttataaaatatgaacaaaatatttcattgaaatgctatcaatataatcatatatctagatccatatatttcatgagttaaataacatagctctaaaaaaatcttggatctaaagctatgtaccaaacatatatccaagtcgacttcatacggatttcccacaaacaagtatcctttttaaatattccaccaacccctgtggaatggcggaaaattaaactaaaccaatccccacaatttttttttaaaaaagcaaataattagtgatccactgtcagtgcatagctgtgatgacatggacaggatcacggggggcggccatggtctattcttcgcataatccggattaggatggggatcactcagtgccacgtcactgtaaaacatgtcactctcagagcttagcttaatcagctgcctaaccagaggtgcattagccgtgtaagctaattctttttatcgaggagtagtagtagaatttatctttaagctagcttagcatcggatgctcgctgtcaagtggcacggaattcgaagatgattcaaacgacaggtcaattgttgtggatgctggacagtaattggaattggatggtagctaagctcgagcttagcaagagttctagaagcagagttaggcacaatgtgaattccacagatttgaaactgaattgggaggggattgcaatggaaaaaaaatgcaaattccacagatttgcatgagttaatttgtacataactgaaatagaaatgtaaggatatgttggaaaattgagtaattaaccgttggatgaaaccgattattgcgaactgttagtttgttcggttatgaggaagacctacactacacacctatgcacatgtacctaacacacacacattactggagaaagggattttccggttgaaataatcgggactaaagatgcataccaagtaaaaaaatatgtgggatgtgggattcggactcaagatctctcacctcggccctcacatgcattatcatcccacctactgcacacatctgaccgtgaaagtatatttagtctggattggtaacaccaattaggactaaagatcgttggggcttgacaactattgaaccgtggctagaaatgatctttagttctggttcctattcgaaccaggataaatgtattttttttttgcatccgagtaaagatcagttcttcagtagtgacaccacacccagtaacacactcttttaacatatgacgaatagagggatgtcataaataaatccatgaagcttataaaattaatatgaaaatgaagcccatacaaataatcaattgtaggcatcggtatttgacaaaagagaactacggttatccatgtcttgcatgttttacaagaaagaaatttagatgttgtctggtttgatgaaaccggtctatgctaggttcattcgatcccctaacaatcatgtttgatttgtgtcatgggtttgtatcgtctgttgttcgtgctaaaacctcgcaatttttttttccatcacttcatatgatgtgattttggtggattgcctcgtctaggacgtcattggactgcgtgacccacgacaagctgatacgtcgaaccaaacatgcccttatggtttatatctttccatcataataaaaatggatatgcactatatttattgcaccatcgtgctatatatgcagctacaaaactagaaactagctagtattatcaagatgctgctttagtggcttatatgtgtaaccctaagtacacacatcacattggtgattggattattgttctatatattggactaatggcagacactatttaaatcattctccaagcaagctctcacagaaaaggaatgccagaaaggcacacacaaaataggcagtgagatgaaggctgtgtttagttcacaccaaaattgaaagtttggttgaaatcggaacaatgtgatggaaaaggtgaaagtttgtgtgtgtagaaaaattttgatgtgatgaaaaagttagaagtttgaagaaaaactttggaactaaacacggcggaaaacaataaccaaatacgcagagcatgcaaacaaagatgctacaatacactaccaccactatatttattgtggatggcagcatctctgctacactttgcaaatgtaggctaggaggaattcaggatcaaatgcctttctcaaagaaaatgaaacaagtgttccccaatgaagatacccttgtccaatatcacatcatctctcatagttggaatgatcaaattaatgggtgggccaggttccacttgacttccacagaaaaaagaattccaattctacccacaagacaatactttcttgtgctttcttttggacaagattcaagttccagctaggtaagcttagaatagggccagtgtactgccaactaattgagggactcatgcatgccccaacctaaaccatccaaccaaaaaaaattctatcgaattatggttgagacagctaatagttttggacctttaaatgaagagtaacaaaacttatatgttcaagctaattatgtggaccatggccaggtggccacttaattggacaattcaatgtcacatggttcgggtggatttaggttgggcctgattttgctgaaggacttggatttaagaaaagcaatccaggtaaaaatatggccagatttaataaattaaaaataaagttcatgaccaggcaatgaaagggttaaatgaaataatgggtatttaccaaattatatttttaaggaggcccaaaaagggatgtcctattgttttaattaaatccactttttttcatggtcatctataaaagcaaaacatgttttaaattcgcacggttatgcttgtatcctatttgtgccatatttgaattcgctatagtatttgaatttaggagagaccactcatgtctgaatggagcatgatctttataacccgaaatagaagaagctggatatgttcactgtttatgattgcaagacaaaataattagataaagccatatgcgaatgagaatcacttattaacaaactatatctgaaagatccacaaaaaatagatgttcaatcaatttaattaagatccatatcttcaaagtatcatataaattaattacattgtacccatgcaaaatatttatgtaaaagcagtcaaattgatattgtctcgaattctaatccacaagcttcactttttttttcacatggatcctgaagcccattactaaaccttaaaacacatccatgaagaaaactaaaaaaaagatagaaaacttctacccaatacataacaccaaagtatgaccaataaagcaaaaggataaagtgtaaccgaaataaccctacgaaatgtacatcaaaaagagaaaggataagataagaagcaacatataatagcaaaaaaaaaaggctacaaaattagttgcaagaaaagccaagcaactttgcaatggccagatggggcttaaattggttgcatgctagagggtgtggcacagtagggccaagagcatggaaggcacaaagtgaaggccagtgtgactcacaaaacaggacaaagatttttgcataaaaacgtatgatgggagggcgtgcaccatctaccgggctatcggatccacaaaaaatatttttgcctttttatttaaagggctcatagaaaagaaaaattgctgtggctttacactttcgtggcttggctttggatatacaggagagtgggcccggctgcatgacaaggtggaaaaaaagagtcaaaggcttccaaaagatggaaagcaatatttaactgatccaattctgtttttgcgggttaacgggtttggtgagtttgtaggagtgtagtgagagaatgtctgccccctttatcttttagggaaaaaaagaactttacatgtaaaaaaaatatgagtagaacagagtgtttagctcacatagattatgtgtaaaattatgtttttattatgtggcactctaaattcgttagttagtgtaaccaagtaactagttttttcgtaagtagtctttcttgtgtgcacgttggtatcctatggcgcgtcccttttgttttatctttttaaaaacaatataaacacgtatgcacgtgcgagcagttacccttaaaacgtgcacgcacgccctatcctatatcttgaagaaaatatattgagattgataaagtaaatataaagtcatacatgtctcaccatcgtaggcacatcatatagcatcgaaagaataaataaccgtaaatacgagtagtaaccatatgttttcagcctaatataatgttgaaacaataacaagtgaagaaaaaaatacattcatttaagaagaagattacacagatacaaagaataatttcatgaatgaagaaactacaaaacaaatctaaaggaaaaaaaaacaaaatcaaactcacattccaattttcataccaacaccatcttagtttggtgagtcaggcgatctactcccgtaggccttattcgattaattccgagtaggaaaaaaaatagagatgttttttaaaaaataattactccctccgttttaggttatagtcaaactgtttcaagtttaactaaatttacagtaatatttattatactaaattagtttcatcaaatcaataattgaacatattttcataataaatttgtcttggttaaaaatgctactattttttcctacaaacttggtcaaacttaaagtcaaaacggcttataacctgaaagggagggagtacatactacaatagacatgaaatacattcctttcaaatcctcttacagcccgtttggttggagggagtttttagaagggattgggagtttagagggatgatgctattaagtgttttgtttggttagaagatatgagaattttagtgggatgggatgaggaattaaggaaggaactccctctttttcaatacctgggtaggggcaggtaattgggagggaattcctcctttactttgtctaatcaaatctcaaccatccgtttttattaatgatctaatctctaactaaactccctatcaatttccatcccctctaccaaacaagatattgagattaaaaatcaaattatcagtccattaccagagggattaactgaacaggcgaacaatgccttatcgggctaccgggtcagtacccgtagctttctcttctcccccattccctccttcctcccccgtgggtgcgtgacgtggggatgagattgcgttgttgctgcgcccgacaaggcaacccctcccccgacgcctagagagagaaaactaacctcacctcacctcacctcacctagagagagaaacacagaagccaaagcaaaccgaagcccagtttctctctcctcctcctcttcctcctcgcatcagtccgcataaagtctcctccccttccccctcctcctcctcctctccaatcttggcagcagcagcagcaaaggggcggtgggttctttgtctctctctctcgggcggatttcggtttcttcgtgtgtttgttggttgcgttggcgtttggagcggcggcggtggcggtgagtgtgagtggtgaggaggaggaggccgcgcatgggcgcgggcgggaggtgggtggaggagtacgggcgttcgtcgtcgccgtcgtccaacctgcagtgcttcttggactgcaccacccccgccgtcgacacgcacctcctccccaaggtcaccccctcctcctcctcctctctctctctctcattgatcgattgattaaagcttcgtgttctttgcgagatttttggtgtggatgtggctgacatgatctgttgcccattactcgattattctagttactgctctctgtttatttctttttatttttttttctgtcagagattgatcatgctgctgcgtgtttcctgattgcaaaatgcatccgtgaaaaggatggggggtgtgggtaatggtagattgattgattaattgatagtgcgtccatgcttgtatatagcttttccttggtacgattataaggacaattgtaccatcaagctctgtgcttgctgccgtgctgcctaattgggacgaaagtagctgcggcctgtggcgatatacggttgccatcttaaattcccggttgctattgtcaattctatttccgcatgttgatcagctgctgtatatgagtgccttttcgatctgggttagctaagctgggctaccactagctgtgcttattttgtcaacttaagactgaaagtgagatgttgctcgttttgatccaggcgaatggccggttttcgagcgattcttggcaccacgccgagatggacagcgtcgagtacttcaacctcgcggacctatgggagcagtactatgagtggagcgcgtacggggctggaactacggtgcagctgtatggaggggaaagagtagtccaatactatgttccctacttgtcagggatacagctatataccaacaaagcccagactgcatccaggtctgcacaaaagatccgttcttgtgcgtgaattttgagtctgtgccgatttctggatgcattgtgaatcggttctctctctgttttttttttctgtaggagttttggtgaagataatggcatggactattggagcgatgatgaggacaatgagaagatgtcaagatcttggagttcaacatctgaagactcattatttaactgtgatgcaataagtggcaatagaaaacgccacgggcacatgtattttgagttcttcgaggtttgctctccttatggaaggattccactcattgacaaggtaaatttttatgtcctatgtgatagtagtttagaccagctgtttctttttcctatgcttatatcgtttttctacaggtgtatgaactatcccagagctatcctgggttgacatccctgagaagtgttgacctttcgcctgctagttggatgtcagttgcctggtattgatcaagcttacctctattaatgctgtttttttggcaattagcataaaatctggcttataaacagctatagtaaatctggtgtttctgcattcatggttgttctaatcgccttgttgcttggtttggtagttgattgaagcatttctgttaattttggcactttataattcttttgtttctaaatagtagctgatgtctccaggagcttgaatccattattggttgttaattctgttcccagagacaattacgctaaacattatcattaacttatattgctatatttaggtatcccatctaccatattccctaccagcgcaatgtgaaggacttatctgcatgcttcctaacttatcataccatttcctcttcatttcaaggtatgctatttgttgcattagggacattaacaagtactagtttgattgaatcttgtgatagagtcgaaaaatatatatattctagggtactattctattactggatgaaaataatggatatgatattgcccctttgtgtgcttacagtgttgccataggcaggcatatcaattcaaaaatattatagcttactatatgttttttctttgttacatctcatgatgatatacattacacaagaataatcagttcctgtggggaaaaaaacctcaggatcagtatatgtttaaactatgcttaaatggcaacatgctatcccaggactaagacactcaaaactgtagcagtgtagctttcgcagtagtgttgcttgggactgtttgatcaagtggtctttaatgttcagaaaatgaactatatatatagaaaatagttgctttgcttgagactggtcagatgagtggtctttagtgttcagactgtggacttatgtagctagaaaacagtcgccttgcttgcgactgatcgattgattggtctttacagttcagagttcagaccaagcacattgatgcttttatcctcttcattttagatgctaaatttagaaaatatatttactcttattattttgtgttaatgtcaagatatgttttttactgcacattagcatgctatgttagcttaaaacacaggcttagcttgcaagagtttgtaagttttcttcaagggattgtacagctttctattttgcatccaagcttccaacttcagcttcaaaaggtctcatgccttagcttttaagtgcatatataaggatgtcacttaaaaaagaggataagtggcagaagtttggttgcccgataaagcggaggaaggagactgtcttgccacatgccatgacttttagtgcttagtcttaggcatgcagctgtttcttaaaaactagaaatatctatgttctaccacagtggtaggagctctttgtatacttatataaaatattggtgcaaggttgcttggattgcaatgagtgcaacagcacttaggcaccccagctgtccatttcaaatatataaaaaatcagtgggtaatggtacttgagtctaaactgagccatcccagtgtgcttgatagtgatatgcatattaagaagaaaaatattatgcactgttttcctttattaaacttcaccgatgatcaccttagttctgtttttgaactgcaacgcgttgcggtaatgatgttcttggcactaattttgaaccgtgctgacctgtattttccgcctcatccacagattacgcgctcgagagcatggccaacgggaagcgaaacgacgagacggagaagaaggtcagcaagactcatcttgctccgttcgggctcgcggcgcacaagctgcagggttctctctggaccaacccgagaacaggggaccgtgacaggatggtctccctcttcggcgccgcggattcctggctcaagcagctcggagtccagcaccatgactacaactacttcatcactcaccccatgtgatctgaacagctgatctgtgtcatctgagaagagtaggttgcaacttgcaaagaaaccccatggctgcagactttggagaggaggcatcagatttttacttaccccagcgacaatggtagcaaacgttttaccgttttgtcaaaatgacactgacatttgccggatagagttttataccgcttgagacttgagacttgagagtttacctgcagctgaatatataccgaatatatcaggacttataggttttgtgtttttcttggctgaagatgtaaaccgaccgtgtacagaaagttttggaactattttgatatccaatatatgtcgtggttggaattggattcatactgtattttacctgccttgtagttaaagttgatgaatttggaattgcagtagattttgataatctcgatttggtggtggtactgcttttagccgttttggtatttggaaaactatgtttcaaacgacaatattactagttctcaaaatgcaaaatataaaatgtttattttaaaaaaaattaaaatataaaataattgtaaaatatatcacagttggaaaacatatacacgtatatatacatgcaccatcaactacagtttcacagttcccttttttctcacaaaagggacatgcttcgtatttatcagggaaagtgtctgaacttagatcgatagacgaagcttgtgctcaacatatacagctgcttcctttcgatcaactatttttttatgctccaaactacttgtacaaaggggcaacttccctcaatttgatatccacaacacagttcatagcaactatgttttaaccatctgatgacactcaagttttatccatttcagaatgcaagccgaaatgaagtagatgactaacttgggaacctcggaagtatgcactgatgcccaaattaccagtctaactatgttcagaggttataccaccatatccctgtcttctttcacagttcaagctgtgtgagatgttgggaccgtgggatgtactttaaatcttcacattgctgttttgcgccaatgaaatgttacaggtgcttcagtacagcattcatctgtgccagtgtctccagaagaatcttgcaacggccttttacttctcgcctacgatgcttttgtagttaaccatatagatggcgaccaatgttagaagcgcgccaccaagctgtacaggcgagaaggtctctcccagatagaggaacctgagaaggaaaggtgaggcagaagagcaattagaaaacaagtgctacatgtttgtcaattgtcatgtatgtttagcttgacatgttggggaaagaatcttacccaaaaatggaagcaaacataggagttaagaaagtgagagaactaagtgtggtcaagctacctgcaaagaacataatcatatgggaatcctaaaagaatatatttgtggacaataccagtaaatgctaaacatgagtgggaagtgatcttacctcttgtagcattgtagaagtacacaccatagctgatagcactgccaaatatagatgtatagagaagtgctaatacatcattcagtgtaagttcttgaagatgcccattcagcgcaggatcatgattgagaacagatataaccaacaaaggaaggccaccaattatcatgtgctgtaattatgtgaatattagcattttacatggtgtaatgccaggcttttcagaattgcaaaaacaaacaaaactatccaaagaacagggggaatgacaatcagctgtaatcacatcaacatacataatctgatagaaccattacagagttgaaagttataggttgatctgagcattcatattccagttgatgttgcagacttgcactatgaatgcatttccaatacatgattcctctcacaatttatcagaaatatgcattaagatccacaatgcagaaaagcataggtatacacattgagttcctcataataaaaatgaccaaattagcacttccaagatgcatacagaatcatttgcacaaaacatatcatggtaaaaaggtacatttgtagcaagaaaactaaagaatatcaattgtgctctagagcatgcatcactttgttcttatactaaaaaaaaaactatttattcatctgcaataacatacccatcctgttgccatgattggatcagaatactttgacacccaacggaccatgatagttccgacagccatgctttgggccgagaggaacatccaccattccccacttccccagatcgctgtgtcattcccttcaactgatagtgctggaacctagcacagatatacacaatcaatgagtaagcacacaatacaagaaggcattaaattcacacagcacatgtttgatttcgataaaatacagcataacttggaaaagctaagatcgccacttacaccattttatggataacacagcatgtatgtactgaataattagttgccacatatcagtaatagaataattcagaaggcaattgttgtaacctgtaagaattgctatgggaattaagacaaatcaaataagtgggtttggttcaaatatttctacaaggaacttatgccttcgaaatgctataactatgcaatggccgtcgagaaaatattatattaacacaacctgttaccgtaatcaacattatctgcctaggttcaatactgatatcatgtatgctgcatacaaaggcaaacctcgagaagcaaaagcccgacgacacccagcacgagccctccaactcctatcgcgccaatcgattctccaaagagcagcgctgcaaggacagctaccgttaatggctgagaatcaatgataacctgcaatggagatttcagttgaaaacatggccatcagttcaattgacaaaaaatgggggcagtatcaatggcttgctcgaggtatgaggaggtgaagaacagcagtgagaattcagcttacgcttccgagcccagccgatgtcttctgcaatccctccgcgagaaatccctgcgagatgagacgaatgcttttagctcaggaacagcacagccacacgctagagctaagaagcgaacaccttgcagctatggcgggggggagcacctggaagcaggcggcgtcgacgaggccgaaggcggcgacggcgacccaggcggcccagccggagggctgcctcctgccgcgcgcggcggcgaaggcgacgagcagcgcgccggcggggaggaggcggagcgcggcgacgaagaaggggcccgtcttgggtatgacccccttcatcgccaccatggccgtgccccagaagaagaagggcgacaccagcgacgcccactcccaccactccctccccacgagcgccgccgccgaggccgagacgccatcctcctcctcctcggagacccgcgcgaggaggggctccgcgcctacgcctgcgcctgcgcctgggccgtcgacgaagcactcgacgtccgtgcccgtgccgacgcagtcgaccgcgtcctgcggggagggcggcggcgtcgcctcgcggcggatgggccccacttccgcgcctgggcggtcgtcgacgtagcactcgacgtcggcgcccgtgccgacgcagtcgaccgcgtccaccgggttaggcggcgtgtcgcggcgcgcggcatgtcgcacgccacggccgcggcgcgcgaggacaggggcggctcggcgcgtcctgcaaccgggaggagggagtggcgggaggacgagcacgtggagggacgcggctgcggcgggccacatctcgctcgccggtgcgctccgcaccggcgacgaggcgggcggcgggcggtaggtgttcgacgagcgccgcggcggcggcgagagacggcggcgagaggggagagggggagtggcgggggtgcgggcgagtcgagggacgtggatcttttgcgcgcgccacgtgtctctctttcacacatttttttccactatcctcttctggactctgggagactgacagtccaaaaaaaatcacctcgagctaatcaaaacccacaacggttactagaaaaaaaattgaaagtaaaatgtttatatatttgttccaacttccaagtcatttgcttgaaaataaactatgttaaaaatcgaaatcaactctaaaattaatatttaaaatataaattttggttcgagctgataagttcaggaaccaatcagaacatcgagtgatatcaacttgctgcacaaataatggagaaaaaaatatcaaacatatcacaggctcatttggaacacgggaattcaaactctttctgttgagatttctgcaaaatttttatgaaatccatgtcttataaatgaatcttgcaatgtacaactacgcaatatggtaatagtaacattcatccaacatatcactactatgtacaagttgtttttgtttgcaacgtacagcagggcagtaaaacactcaaaaagagcatatgagtgacaaaaggaaaaaaaaactgagagactccagtaagccaatgaatgatttcatctgtttttttaggaggatgctgttgtacactactttcactctagcagcagctgtctaatctcatcgaattcatcgttttcatgagggagtactcctgattcgtcatgttcaactactgctagttcatcgcgacgtactcccgtcttctcgtagaaggcctccttctgtgcatcccattctttgacgatttcatctaccctgtcgcccagcagtttgtcattctgaacaatgtgcctagcatcttcaacatcgataatattgcttgcctctgtgaagcagaaaaaggataaaaccagtaggaggaggatcaaaatcatcgttactgataataaagttctcagtgagtacacacagaaactgaaagctatataatgcaatggaaacaactaagagcacctgcaaatgccaattccttggctttggcataatccaacgatgatttcttgatcttatcaagttcaagctccgaaccctagacgtagatcaatttgtcagtaacagaagggtatgtaatattttgagaaactaaatgaaaggatttctagtatgggcttgtggtcatgttgatgtattgtcatttgttataatgtaaaaaggcatgaaagaaacaaaaagaagttatttaagtcaacaggctaaaccttaccaaatccatgtgcatataactgtctatctgagtattcataaacaacctggaggataacaacaaaatattagcatgcaataatttattacgtgttcttgtttgaataggacaatagtaaatggaatggatcacaaatactaatgagaatcagtttaacacatacttgtcacatgcgaatttcactctcttattctgagatgcagttaactcattgacctgcttcacccctgagtcaccaagtagattgatgaatccaaacaaaatcattcctttgtccagcattcttttgacaagtgacggtacaacagccattccattttgcttagcctcaacaacaaaatccttgagtttcttcaactcctctgttgcatacaaatactgagcatattagtatgtctatactacttctaaaagacagtagcggtgccaccaccaccacgatcactgacatgtggcccatgttgtatgtatagtctatactactatgcagtctgcagcttatattgctttgcatatttattaacgagtacatatttcgaactttaatcaaaatatatatttcattatcatatgaaaaaagacatttagttaaaatggttggagtcaccgatttatattcaagtactggaaactacttatgtttatgtctcacattgagaaccacaatcctaagtatggcatttttcatttcttttttaaagatgaaagatcttgtttcaaccaaataaaagatcattatttttcaacaaggatttaatttttactatttcagtaatccgttgcaacgcatgggcatttggctagtgatatcagaagcaccaaattagtgaccgaaagcaagtgcattaccaagagacaaatagatcttgaaatgtggcttgtatggttgcgattcgtaaagacagtaaaggcagtaaagtccagccaatctttgaggcatacaactctgagatgtcatatgacctgtaatagtaaaaaagtgaaaattgatcagaaatgactccaaagattatttgtgggtatgtcagtgcaaatttccaggaagccagcctaccaatacaatgcaaaaagagcgactgcatgaaagcgccagagtttgtcttaggtcttccttcatagatataagaaaatttctttgccatccacaatctcttgaaatcagcgaatgcagtgcaatttgcctaccaataagaaaaacagcaacgtcaagctgatataaatgtgacacacctagagagattgcaggatagtcaaaattacctcggtataatccgctagtagctcatcaatatccaacttgaaaggagaaagatccatattttgcagtcaagtcgaagcctgaatgagagtcaggaaatgattgctcaatttaacaataatgaacaagcttcagtacgaaaataagtattgtgagccagagcaggcaaagatttcttcttcttcactgtcaccatcttgatcctacggatataaatgaatcacaaaatcgcatcttaacgagaaattaaaatagtgagaggaagcttcatctttcgggttcttacatgttagaagaaaaaatatcttccctttttttcaatgcttgcactgttggctgttgcacatgtctttggctcaccatgtgatggttgagccatttcatcacccatctcattcagtagctaaagttttgatgattttcaattagtctgtaatttcttcaatctatccatctaggcatttgagaactaataacaacagaaatagcagaaatagagaatgaacaaaactaaatcagtagatgagacttgagagatttgagatttcccaccgttggaggtaggagacgccggctttctgcagctcctcctagttgggatccgagtttcggctgtcggggacgggttcctcgccgccgccgccgccgtcggggagcactggctcggcggcgccccgtccggggttgggagaagcggagggcggagcacccctcggccggtcaccgcggcggagagggggacgcgcggaggagccgcctcccgtcaagcagagcggagaacgagacgaaggagaggccgtcgccggtggcgccgccgccgcgtccgtctcctcctccgctccggcctccgcgagcactagcgatgggatgggccggcggcgatacgaggcccaataacggggtcatccatctcgggtcggcccaactggtaagcatcagttattgggcctcacgtccagcccaactagggtgataccgccgttccagcccgacaacaaaatgggctgcaataaatcggaatgtcctttcaggccgaactaatatgggctgcacgtaggtcagaattcagttacggcccaataaatatatggacccctccctcgaaccacgggcatacaaatccctgctatcttttctgtcactgagatcactgaaaaagatctatgattagctctggccaataatcgtcatgaagatgcatgagaatttattttattttatttctgtttaagcaacagatgcaggtgaattggctggtgcaaacccaatccgttgtttcagacttttttcaaagtggttcgatagggttgtgaaaccaactcaacagagtgagaagataatcttttagtcagcagtacgatgcataaagctcacagttttgcaaacacatgtatattgtttctctaaacaaatgtacaaaagcatggaattctttattctttccatccactaaaaagcccttgattgtataaccaagggagagtgctatctactaaaatatgaaaaaaagagcgcaccaaatcacactgcattggcacatgaacaaaagaacaataccgcagaagattcacacttgtgagttgtttgaagattaatcaaatgaatagatgaagacacgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagagatcgtgggaacaaatcctttcacatatgtgtgtgctatgatttttttcttcttcaccagaacaaatcttgtaatagatctaacgattcaaaattacgtgaaacttacatacaagttacactatagttacatgcaagttacagtgtaattacatacaagttacagtgtaattacactatgattgtactataattacatctgtcaaatttttactagaaaatttgtcgacaaatatataggtagtcccttatcgatccctgcaaaaacataccatacagattctagccgtcgtcgtcgtcgtcatcggtgacctcctgctggatctcggcgtagcccttggtgcggtactggtagaggacgaaggcgtcgaattctctgttctcgtgaacttgggcagcgatttcctgcctgagttcttggccgacgaacatgtgctgcgcgatgctgggatcgatcgggagcgggcgaggcgtctcgcgcgcgaggtaggccataacctccttggtccgcaggtatcccatcagctcgtcgctcagcttcaccgtcaccagcttcttcctcttcttcttcctcctcttcccgcgctcctcctcctcttcctccttgggtaaggcgtccaccaccatctcctctttcacctcgtcgggcttgtgcttgtgcttgtgccttcttcttcttcttcttcttcttcttcttcttggatgatccattcttctcgggggagttgtcgagttgagcttggggatgccggcttggatctcatccctcgccattgctgccgagtcgaaaccctcacagatgttgttgcgagggcggcgggcacgggcactgcgaggaagagaggaggagctaaatgggctgggcctctactcacaggtccaactaacagtaagtctattttgcctccctcacatattgcttttctcttaataaggtctcaaaacgtaaaacctgatacaatgtacgtctcctccaataattaaaaacaggtactaatcgactctttctcagcggtggtttggtaacatggcaggttgatttcgagtcaacatatgaaacctatatgatctagagtttcggcattgcgccgctgacggaagcaagctaaccagaggtacatctctactattataaaaatgaaaataaagatgtttttgtcggtactttggtacgccatctgtgtatgagtcggtttttaattttattcgcttttgaaatatatatccgtatttgagttggtttttaaggtcgtttgttttttaaatacaaaagaagtcgtataataaatctttttaaaaaaactcacatgctaacttgagatgatcatactcctaactgcagctcatgattttctaaaaaaattatatattcaagcgaattcccatactgaatttcaccttaactaaaccgtataacaataataagattaaaataaccttcgcccgttgcaacgcacgggcaatttttctagttaaacaaaaaaataaaaaaaattatataatgaaataaaatccatagcaattctttatcaagttcttcatataaaaattgaaattccgcacatatatctagcagacattcatcatagaacttttacatatcatagggggccatcaaagtcacgcaatgcgtgacaaagtggctagttcatactgaatgaatatttactgcatctaaatgatactacatatataatattaattaatggtccagtttgtacaacctgttcatgcaaggtaaatgatgacaacaatcaccaacattgagttaatagaacagtaatagaacagtacaacatcattaggagtaccctgctcacttttctttattgctattttcaaccctaccaaattttatcatcgtcaaattttattagagcaacaaaccaaacacatccttaccattgctaccataccaaaatttgaaaaatccagaaacttccactctcaaaaactctaccaacataaaagtaagattttaaactaaacgcatctaatactaccaaaatttggtattacccaatgttagtaagtttgaaaatggtagaaaattgaacaagccctaattaattaagtcgaaacacagaaaaagcccaaatgccatgtataagaaccaatctgtcattcccagtatttttcagggaaatcagtcttcatacaacatgttcttctgcccccaatggcactcgctctccttaatgttgttctgcatcgagtacaatgccccatgtaagcaatgatttttttcctatagttcattctaattttgtcaacaagtgaaaatataaattcttttgtctgctacaacatgcttattgttacccgatagggtgcgcaccattgcgaaccgtagaaacatctaaattctcaacgactaattttgcacggcccacagttctattaactctcaaatctgaatattctcacttgtcctaccactaaacactatcagtattgttacaaaaggacattatttgacctagtcaatgcagccatcatggttttaaatccattgtaatagccatggttaaaaccattaatcaaccttattgcaaggaaatgaatcaaccttattgctacctttagaataagaattgatgtattacactaatgcctagaattaactaggtttgtaatctccctatttataaagagaccttaagatcaacgagaatatgggcaaattcatgaatcactgtttctacttttagttttctaacacgttgtcagcagctctaagatactgagcaacaaaggtgaagaactcaccggtaactcaaagggtaagattgctcgccattttcccattcctcttgacgctggatctcctcttcatcgcaaccttcgtgctcgccatctacgttgcctcatgcatcaacaactcgacaagcttcttcgggctcttgtgcgccgttctcgacgtgacaggggctgtggtgctggctttgccggccgtggcccccggtctcctccctctggcttcgccagacatggaggaaacgccgcgacgatggaccaactgcctgcagaaccaccagagctgatagccctaactccagcaccctcgcgactcgctatgggcctccagtgatgcctgacacctgcaccacgccataacacattctggtggagtcgccgcgccactgcaagtcccatcgatggatggcaagggtgcggctacagcccgacgggctaccgcaggaggtgccagacatggtgacgtcatactgtcctcaccacggctggacaaaccacgctcgccacatcatatcaccgtcaccttcaccggagtactcaccaacgacgccgctgtacactccaatacgggctgaaccgccgaagctcctccttagaggcaccatcgtcgcgcgttgcggagccccttccttctacatagcagtaggtggctccagcggttccgtgctcgcacctccatctccaccacaggccccttcgttccccggccgcccgactgtagccgcggcagcaaacgcgcgccccggcctccaccgcatcatcaagaccggacatgtccctgcagagacgagtggcggcaacacaaatcggcagcaacggtgtactgtcggcagcagcagttcaagtgggaggatggggtggcgccaactaatggcccctatgcgcccgcgcctcccctcccgacttcctggaccgaaagcagcggcgggtcgaaaccgagattgtatcggctcatcgcccatttatttttatttttccagaattttcattctagctcctgatctttggtcaatttactttccgcaaataatcagagactatacatttgctttcagcaccccgtaactctctgttattataaatatgagtttgattcagcactctatgcatttccatgtcctttatttttacacgcactttattttttacaaattcacataaaatggcataaatatgccataatttctcaaaaattttggctatcacaatgtaggtgagatagcaaccaaagagtttgatatcctcactcttgatggtccaaaatccctgcttgggcgatagatgtcaaagtaaatctgtcgaccaatggactatacagatgtatagatgaaacagctgaagggaacgttgcccccgtctaacgtgtctaaatactccgccttgaaagtaacgaggaatcatatccgtcaggatttgaaaatggagtacatgtataaggaggacccacgtgctttgtggacatctcccaaaaatcgatatgaacagcataaatctactcttctccaaaaggcaacgcatgagtggacccacttacgcctacaggatttcaaaactgta

SEQ ID NO: 51108 - DNA, 15559 bp, Oryza sativa
  unsure (1)..(15559): unsure at all n locations
attcatttccttgcaatccactcccccacatcaacagtgaattgcaaggaaatgaatcaaccatatttttatctttagaatgagaattgatatattacactaatgcctagaattaactaggtttgtaatctccctttatacggtttgtaatctccctatatataaagggacagcacgggagaattcatgattcgttgtctctatttttagttttctaacaagtatggagcatttaaaagaagaattatgcatagcagagcagaaaccagttatatgaaaccttacagataacataaaccacatgagggcaggctaccacaggtctataaaagaaaacattttggttttttcagcttcacctagcaattatgacaatacatctggacaacaagcagtggcggatccaaggtccgtctacctcgagcagctgcccaggctcaccggcggatcacaccattacaataccttaaattttcagtgtttaacaatgtatataattcttcacatatgtatttgcccgggctttaaaaagtatcaagatcagccgctgacaacaaggttatgcaccaatcttatgacctcattactttcatttaccaggtatagcctgacatcagttgtggtatcttaaatagaaagacatatagaggcaaaaaggccatactgacctcaaagatcctgaaatttctttaccggttgccatctttggctcctcagcatgtgccaccctgtaagaaaacatcaataaaccccttcaccattttaacaaaaacctcaattttctcttcctgacattgacaaaccaacttcaattcataacacgaaagttcaagaaagaaggaaacataatactccctccgtttcatattataagtcattttgatttttttaaaaaagtttcaccgagtttataaaaaaacatagtagtattttcaatacaaaacaaacatattatcaaaatatattcaatgttagatttaataaaactaatttcatattttagatattgctaattttttctataaacttggtcaaacttaaccaagtttgactagagaaaaaaaatacaaaacgacttataatacaatacgatgaaacggatgaagtaaaaatgaagcacataatgagaaactttttttttctgtttccaatgtgtgtgatgtggtagaatctgaacatcaatcgggtactttgatttgctaacatatcatcatgcaaaaacaaagggaaaagggatagccaacctgaaatctgctgcctgtgacatgaattatataggtggtgcggttgtgtgatcaaggtctccttgccttcggtgttgcccttccttgtccacagagggcgaacttctgaagccttgtgctcttaaaggaccatgcaaaaaaaaaaagaagatgaaatatgttatggcatgaacacatgtacataatgttgagtatgacacacgagggaaattaaaagtgtggcaataagacagtaaattaatgactaggcgtcactttgtcgatcatcgccgtaaaaagacacgaatattagaaaatgacctaatatcaaataattataagagtaagacttcaaacccaaatcgtctagcccatcaccctgtgtagctagctagaaaatctccggatgtttctctatcgatcatcaccataagaacactgattgaacctcgatataaatctgcaagcagcacaaggtacagtatggaagaagagtaattaatttaatcaaatacatgtcttgagtaatgaactataccaattccagttggccatagcattatgggttaaataatttttttaaaaaaaacatcagtcattcttaagtacccagcgagcactgaatttgcacccaaaaaaattgttaacgcaagacgataaaattaatactctctccgtttcatattataagactttctagcattgcccatatttatatagatgttaatgaatctaaacggaggaagtagatagaagtagatagcaagacttgtagcagagagtgggtacatccagctgtttgtacttgatatttctaaatcaccggtagcaagatactacctccgtcccaaaataagtgtacgcatgagtttccgcgtccaactttgaccgttcgtcttatttaaaatttttttataattagtatttttgctgatataagatgataaaacatgaatagtattttacttatgacttatgtttttagttttttttaaaaaaaaattcatataagacaaattgtcaaaattgggcgcgaaaaaccatgggtgcacttattttgggacgggggagtaagatgcaagattgcattatagtataatataatgatgagcagaactagtatacactataaaaaagacgatttttctggacgagacgatatctatataactcatatatattatataatatatactctctccgtctaaaaaaaaacttaatttagtcagaataggataggatatagattatgtcccatcttattaggttgtttttttttttttgagatggagggagtataggatagctggatcacaaagaaacttgcaaattactaagccacataattaattaagcttcctccttaagcttattcctccatctggcttcgtcctccagctcctcctgttcctcctcgagcatcctcttcgccctcttctccggcgtcctccagttcatccagcccctcctatcgatgatgagctcgtcgtcgtcgtcgtggtcatcggaggtggtgatggggtccatctggagctcgacggggccgttggtgaggcggtgttgcttgaggatgttggccgttggtgatgtcgtctcattttgatatcctgcagttgccgtgtctcaagtgtttagccgtataatcaggtcttcaggcgatgcaaaaaattcatatgttcatatcttatatagtggcaggaaagccttctttttgtatttttattgctgcaactttcgttgcaaacttcagaaatacactcgccagcatttgacggctgattacatatacgcttacaggcttacagcttatttctacatacataaccaaatggcatcccatttccagctctaccaatccttgcaaattgcaaaccttcttcctgaatcctgatcaatttagctgtattcgccggacacgtactaacctgtgctgcttttctttgctgactagtttggtgtcaagacatacatcttgcagtcatgaggcgccaccgatgctgatatctgtccctgagccgcgaacgaagagtgctgcacaattgacagaaatttgttatgaactctgaattctgaagagaagatgttctactttgagctctgaagaaagcaaaggctttaccgcccatagatcacgagcagtgaccgcgaccgatccagcgagcccgatgttcgaccaatgtgcagtgatggttgcctggtatgactgcctgttccagagcaccacagccttcctgttgttgctgagtggcccggcccaaacctaccgacaaatttacacaaagtattgtcagcttcagagttagtcatgatcatgccaaggcttatgggacaatgagaaactgcaaatttggaagccattgaaggcatacctccaatccgttgtcagattgtactttctttccttggacacctagactatctgttcagagagttacattatgagtatggtgaaatatccaagaggtatggctaaatctaagcatgtgaaactgagaaggcttgccttggttgacagcgatcacctccgagttgctgagtatgttcttcgtctgctggctcattgagcgcacatcgcatccgatcaaaagaggagcctgaacaattcaagcaaaacttgcagtgaggaaatgcaaagaagttcaacattgcagcaaaattattagtacatagaacatgctatggtacctttgctagtgcccagatactgaagtgtgaccggtactcagcttcagacatcccaccatttcccacttcaagcatgtcaggatctgatattgcacagcagaaacatatgttgatcattttgaagctctcaaatggttaagcaacctaggaacagatacatctcaagttcttaccattccatccaccaggtccagcataggcagcccattggtcattttcgtctgcacgagatgtcatactgaaataacagggcaattacgatcagtactgaaaaactcaagaactatgtaaacagggttaaagagaggatgagtagaacctgccccagttgtcggcgatgtcgccagttgttctccagctgttacccatgcggcctgcccatgtagcaggattttctttccccctatacagaaaaaaaaacacagtggagtgaatcagcaatgcttcatgttccttcgacctagccctaaatgttacagagagtaaactcaccattcacagagtgagaagaagatattctttccataggtcttcatggcattgctcattctagtgtatctgcattaaacatgaaaacagttgctcatcagcaatctgatgcataaagctgacagtttgagatgttttgtctccttacctttccatgacactcctgccagcatcattgcagttgtcatacttcagataatcaactccctggaacatagaggtcaagaattaagaacaccagaataatagtttcagtgtttaatgttgattgggtataaccagacaggtaaaagagtcgaggtttacccaagacgcgaaggtcttgacatcttgctcttcatgatcaagtgatcctggcattttgttactgcatgtttgtgacctgaaatacagtcttgctattagtttcagatttgttgatagtttatattcgataaaattcttagttcatctaggctaatgatgacataagttacttctggatgagtacaaagtagtttgtcattatgataaatctgaaagctagcatacccggcatcgctgtagatgccaagcttcagcccttttgcatgcacataatctgccagtgccttgataccagaggggaacgtctgcctatttggcacaaagttaccctgagaagcgaaaaaaagagcagtacaacttgtcaaaactgacagcaatagcttggtctacacaattttaaagcattgatcttttaaaattgctcattctccccccatgcagaatttttcacatataaaatttctagttatgacacattaaactgatagaaagtacatacgttttcttattaatgtgtattgtaattgttaatgattgtttccagtctaaaatttctcaggctcatcaacaaactagacaaggttctcaaatttgtatcctaaaattgtgctgaaaattatggcggtggatagcattgctttatggagaatatttttgtctctttacctgggaatccctactatattctgcccagcaatcatctgaaagaagagatggaaaacattacagacatgagttactagctgttctatcacaaaataattgaattaacttttgctaatatatcaacaatgtttgtgtccatactctagtgtatcatatgaaatactgttcatagtttctatcagataaaagcccatacctatattcacatactggtaccccaatttcgccagaccagtgttgaccaatgcatcagctgaagaaaggaacacaattacatcagccttaactctcagttgctcacaacattattaaaaacagcttctattaaatctgtagtacaaaaaatctcaaaaggcgtctggttcgacaggcttccctgtcgatgcttgtaactttgcaaattctccttcaaatcttaatgatatttgatcagcctcttcctttggccggcccagcaaaaaaaaaacactatgtgcataatattgacaatattaaggaacaatgtttgtaacagaaatttgataccagaccaaatcagtaccatgattattctgataagacactaagatcatcacgggtgtttgtccataaccacctactaggaagctggaacatacaactatacaagtagctagagagtggttctagtactaactatggttacatgtaaatggagtgagtccaagtggagcaggtttcatgcctgcctgcaggctgcagctgccatcctcttatttagagtttggtagttaggcagtaccaatccatggctgaccccaagcttgtagggccccatttccatggacttcctttcatctattaccaaccacatactttgtagtagtactagactgtggtgacaatattgtcaattgattttgtttggaccaccaagattgactggatgactgatgagatgattaatgtgtactcagtcataaaaatctgatctaagacatttactctagatttgttcagagatctgccctccacaagctgtcgacatgaatgatttaattcaacataatccagttgtgcagatcagaatcagtgaaaatgtcttcacccattctggagatcagcattgcttggttatggggcctcatcatccgttatcaacatggtaattaaagctcctatgaacattctggccaaagggtcttattcaacatggaccctctcactctccctttcatttccatatttctgccacaatgttttgcaacacatgtggccttgctcctctaaacaaaacaaaacaaaagctatctactccatgcatggaatcttttgctctttccatccactaaaaagccattgattggataaccaagggaggatgctatctactgcaatctgcaaaaagctcctaatcacactgcactagcacatgaagctgctctgcctgaaactcttaagcaatcctagcatgctggagcaacaaacaaatcggccaagcaagcaagcaagccgtgactgattactgaacattgccgactaaaaattcagtcgtccaggcaagttgcatggtggaagagttaaaaggggcagggcatctctgaaccagatctgattcgtctggtgcccaaagaataaagatttggtcaggagagatagagagcatggcagtgtgtgtgtgcagtgtgcaggtgcagccaatctggtcgctgtcctttgcattgctagtactagcttgggtccatgcaaaacctgctgcttgcaagctgtaaatctgcaagctcaagctcatccctgcagttaatcctagctgtagtaatccgtgccggccgacaagggtctcgccctgcggccgtacagctcgcagctataccaaaacagatgcattgttgtctctcgggtgactcgagatctcaccgccccaattcatggctgtttacttttacccaactcttattacactaccaacttgtaagagcaagtataatgaagtgatagccatcggagttaccaagatttaagctgtgttcttagagaaaagagacaagacttgaaaaaagacgggctacagatcggtaacctgttgcaacacaagctttaataagccttatgaggtgttagtatgtatctgtatgtatctaactattgtataggtcggctactagattagtagcaaatgacgtgtcatttgttaacttgctttaatcatagcctgtgatgaatgatccttttttttattatttcttggaagttttgatgcagggtatgacaaaagtacgtggggaatttcagataagtcgcatcaccgacggcaaccttttttttttctctgaatgttttttgtagcctgctgttgctgacgttgatgcatccaaacacaccacacccaccacactacgccgaaccccaccactatgtgttgtgcttccaagatgttccaaattagtgcatagtttagaactactaaacttcttgaaaaaaaaaagaacttcaaaaacagtgtcctcccaactaaaaactactaaatcaacgtattaagtcatctcctagaaaaataatctaagcttcattggaaagatttctgacgaggttgcaagttttcggttcctgatgtgctgatgcacattggaaaccgacggggattgtttgcagtactacacctgctgcagatgtcattgatatatatgactaggtatacatgtcaacaacagcaatactgtagaggatccgtgtccattgggaaccaatgcaatgtgtatagagaaaaataccaaaacacggtacgtggcgtactggagagatcaaagtgtgacgccatgggttgcagaaataagttgagttgagaagagagcactagtggcagaagcaagtgtacctgtttccctgatgatctgctcgttgatcccgcagtagaagtggttccagctattccacctaacacagccacacacaccgagagacagcgtcagtcgcacagcagttgttaattaatttattacttgacaaaaccacgaccattgatgcatttgtaccactgtctgctaatgcctacacacgtgaatctgaaagactagcagtattgtttacaacaccgacatattatgaagtctgaactctaaagaactccctctggttaaaaatataagcatttctagcataatttagagtactacttgctgtatggattatctcccattcgaaattctttctactaaaatgtcctcacatccctaatcatccctcgcttaatgaaggacatcaaagttgtttttgttaatttcaatatttgctaaataatataaaaatactttgatattttggaacatatgaagtactctctaatatgttagaggatatgacacatcctaataatacgaatttggacgaggacgaagtgggacggagggacggagggagtactccgtccatcccaaaaaaaagacaaaccctggatttccgtgcccaacgtttgaccgtccgtcttatttgaaaaaattataaaaaaattaaaaagataagtcatgcataaagtattaatcatgttttatcatctaacagcaataaaaatattaattataaaaaaatatataagatagacagtcaaacgttggacacgaaaacccagatttgtcttttttggagggaatgagtaggtggtaaaagaaagtgcggaaattctgcctgatgcgtaaagaacaatgaaatggaagtacatgtacggtaaaaccagttcaattgtgacagaatttaatagaggcagcatagttgaatatgtcagcacaagaaaagaggctaaaagggacaagcaaaagaaaagaaaagaaaagagcatagatatgcccgtcaaaagaagcagaagccaaatgaaaagcaggaaatttttatgcctgtttttggtggacatgctcgctttctctcggttgtcccttgtctgaagattttttatgcagtggagtctaaaccttactacaatttttctcaaagtgataatctgatgatggttaaccttgtggatgttcttgcagcctgacagagaacaggattgtctgatttttttttcttttatacagtctgacagaacctaaatgtacaaaaaaaaaacccaaatgacagaactcttaagctttccattgaattcaggaaagttttccacttttccgggtgaaaaaaaattcacacagtgccctgtacctgacgaaacatttgctcgtacagaaagcaacattggtctccaacatggcaatagtccattgtacagtagcaccagtttttctttcttctttcccatgcagaaaagaacagaaatcttttggacaaacggagaaaaaagaaatgcacccaccgcgtccgcgtgcgcgcgagctactcttctgacgtctcaaatcgacagaataaaaaaaacagagagaaaatctatcgccgaacacgataaacaaacgcaaaattgagcacaaaaacaaaggataaaaaaaaatggaaaacggaagcgtagtactccacatgcgtgtgatgtcagtttttttgccgtgcaggaaagcatcgaagaaaggaacaaacaaaagcagcttaaagttcagagtttcagagttcagaaactgcagagaagagcagaagaagctttcgcttccactgcaagctagagacatgtccgtttcctcccccaaaaaaaatccgactagaagatgacgcgattactgtttcttttttattttccattgtgataatcggttgcttgctgttcactaaacgtgttattactctaccaaaattttgaagctcccagagtttcatctcgcataaacaccatcaccaaaattttggaacgtttcaaactgaacatatctaaaagtctgccaaaatttggtaacacaaaagaaaaatgtaccaaaatttatacagtataagcggtcacgagttgcgaatgagaaaaataaagagagagggagagagagacggtaccccatctgcggcgtgcggccgaggccgttctcgaaggcgcggcgccgcgcgcggcgagaccgccaccgcgcgccgcgggactccgccgtgaagttgcccagcgccgccgcctcggggagcagcgtcgccgccaccgccaccaggaggaggaggaggaggcgcggcgacggcggagacgaggagctcgaggcgcgcgccatggccggcgtgctctgctctgagcttcgctccgcgttaaattcggagggagaagtgggagaagcgttttaatggcgcgcgctttatataggcgcgcgcgggggggagtcggtggggcccacggttttcgaaatacgtgagtttattttattattttgcgttcacactcttcttcgggcttgacttgtgtcgcgggtgagtccaccaattagcgcgcgcatagataagcgtctctgctctttcgctagatttttatataaaagtttcttttaaaatcaaatactacaacctccgtccattttaggtacggttgtgtattttcgtgtccaacatttgacctcttatttaaaaatttattaaaaaataaaaatatttagttacacataaaatatttatttatgttttatcttttactaataataaaaatactaatcataatatttttcaaataaaatagacggtcatgcgttaaacatacacagtcaaaactaaggtctttctgggactgagctgaaaagctagtgaacaggcctttttaatgttactaccttcatcctagaatagttatatatctataattcaaattttatcatgaaaagattgtgtttttattgagatgtcagacccaatcaattaattacataaaaataattgactccgtatctccaacttctaaccttctttttaatcaagtttaagcatgaaatgtatgcatataatgtggtaattaaaatagggttactgcaatcgtttgtgtgttgctaatctgtctttaatcttctaggagtgcaattattctggatggaggtagtaaatgctaagaaaaagttgttttctttcaatcatattagtggttaaattttaaattactcctgtataaacctaatttgtttaatgtatggatcccggtgcattggaatcagtgtatcagacacacttagagcaagtttaatagtatagccaactactagctctaaatcatgtatagccaatttaatagtcaattcatacaatagttgcttactatactattaatatatggtcccacctgtcatacacacattgtgtcttagagtccgtgctgcagctggctacagatctgtagctcgctgctcttatctctcatcttttatctttttaaaatatgtttatagctggctaatagtttgctattgtatctgctcttattttatagaaaaaaaattcatgcaaatgtttatattttggggcaaagagaagtagcacatctgctatctatcattaactcttaaaaaatctacatttgtcaatctatcatctagcaatacaaattagacctttaaaaattcttatatcagctgagaaaaaagacagaattacgatgatacatataaagacaaaagtataggtcatatagtgcatggtaattgttattttggatttaagaattaaaaacaagaaaataaccaaactgaggcagctaaacaaatacagctcgccactattagttctaaattttgaaattattatatcgtaaaaactaatcaaaacgacaggacatgtatatctgtgtaattgttaatttttgaactatctaatcattaaaattaaattaaagttaggacattgcgacaagtatagctttctattcatttattatagttttccttaaaagaaggtaaaattaatggtaaatttgttaaaggtatttaaccatagacacctctattttataatttaaccatatttgctatcgatagatggttccacttaatagaagaactataaagtcaacctaagtgggttagtgcaataatacttttcagttttcactaacccaacgcccattttctccacaagagaaagcagaaaggacagcttttctttctctttccatccttttcattttcctttcggctctatgtagtatctgaagagatttaatatttttttttgtttatccttgggagcataggaagtagttaggctctaggctaggcctttgcccttttatatctcttactcatttcataagggactgaagggagactcccgagttccatgggtttttgctccatgtctcaagttgaagccatgagagccaggggattgtctacacagttggggtttagaaaaattatgttgcctcctaactagggcaattctgacacagtcccatttggagatagaaaatattaagtttggacatcaagcccttaaaaaggtgaagtgccggtgaaaaaaatattgttgtaatggattaagaaaatactctattataaacagttaagtaatgtaccctctgcttttatactcttgtaaaattataaaatatagataaacttaaatagttggtgcactgtgtactgcaattacagttaagatccaattagttaatatatttagaaagaaattatttataaattttgggaaacattcgaaagttgacagcatgatgctataattgtggaggtgttgatgtcaaggaagaacaattataaaggacattaaaagatgaaattgtccagtttaagtttgaggttaaaattcgaactttctgcacagctttatttagacaattaattttctgcatagtttatagggtctaatatatttttctattttcttttacaaaattgttgcttatgtctggaaaggtgcctaggatggatatatccaaaagtataggttgcgtcatcatggacagccaaagcaaagcatatatacttcctccatcccgaaaaaaataaatctagaactggatatgacatattatagtacaacgaatcttgacaaaggtatgtccagattcgtagtactaggatgtgtcacatctagtactaaattatttagattcgtagtattagaatgtgtcacatctagtactaaattattttttatgggatggagggagtacggcgctagaggtcggcatccaaatcaggattttgacaaccaagtcatctccactttgacaattgacagaaccaaaaattaaaacgttatcagtttactaccacttgagcagcaaaaagggcaggtttcatggagagtgttcaaaccaacacctcccaaattaacaatccggctctgaattattagtcgttcaatgatgaattcatttggtggtaggagtagctagtagtggacagtgaccatcatcatcatcatcatcacctgatctccgttccgtgtcaggagttagtggatgatgttgccattcattattcttctcatcacttcgcctttctaatcctccattaactattcgagctaaccagaagttagcctgcggccagataatagccagacggtgtggttgtgtccctagcactgcagggttcaatttctacatatagtgccatcataaaaaaaaactttttttataaaatgtgaacggttttaaaagttgaaaaacaataacaatcggttttatatagttaaagaatacagatcggaccacagtcataattggaggactaaaagtggatttatcatatatctaacattatttcaagcgtggcatggtttgagggtgttattatttgtggatggtgcatattcaattatactcttccgaagaaaactgaggtaaccatttgggacagagcaatagctgcttgatgtatagtagtggctagctagacagtggttgatgtgacactaaaaaataaaaggtgatgagaagagaataaaagagcaggtaattaatgaattaattaatttactgacagataataaggcagagttggccaacaacatcacgtacaaaagacggcatacattagaatgatcaatctgttgggagaaattgttgacttgtgtggtaatcgtggaggtcccatcagccgccaaaatattccccaaaagcacaaacttttgtaaagataatttttttaccctggttttagatgataagagagcaaacaaactgggaatggattatggatgaacaattatcaacttgatcttatcattttgcgtgtaatctgcatgtacactgtatttcacccatggtatgaatgttaatgggagcatgatggagttgtgctcttaaagtgtgatctttaacaatctgggataggctgcgaaagtgatcattaaccgtgggcaataggatttatgatgttccacaatttattgtgttgatagcaacagcaataactaataatcaacggtatttaaatatatatagaaaaagactctgcaattgttttaactgtactaccacaaaataagttgtcgattgtcacagatatttgatttacaacaaaattcaaaactttgactatcaattttatattagaaaaaattttaaaaaagaatataagcttagaatattatcatactgttctttttcaagacaaatctgtgtataccatttcttcttttttaaactaaccatatggaaactatattcatggttaaagtttgtgattggttaaatcttattttaagtgttaaaatgtttatgcccaaggttatactaaactattactccttctgtcccatttttttaagtacggatatagatttcggtgttcaatgtttgatcgtctatattatttaaatttttttattagtatttttgttgttattagatgataaacatgaaaaaaactttatgtgtgacttatttttttaaatacaacagacggtcaaaatgtaaacccacatctacacttctaatgagacggagatagtactagctaggtttatcgcttgtgataactcgatcccgtttcggccagtccttgtcatgcaaggatattgcttacataaatttggggttcagattgtgaaccttaacctctccttatccatccatatgaatgctcgcctaaacgtctcgatcatggcaaccgatggagcctctcctcacgcgtcaaccatctcggatcagattatatatccaattgatcacttgatcaaaccaaggacaacatcactgaacagcagcagcagcagtagacaacaattgaagcatcatctgagacatcactgaacatctactagctatagcagcagtgtgctgtttgcagaacaattgtaaggtagnnnnnnnnnnnnnnnnnnnnnnnnnnnnnnnnnnnnnn

SEQ ID NO: 51109 - DNA, 9230 bp, Oryza sativa
  unsure (1)..(9230): unsure at all n locations
nnnnnnnnnnnnnnnnnnnnnnnnnnnnnnnnnnnnnnnnnnnnnnnnnnnnnnnnnnnacagtacataccatgaaatgctggaccgggggattttaccagatgttgtgacctacagctctattattgctgcgttatgcaaggctcaagctatggacaaagccatggaggtacttaacaccatggttaagaatggtgtcatgcctgattgcatgacatataatagtattctgcatggatattgctcttcagggcagccaaaagaggctattggaacactcaaaaagatgcgcagtgatggcgtcgaaccaaatgttgttacttatagttcactgatgaattatctttgcaagaatggaagatccaccgaagctagaaagattttcgattctatgaccaagaggggcctagagcctgatattgctacctatcgtaccctgcttcaggggtatgctaccaaaggagcccttgttgagatgcatgctctcttggatttgatggtacgaaatggtatccaaccggatcatcatgtattcaacattctaatatgtgcatacgctaaacaagagaaagtagatcaggcaatgcttgtattcagcaaaatgaggcagcatggattgaatccgaatgtagtgtgctatggaacagttatagatgtactttgcaagtcaggcagtgtagatgatgctatgctttattttgagcagatgatcgatgaaggactaacccctaacattattgtgtatacctccctaattcatggtctgtgcacctgtgacaaatgggacaaggctgaagagttaattcttgaaatgttggatcgaggcatctgtctgaacactattttctttaattcaataattgacagtcattgcaaagaagggagggttatagaatctgaaaaactctttgacttgatggtacgaattggtgtgaagcccgatatcattacgtacaatacactcatcgatggatgctgcttagctggtaagatggatgaagcaacgaagttacttgccagcatggtctcagttggggtgaaacctgatattgttacctatggcaccttgattaatggctactgtagagttagcaggatggatgacgcattagctcttttcaaagagatggtgagcagtggtgttagtcctaatattattacgtataacataattctgcaaggtttatttcataccagaagaactgctgctgcaaaagaactctatgtcagtattaccaaaagtggaacacagcttgaactcagcacgtacaacataatccttcatggactttgcaaaaacaatctcacttgacgaggcacttcgaatgtttcagaacctatgtttgacggattcacagctggagactaggacttttaacattatgattggtgccttacttaaatgtggaagaatggatgaagctaaggatttgtttgctgctcactcggctaacggtttagtgccagatgttaggacctacagtttaatggcagaaaatcttatagagcaggggtcgctagaagaattggatgatctatttctttcaatggaggagaatggctgttccgccgactcccgcatgctaaattccattgttaggaaactgttacagaggggtgatataaccagggctggcacttacctgttcatgattgatgagaagcacttctccctcgaagcatccactgcttccttcttgttagaatcttccccaatcgtctgggagcaaatatcaagaatatcgtaggtttttccctgaaaaatacgaggcttctatagaatctttgaactgcttcgaagctttttgcagctttgaagttctgagttggaattcttttctactacactctacagttgtactagaggaggtatcttttctctgtttgtgtaaatagcaagcagatcacctcatgtctgttttagttcatgttaaccaagagactataaaatatacacacgtcttggcagttagaacttagaagcaatgtcgccaccaagctatattttttaagtgcctgttttttattctcttttccaagaggttttccaccggtttttggtgtaaatgttagcatgtttctcggtgtaaattgattcccacgcattgctatataatcttggccaatggtttttagtgcctgttttcaaatttggttagctgtcagtcaggaggtgcatgctattaaatttacttttgccgatgcaaaactgtccattttcagtttttgaattcataaaactccatactagcttgaagtatacatgtatatattagcaatactagctttcttccaagctaaccattagttgttagagaagaaggcaacgctcaaaatgtcctttttagtttttatgtttgttctgcagacacttgtctgtaaatttgaaattaattaagcaggtttggataagctgcttacttttaatatgtatagacttcaaatatcctttggctgattgcatccaaaattgctacggaaagtctgaaattttgtttagattatgccaacaatgcatgcagaaaagtttattttggttttataggcaggctacaggcatgacattgctgggtcaatagcttgaaagctgaaacagtaacctacaatacggaagtaactgaaacgctgggcattttgctttcaaatgtttgaatgccagttatgtttgatagtcctttgcactttccatttaatcaagatgtccatatctcgggtagataaattgtttatcttttatgatatcaattggatattcgaagtcacatcctactactactaatttgatgatgcattagtttcgatcacaagcatgttttttggcagattgatatcagaaattaatgggaggatggtggtgtgcttgcaaggctggacgtttgctaccagaggagtgtcctataatacgaggcgtgcagttcagtgtcctgtaataggagtgaatcggtgtaatttctgaagaaattacgcgtttgcttccctctgatttcgcgttggggggacaacatggctttgcgcctgaagattagtagtattagggtaacagattgttgagctaatatttggtgccgcaccggagaaactgaatagtatatgttgttaacagataggctcatagctgatatgtgctcttgattgttgctcagtttaattaccggcaaatttaacgagagtaaattcatcccatcagtgtttgtaatttcagcccaaatgcacctgtgagttaggcccaaagtggtcccaaaatctgcctaaacctggcacaaattcggtcggtagtgtcgcacagtttcacttatcgcgcggcggttatcgcgcttaccgcgggggtacggtaggagaaaccggcgatatggtttagatgaattttgaccaaattcaaaattctggaaaaaaaaaattggaaaaaaaatcatggatatagttcttgatttgtacttgctaatggtgaagaaattttttgaaatagagtaagctaaattcaaatttaaggacaaaactgaaaatagtttacaaattggaaaaaggaagacaatattaggccttaagtatcctacatattcttccaattattctcaatttttagttttctacacatattcaaccgtattttcgatttttttcctatttattttttatttacatgatttcagctacacagctcgcgataaccgtgcgaatatcgtggtaaaccgtgcggtaaccacggtgaaatcccgaaaccgccaagttctgaattcgaaattttggatgtgatttttgtacgattttagacggttaccgcactaccgcagggtgacggtaaccccggcccaaacgataaggtaaaccctggtcgcacaaatttggcccaaaaccgaccagttatcgcgctaccgcgggatgcctcagtaggaccttaggtcctaggttcgactccccatgggagcgaattttccagtatttaacggcattgtactttcagcggtagacgacataccggtcaacagcgaggcgtctgtggagacttcgtcaatttcaaggatgatttgccggcccagtcttcgaagatgctcataggggtaggatttgcacgcgtactttcatagggatgagtgtgcgtgcgttgtgagtgtctgcgttgtactgtgtaattctcaaaaaaaaaaatcatcctataactttcgacccgaaaacggacgtcaatttgacccaaaagtgcgtctaaagttatcccatttcacatccacggtaaatttaaagtttatacattaatgtgatttaaaatttaaattatttgaaatgtgtataaaataaattatctaaatattatcaaggtagtcatagatatatatcatgaatttatgttgctagaaatatccagcttataaaaaaatcctagatacatagctgtagcaaaagagatttagattttatctcgatttccgttagaatttttttcaattaataatttgtcaagtttgtaataacttaaacttaatcaattatgtgctaatgaatttctcgttttacgttacatctatttaatcttcatcttcatcttcattagtttcaaacaccaccttagagcaggtagaatattagattataagtcagctataaacacatatcgagtagataaaagaagagagagataagtagcgggctacagatttgtagccagctgcaacacagatttcacgacgcaatgtgcgtataacaggcgtgaccagatattaatagtgtaagatatacctttacatataactattgtatgaattgagggtgtgttcgcagttgctagttcccaactaggaacagtacgtgcggagaacagagtggtccattagcacgtgattaattaagtactactccctccatttcatattataagacttctagcattgcccacgttcatatagatgttaatgaatctatacatatatatatatgtttagattcatatatatgtctatatgaagtattagctaattttttttaaaaaaatggattaatttgattttttaagcaactttcgtatagaggatggaaaaggggcatccgaacactacagatgatttggagctggtaccagtaccggtcacacatggacgcggtgcacggactgtccgacccaaccccaaccccagcacgaatctcaacgcgacgcccccccgccccgacgcggcgaagcaaatcctcttcctcctcactagtagcatacccgtgctaacgctacggtgacaactaatattgcaaatgaaacaaccaaataacagcgacacaatatatgcttcatcaatggtacatagaacagatagttaggctaaaagagcgatagagttattagaaaaaaattaatcagcatgtatccacaataccatctaggaacaagccgtcccttgctatgctataaagtacaggtattgctcctctcaaatacacaaaataataaatatctaaaattagcttgacttaagccatccattccgcttgatgtggtcctgattatctggacaaggctacaaaacaaccaaaatgtatattatcactgtagttatttgtatttacacaaaaaagaatattggtcatttcataacttgaagataaacttctgtgataagcaaggtggactctcttggatgactaacgaatgaacctctgaactaaaattgacgctcatttaatacattcgtaatcaaagtcagttgatcggtgttttcatctatgtgtagaaataaacaacgggaaacagccgatatagctaaattttgcccaaaaaattacatgtcttgtcatttcacttacaattatatgcacatatatgactaaagtttctgcatttatattgtaatttatgaaccaatgaatcactaaatatggaggacttatgtggaatatgcaaataaacaaagagaaaccatttgtgtgcacgtggaacccgcgtcacaaggggtaaaattacaatgttgtatattttatacattttacatttttaaaatgtggttaatgatcaaactatcatgactctccaatgtctcaaatcaaagctgcagctatatatatacaaaacacattgtggtttgaggcacttttctgttgcactggaaaatatataccaatcaaagcagaatactgtaaaataagaagtaactctttctagtctataataaaaccttcacttttgaaacctactacagactcatacttgagtctagttgaaggttcaggcgttcagctatcttgaaaataaacaatctgaagtgagttcatcagatgctttttcactgtgccatacaacatatctcggagagctaaggggactgaaatataccttacatttcaaaaaatcaacatcttcagaagatatgttagcattggagttatcagtaaccatggagcactccacataaagcctagacttgtctgcgtttttatgtggaggtaatcaatccttgtctgatcagcgaaagaaattattaattaggccatgctgcagaaaatgatttaaagatgcttatgccaaacaggaaagcaaagatagcaagcagataaaattccatatactctaccttgaatatcaacatcactgccctttgaactggtcaaactctaatactgattgttcagtatatctcggtaatctataatagatgcaagggcacaaaactcggtaagagtgaaaaaggcattatattagttagcactaacctccaggctttccaatattgacaagattaacatagaagcatgaatatggtcttgtataacacgctttctttaatttgtcatattcctttttcatataaggatttttctatgacttgaggaagtaaataacaatacaattaattcttgaacatgcaaaacagtatgaagcaaaatacagtctacatatggaattttgcacattttatcatgaaaataatttctcactgtagtttatcttatcaaaagaagtaacacagagcatgagagatgcaccgctaattgtgcctcctgcaaggaagaaagttagtagagctaatcgtttgatagtagtgttagttccaaaggctactgcaagaaagagagaagcagattactcttatcttttagagaattttattactatgtatgtaattctatactaagtaattctgcaatatttttcatgcacaaatcctccttcacttcagtctctcatatactcaatcctgaaacaaggagggcaaagatggctacctccacaatcactctgaaagctttcaaaaatttgatgaagctactttgaaacttcagtctgaagacctgaaacaccaaaaacaattgatagtttgactccgaattgatttgtgaaactattctaaactcaattgcgtaaattactaaattggatcaaatacatgattggttacagggcattgagtaaaactactgaaacatttgcaaactcaaaattgtaatcataaaacctaaacagatgcataaaccattcagtaaagaacgcaaggcaagcttaattaacctttgcccgtgctgtcgcagtaatttgttgcatgcccagtattgatccagtccaaaccatttctccatgtactcatctaggcttgcatgctctgtggcaaccggaattcactaataaactggtaagttgttcctttagagtttagacaatacatcgaaagtgcttgcacattactaatgcacgacattttacatatttaggtgtcatgaataaaaatgtaaaccaaatttgactttttaaagggaaaaattgtcactgcatgcacaaatcagaactttccgtgtgtgtgcaagcatgccattcattaatatatgcaaagacaaacttaaacgacacaaggtaaactacagtatgaatacaagtggttcaatagagcacaattccagaattgaggtatataaccttcggtacacatcacagaataatgtatacaacggaaagtaaaagaagctctcaatattggcatcatgatttagataattaaattcttctttttaatttggatgtcaatttggatggtgatctctaaagagagcacacaacatgtgtatcaatttaattggtttcctgggctatgttgctgaccaagcaattaatgaagttcaaaagaaattatctgaattttcagatataaacatcccaataataacttaccttgttgcagtgcgaggccgatgccggggttgagaaatccgaccgcggggacttggaatgtcggactcacacacggccggaggaaggggctggtgccgggatcgaccgcgaaaatcgggcggcaacacttaggccagatcggagcaaggagggaggagcgccaaaaatcaaatggaagacatcaaacccaaaaatcggttgtgatctgtcgacgaatctggcttgtcggtccttactgatctgtctcttgattccaatccccatctctctaattctttttgttcgctctaattctttttgttcgtcctttgagcaatagggatttggtggagagtgcgttggtgacggccgcaagaggaatgcagtagggggaggaggagcgacggcgacgatgtgaaggcagtacggcgaggaggaggggatggaggcgccggagaggcagtgcgatgattagggtttgctcgggggagtacgtgggggaggcacgccggttgggcgaaggagggagcgagcgggcgaggcggcgaggggagcgggttttggggagagaacacgcacgcgggggaggaggagtgatctggaccgttagatgatcgggagatattctggtccgttggatttgatgaatgagtaacgtaggtgtaagagtgagttggtgaattatagggtagatagatagatagattagaagatcacacaacacaaacgactgactactcctaccgcgacggcttccaacttcccccaatttttttctcctctttttttttggaaaaagtacgaattacccccctgaacttgtgcggtcgatcgaattacacccgcgaacccgaaaaccagacattgttcaccccgaacttttaataccggacgaattaccccctcgatccaatccagaacgattttgtcctacgtggcgtacacgtggcaatccagcagcattttctttttttttaattgtgggacccacatgtcatacggattccctcatcctctctctcttcactctctctctctcacacagcgcggtggcaggaggtgggcggcggcgcgaccggcaacggcgggcgcgacaggcgcggttggcggcgag

SEQ ID NO: 51110 - DNA, 11008 bp, Oryza sativa
aatggatggcttaagtcaagctaattttagatatttattattttgtgtatttgagaggagcaatacctgtactttattatagcatagcaagggacggcttgttcttagatgatattgtggatgcatgttgattaatttttttctaataactctatcgctcttttcctaactatctgttctatgtaccattgatgaagcatatattgtgtcgctgtcatttggttgtttcatttgtaatattagttgtcaccgtagcgttagcacgggcatactcctagtgaggaggaagaggatttgcttcgccgcgtcaccgggggaggtgtcacgttgagattcctgctggggctggggttgggttgagattccccaggcgcccgcggcggcctcgatctgggcggcgcagatcagaggacggcgcggatcggcgagcttcgcactgggcacgtgtgcctgtgtgtgggagtcaggcctcgcagccgccgctgctgctgctgctgctgctgcacctgtcagctagggcgggcatggcgcgccgcgccgcttcccgcgctgttggctcggagggctcgatccaagggcgagggggccgcgcggggggcaatggcgccgaggacgcacgccacgtgttcgacgaattgcttcggcgtggcaagggcgccacgatctacggcttgaaccgcgccctcgacgacgtcgcgcgtcacagccccgcggccgccgtgtcccgctacaaccgcatggcccgagccggcgccgacgaggtaactcccaacttgtacacctacagcgttctcatcggttgctgctgccgggcgggccgcttggacctcggtttcgcggccttgggcaatgtcattaagaagggatttagagtggaagccatcaccttcactcctctgctcaagggcctctgtgccgacaagaggacgagcgacgcaatggacatagtgctctgcagaatgacccagctcggctgcataccaaatgtcttctcctgcaccattcttctcaagggtctgtgtgatgagaacagaagccaagaagctctcgagctgctccaaatgatgcctgatgatggaggtgactgcccacctgatgtggtgttgtacaacaccgtcatcaatggcttcttcaaagagggggatccggacaaagcttacgctacataccatgaaatgtttgaccaggggattttgccagatgttgtgacttacagctctattatcgctgccttatgcaaggctcaagctatggacaaggccatggaggtacttaacaccatggttaagaatggtgtcatgcctaattgcaggacatataatagtattgtgcacggatattgctcttcagggcagttgacagaggctattggatttctcaaaatgatgtgcagtgatggtgtcgaaccagatgttgttacttgtaacttgctgatggattatctttgcaagaacagaagatgcacggaagctagaaagattttcaattctatgaccaagtgtggcctaaagcctgatattactacctattgtaccctgcttcaggggtatgctaccaaaggagcccttgttgagatgcatgatctcctggatttgatggtatggaacggtatccaacctaatcatcatgtattcaacattctaatatgtgcatacgctaaacaagaaaaagtagatgaggcgatgcttgtattcagcaaaatgaggcagcaaggattgagtccgaatgcagtgaactacagaacagtcatagatgtactctgcaagctaggcagagtatacgatgcagtgcttaccttaaagcagatgatcaatgaaggactaacccctgacatcattgtatatacccccctaattcatggtttttgtacctgtgacaaatgggagaaggctgaggagttaattttttaaatgttggatcaaggcatctgtccagacaccattttctttagtagaataatttataatttttgcaaagaagggagagttatagaatctgaaaaactctttgacttgatggcacatactggtgttaagcctgatgtcattacatacaatgcactcatcagtggatattgcctagccggtgttgacgtaaaacacgaggcctgggagatctgcttaactccagtgcaggtccaaaactcgccttcgggtatgcttagcgtgccaattgatttgatcctgcaatcaacaagaaacaaagacaaagaaaccgcggttaaatccataaacgatagacgatcggctaggtgccgatgacatatcatttatctttgagccgatgtcatatgtgcatcgatcggcagtcattaataaataagaagggactaaatctattcgatcggctgtagatattaacaatatatagtccttatatcgatatatacttaaatcaagtgattgggatagatcggactccatgccgagacagtatgaatcacttagatcgaaatatatattaataatgagattatatacgttcatagcatagccgatcagatggatctagcatgtatcggttgatactccgatactactctatattaagatattaaagcaagtagaatatactaaacaaaagcctaatatacttaaatgcagcaatatcttaatataaagggcagatttaacatgtcaatcgagcatataggataaaagtagttaaatcaggtaagatcggctgaaaccccgatactaccctaatcggcaaccaaagacagactagagattgagattctaattacgactcataagatcaaactcaactgatgcagctataagtatgaaaagaaggataatatctagacaatcaagccgttggatatgtcatagagtggtggatatcctatataatctaagtcaacgtcggtatttaacctaatcggctgccttctagtaacagacgttagccgattagaggttagataacgatattgccaaagattatgtaagatatatgataactcgacgaattacataaacaagattagagtgtcataaagatggaagcactaatcccgagaacgcaagccgccataacaagttttacctcttgttaaagatcgaaaccgatgcagctcaacccgaaagcaagaactcgtcgaaataaaactaaagcaaaaaagggtggcgatgcgctgagattgttattgaacgtgtgttatcgattacatagggttcgggtctatttatacccgagaattacaagatatgtccataccggacacgactcttatccctaacaaactctaagataccataagtctttgcggcagacttttgcccaagcatatctctaaggaaattatataaaatatcctaattaatagatacaattaccttcccaggactctatccatgcacggcaatcatcgtgaagcatatcaactcaacccgatgttgtacaccaagtcatattgtcggaatcggctgtatcggcttacccagtctgactcggacccagctgatcctgatcgtagccgattcggactccagccgatttttgctcggttctcgaatcgatctccgcctccgtctccacttcaacctaatccccttttccgatactgatattaccaaattttgtcgttaacagccggtaagatggatgaagcaatgaaattactccctggcatggtctcagttggggtggaacctaattgtgttacttaccacagtttgattaatggatattgtaaaggtagtaggatggaggacgcgttggttcttttcatagagatggtgagcaatggtgttattcctgatattatcacgtacaacacaattctgcatggtttgtttcagacagggagaatagctgctgcgaaagagctctacgtcaggattgttaaaagaggaatagagactgaacttagcacgtgcaacataatccgtcaaggactttgcaaaaacaatctcactgatgatgcacttcgcttgtttcagtagctatgtttgttggagttgcagcttgaaactaggacctttaacattacgattggtgcgttgcttgaagttggcagaaaggatgaagccaaggatttgtttgcttctctctcagctaatggtttagtgccagatgattggatgtacaagtaaatggaagtgttatagaacaggggttgctaggaaaaatggataaatgctacagttaggaagctacttcacaaagggcaggtaggcagggctggggtttacctatcctaaagtgatcatattggtcttttattgattatgttgatattgtgtgtttacactacttcaagtctcagccctatattatgataggttaggggtctttttttggtattgtattatcttgctgataatcatgtcggtgacttctgtttacgtttaaaatctcatgctttaaattatgattgttctacatatggtcctactctgcatactaggaaatataaaatattcatgtttttatatttgaatttagtcttcttgcgggcagttctctttcttccttttcacggaactatctcctgatgaagtgcaaccctgattatttttactgcattttgctggcaattaaattagtttacaagggcttgtccatttatcttctcagtagatgtgatgtgcagaaaacatgacagcatcttttgtttgcctctataggccaatgttttttggtgcatggtctttgacctacagattatagctgtaaatcttatatagaagggttgttgcaatgattctgattaactgattgtatctatgaagttgaatgctagtggaagctcctttggccatgttatattttgtgtctgcaaagaacagatcatttctttctttttaaaaaaattgtgttaaatgcactgttgaagaatgcctaacaatttctctcggcagagagtgaagggaatgtttatttggtactgttctagatctacagataaaattcttattctactgtttctttgcttgaaattttcatgcagtggatatccagttgacctgttgcattgatggagaaaggaatcaatcagctctgaattgcctgtaacttctgcagttcctgtgtgaagtgatctatgtatgtccgcggtttgagaagacgcatcatgttctttccgtgtggaaggtttgccacagcgacgagatctggatgtatatgatttcagaacacttatgttagttgttttgagttttctagctcaatttgatgcatcgttttggtctgctcccttgtacatcgatgcagagcagaagaagcggcctgaagacttcttttttttttttaagactttgaagcggcttgaagactgatttccctgaaagcactgggaatgacagattgattcggtgcattgcacttgaccttttctctttcaatttactgctggtgattgttgtcactatttaacttgtactcctgatgttctagaccatttatattatgtatgtgtttatttatagatgatgtaaatatcagcgcaaatggggcatgtgatttacttatatttggggactggggtagtattcagcgttgaaccagctgctagcgtactcgttgtcagagaatcaatacaggttcagtttgatgggaaaatgagtttccctgataatgctaagtaattgttatggcataatcactcagttgggggcttgcagcctctgtccaactgcataagcttccagttccaccgcttcactgctaatagcattttgggctgcgctccgttaccactttcgaccttaccaaattttaatagggtctccaactaaatttgtactttcaacatctttaccctaccaaaatttagatgttccggaagtttcctctcagaaacactaccagatttcagagagattccaaattaactagcatattcaatgccaccaacattgggtaacaccaagatttggtattgcccaatgttggtaaggttgatgttggaaataaagtgaacaaaccctttttattttactactgtcaccgttttgagcttcctgttaaacccatgtcttctttctttttttactccagtctgatccatgaaggactacaagtaatcaagtcacaagtctgaatccatgaacaaaaggagagacaacattgggcagtacagcttttgccgctaaaatcaactagatagtcgataaacacaatatgaaagttatgccgctcactacagttaggtggcatctatgtaccgttctagcaactatggcaaccgatccgcaattttctgcagttgaactgaagaacaaactcagctgtgcagtgacccccctgttgcgaatgtcctccagcttactaaaaataatgggccatgcgagaggactggggcgcctgcctgctgttgctgcttgcgccgatgaagccttgcagaaggctctgtgcggctttcacttgatccggaatgccctggatctccacaatggactcggaagaaccgggatgggcttcgtgcaacttcactctcgcgccagagatctgggatcaaggggagattttcatgaggaaaactattggaggccattggggcatggttaagactgggcatagtgcgtgatgtttcgcatacgctatacctgacggatctcagctagattgacaccaccagctccaatgacagattccagataactatttggaatccgaaattcgacggagccacctggatacctgcaaagagatcatcactcaatgattatgaggacaaaattcacgtttgtgtcctgtaaaaattcagtttgcataagccatacccagtgagacctgacagtcttcggtaatcctcacgtccatggatctgctcagcggcctgaaaagaatgaaattcaaatctattaagcactgaagagaacaaaaatatacattcagatgcatcagagaggcatcaggtgaaccaggaaacaaggaaataaaaaatgagaaaagatcaacacccaactaagaaaactggtaagcaacagcagcagagaacagctgaataactgaatctagggtttgcaacaacatcgtaacaattgaatagtgttaccaatgatagatattagagtgggcacaagacagaaggatatatttggatcaccatgacatattctagaatattttggtccttttttcagacatctgaaccatcatggaagaaaatagacataatgcaacagtcatatatatggtttcatgtttctaatggaaacatatcaggcgagggccatttgcaaagaagaggcaagctaacgcattggaaatgtacctcggtataatcataagcattggaatttccagctctggtgattcctaattgttgcacattactattcccagctctcgagaggcctaattgtagtgtacccctactagagtacctatcagtaggtacttggtcaagataagaacggcgggacatataatcggcaccaggactaatagatgagggcagttctctattaggcaagcgagtagttgctgcatatctgtcgtatgaagcagatggtgtaactttgctatttccactagggtactctcttttagagaagtactctacaggatacgcagtgtaaggatcacgaggcccatcattgttcaaccctccatatgatgtatcattggcaggtcttctatatggtggatcaatggctggtcttccatatggtggatcaatggcaggtcttccatatggtggatcaatggcaggtcttccatatggtggatcattaggaggccctccatatgggggactattggcagatcgtccatatagcatgaattccctgttaggcaagatatcaacaggaggaccatcaaaaggggcaaaaggtgtcggattattggaagaacttccatctctgagtgtcctagttctaagcctcgaagcaatctctgtcagggctcctcttgcaatagctggaagcccagcaacctgaaagcttggaacaaatgtaaaagcacaatgaaatgttaacaagtaaaaactgtagttataaaggtaatatatggatctctggtgtaggtatggccaaataaattacctgcacaagctcctcatcaaaagacaagtacttaggtttatctgcttttgagtagactcggatttcagccccagtccgtcttctcatttcagtaattacctttccaccttccccaataatacaaccaactttgtttgatggtacaacaagccgtgtcgtcaagtggtgattctcagcaagtgtacttactttactatggagcaaaataagcgcctcaattgttggagacactggatcatctggaatctggaaagaaaatgtaggaggatataatattgtaaagactcatgataaaaatggtaaggcaatgccaattggaataatcatctgcatattacctcctgagatgaaacaacaattaacctttcttcagaagcatttttgccaacttctttaacctgaacgcaagcacctgtctgctgttcgacttgccgaacattgccaccacttttcccaataacttgaccaatgtgttcagaagcacacagaattttaatagagaactcttcagcttcagcagaatgatactgcagtggcctgtttctatatggatcaagcaagggtatttgtggtgagtgatccacatgcaggtgtggcaacattggatttgcatgtggtaattgtggtggagcctgatgcttcctttgtgtgcttgcatctataatttcttccagaggtggattgtctttacgaggatgttgatgcagacgagtagatatttcatagagagcttttcttacaagggaagaagatccagatatctgaaataacataagcccaagtgacagtgatttccaaaaacaacaaattgacaaagcaatcatacttccattgatgcacatcatggtattacattgcaattttgcaacatgaaattacatatcattaagaaaaaaaggcatattgataaaaagttaagagaggtaaaaactccatgccagatcaaaaagttccattacttagttcattcaagagcttaacagggcatattgacaagaaactcagatagtagtacaaggattgatatatgccatactgagtgatttgtttttcacgagtaacgaatgaacacaaaccaagttaactgataccattactcaaggacattggtatgaatgaaactacggatacaaaacaagttggaacaaaagataacaaataagttttttgaagttacctgcaccaattcatcacttttaagtgcacactgaggaagattttcagatggtaagacacggatccctgctccagtgtcatttcgtagctgttgtataatggagccaccttttcctagaagacagccaacttgatttcctggaaccaaaattcgagcaattacatcatcaacattttcagacttttcatgaacaattccagcatggagatcttcatctgctgcaattttgtcatgtatcttcaacagggcatcttgggcaaaacaatgaggcttcatgtcctcaaatccatcagtagaaatattttgagcagcttcttcagtctgacttgagtagttaaagataataattactctctcatctgcaccaggaatggaatcagcgacccttatctttgctttagttgtgtctcttagtgccttaacaatatcaccgcctcttcccaagacactgccaatctttttaaccggacacagtatcctgtaaatggtttctattggctcagaagatatggttccatcatcgtgccttgagtttagccgtttcctctttccgtcatcagaattgaaatgtggcctttttctggaagtatttgatttatgccttctagatctatcatgatccatcagtaacctttgcctgcataaggaaaagtccatcaacataaatgagaattagacataatgtaggacacaggcaacacacaaataatggacatggcgcacgatagaagtatgagaaatgttccatgatggcaacatgcatgaccttgtaacttttgcataactcaacatggaaaaaagttgccattaaatgcttatgtggatactttgggcctatggaattactcgtagctgtttgcaggaacaataataacaggcaaaggctatacatctaaactttaaagtcacctcactgaacacacgccacagtaactaaatatataccttgtcatattttctaaagatgtatctatacagtgcttccacagttccacctattgtattccttcaaacaaacatttaccactatctagtttagtctcactgtggcatgatcttaattgatccaagaaaggtagtgaattttataacgcacggctcaagatccaagtatcaatatttgtaagtactcgagtcgtgcaaactcacagtaggttttttaaaggcaaaatgctgatatcaggccagcgtgtccaaaaaggaataccatggcagattaatgcgcagttgcacattattggagtaaacagattaagaaaatgacaagcaacagacacaaagggcatcctgtcattaaatgaatttaatggagatgttccactaaagcatttcacagaaagtaaaataaaaggactatgtataatggcgccaaacatcctttcgtagagatctacaggtggctgctaggcaactggacaggtaggacttgaatttataataacagggtcagcatacaaatcattagtcacatgtatagagcatcacattagaagcaaaagtcatcctaacgtacgtgacgtgcagcaactccataaatggaaagaaatgacaaaataattacactccatcaaggcatcaggccatcgcctggtcaataacggcaataactagctcctgaataagctactgaatgcagaacatgagatgccaaattgatgactgtacacttgccgccttgttgctgccctactaatacgtaatcaaataaagtgtcatgggcagtgggccgagaggtcgaggccttccctcgtcttacggtagctcagttggttggataggattaggttgggtccttccctccatctatataaggatgaatccagggggggag

SEQ ID NO: 51111 - DNA, 12938 bp, Oryza sativa
  unsure (1)..(12938): unsure at all n locations
taacattcttttctttgctttgggactcagcacggtcacatatacggacgactccaaaacgtaaactaattctagcttcataaagactctcacttttgttccataaatgcaattatattttctatagaactatattgatcaatataaacagttacgatctagtcctacacaccgatctaacgatcaatatttttctctcttgatcaatgtggtaactttcatgtatatatctatacccctgtacattctctttctttttcccgttactctttcttttctgctttcctttatgtacctccctctctgtctctcttctctctaaccttaaacttgtaacctataaacctcatttctatcaatgaaatgactataaggtagagccttcttgcgtcaaaaaaatgtggtaactttaagcctccggagcaaacaatgtgtgcctctttttcttgatcccataacatgatcgattgcatatatattcttccctggcttttagtctcatttctcatcctaaataaaatacagaaaaactcacttagtgatcatcaagtaagaaaaatcccatcaggctgcaacgttgagatgtcattcataccttcatcatggcctacgcctaatctccttcggcttgtaactcattcaacatagtatctaggaatttatcgaatgtatcccttcttagccacatgttagtctcctcctcctcttcttcctcttcctcttcctcttcttcctcttcctcctcttcctccgattccacatcatccacttcaaacaaccccaactcctcctccgattcatcctccgattcctcctatacaattgaggaaagcagctcatgcaattagcaacaaagcagcaaaaagtgttactacctccgtttttagatatatggcattgttagctttgatacatgatgttcgaccgatcatcttatattctgaataagatgattgctcaaacattatgtccaagtcagcggcatcatatattattttaaaatggagtaaatgctagtcctgaaagtgaatgtccgtacatcctcggagctgcttgtcagtaccaaacgatatcgctctacatccaagtgaccaccagcgtatgcattagtattttgggggtgcttcataggaggagtccccttgtttctgcaaccataacagtgaccccctttacagagaaaaaaatgcatttgtcaagtaactgccaaatcaccaaccatgcacaagcagatgtacatccgagtaattgaaggaaacgaaaaacgacatatgcaaccaatatagaggcctgtacatgaaacagtttaagatattgtacaagcatgtatgacatgaactactgtaacgtaacataatgggaaagcaaaactgccaaattagtgtaataggaattgcggatgatgttctatattcagcagaaaaagttttgaaaatatatctaacagaagagttggcgcttcagcagccatgcaagaacagatgttaacacatagtcacaaagttctcaggttgatgaggtcgaggaatttgtacgctacttgctagaggtttttacactaccgcaagggtcatgaatgacactgtactcgaacataacggcaaataaactgacttcagtttaataaataattggaaatcatatcctacattcagcagcaaatatacaaatgctatcgtaaaaatatacattcaatgggtctaatgaattgagttccaacagtgtgtaatgcaatatatagagcataggtgctaagcaaaaggcagaatgcaacatatgaattcagtatagtctacagagtagataaacaaatattcctcaatccagatttatgtttgaggtaaactgtaagtgtaccaataaccactacaatgtgaatttagaagatagtttaagagaaaagtatgaataccattaacttcagtgtcaatcttgcagaaacagctgaccttccaggccattcttctttgcacatgtgtcacttcagcaaagaatagtttgccactgctatcgtcagctcccttttgttttgctgtgaaattgaaatgacaataccacatacaattctcacaaaataattgcctactcacaagatcttcaagttcatatgcatgattctacaacaataacattaccaaaaattgcatcagagagagagagagagagagagggggggggagtataccccaaaaagtttgttgtcatcattatactggtccaatatagcttgaaccaagtattgcttttcatcataggtagtcttgctactcggagaactgggatctctctttggtggaccataaagatagtgtttacaatcatgtatcatcctatccacacgagaaaattcacctgattgtgtgcacctaattcagatcagagcacgccacactattagtacttcagtggagaattcaaagtggggaatatagaagtgacactaagttgtctaaatggttataggtccaatgtagggttaggaagagtttgtgtagaaagttactgagcaaggatgaaactcccaggtacctatgttatcactgattgagtaataaaaaagtgtccttgaaattataacaagataagagaattgaacatgtacaatctccatgcctataagttatcaatcaggctaattgatacggttatcgcaattatttgatacagcagacaacagaactgtgtggtttgtaatcaacttacattacaattcagattaaaacataccttaaacaaagcatagtatagtatatatttactttgtggacttactgtcatgcctatgggttacgattagtactccctggcaaaaataataacagaggatagtttcgctaacttcatcattgtcataataggaccacatattatagatgcaacctggtttttttttttatcaactcttaggctttctattactccaaagttaagtatatttgctgcgttcttaactaatttgatgaaacaaaattaagactgtaaagcaatacctttatatgaagagtaatacatgagcaccatgagtagaaacaatgcatgcaaactacctagtcaagttaaagtacactgaccaaacaccgttgcttactgtggagaattaaatgaatgagctacaacaaattcaagaagaaactttaccttgctccatgctgcagttcatcaagaaagcacttgatagcatcgtcagcttcatctactctctgaaacggtccacccacatcagggtaagtccagcaagagcccctggggtctattctaatgtagaacagctggtagcaatttacaaaactgcggaccaaaatgctagacccaacagatgaggaagctgattgcagatagccatcagtggtggtgttatctggcgccgttcgtggattatcatcgaaaatttcgtccaagagcgaaagggccacatcttgcagagatgtggacagtgtagcatctgccacaggcttgtcaattctggatgggcaagtgctagatgagccatcatcaatgatgttatgactggcagtaatcaaatcttgtgatgatgtggtgtcaaaagactcccccaaggatgaaacatctggctcttgtaagggtactagaggtgcagactgagcagcacctgccacaagcttgtcagatctgaatggagaaaagcacagtgagtacatagtatatcctacaaaaaattcacatccaagaacaatcgatcactgagcaatgcctaagtaaggccgagtttagttctaaatttttattcaaacttccaacttttccatcacatcaaaactttcctacacacacaaacttgtaacttttccgtcacatcgttccaatttcaaccaaacttccaattttggcgttaactaaaacaccctaagctgagtaagaaatctgtaatgaactggtagcacaaattcgatagaaatccatactgatcccccagttttatttattttatgtcccttatctcctgctgctgctaatactagaaaacaagcctttatagcaagtaccaatccccatcacctccaacgaatgaatacccaaatattgccgagctaccaatcccaattccctcccaaggaatgaattaccaataccgagcgtttatcagaccaattcgtaacctacttttttacaaaatgggataatcccggcctctacatccaatcgcaacctaatactagatcgaccaatttgtaaggcctaattggatcggtcgcaaacagaaaaaaaaaaaagaaaagcgagaggattcatacgatgatgaaggcgaaggcgaaggcggaggcggagggaccatcgccggcttggttagggtttggcgagggttcgcactcgggaccgatgattatgttgggggatttttggttcgtgcgcgggacggagacggatttaccggttttgcgtgcggcggctgggttgaagacggagaggagcgttcttttattttattttatttgcttttcttttctctttgtgaggactttcgaattttttttcatttttaatttttaattttttaatatttacagaaatattataccatccaaaatatttacacaaatggccccttccacccaagtggagagcgataaaggtgtgcgcattttgcattgaggtcattttgcaagagggtaaatacaattttcgccttaccaaaaatatatttttctagtttttttttttcaaattatccggccctcaactcaccctgccgccctaaatattttcaccgtacaatatttctataaatattaaaaaataaaaatttaaagatgaaaaaaattcaggactttccgaatcgtttgtgggccgagaccagagaaacagagcaggctataagtctatttgccctcccccatctcttgctctgattgaatcacctcactcaagtactcgtactcaaccaaaaatcggggttataagtcgtaacacctcccccatgtttaagaaccggtgcaaatcgaaccctttcagtggtttgggaagcagttttttttgttgacgtgaggtgggattcacatgtcagtgactcttctatctattctctctcaaggtagaaggagggttcctgaggcgaagggaggcgatgagaatcattgacaacactataatttttagttgaaataactatagagtaaaattcacaaaactacacatatgttgatcaaattgtcacaaaactacagatttaatgcgttgtatcataaaactacagatttaacatcaaatttataaaaaaactataaatttaaggtcaaatattacacaactacatatttaatattaaagttattacaaaactatatattttagagttcaaaccctaacactaccattatgttagagttacaaacattatagttttgtgattaaattggtactatacctgtagttttgacatatatttgctacttaacctatagttttgtgacttttcatatcttaaatattccaattttgtgacaattttgacactgaatatgtagttttatgatacaacactttaaatttatagttttatgatattttattcaaaatatttgtagtattgtgaaatgtactcatatctataccatgttaaagaaaggtccgagggtccgagggtctagcttcgagtctcatcccttaataaatttcaatacaagagtcatacccaatgttttgtttaatatctatatcgtttaaatttcaccataaataacctagttgaatttctttacatgggagcaatcaaaggtgatcttgtatgtatagatggccaaatgagccgtctggtccaggcacgactagatacaggcctaagatcaatctggccggcacgggctcacttacacgctgggccgttggtgccaaaaccccatgtcatggaccagatcatcggccccagaccatttggccatctatacttatctgggagcggctgctttttcacgagaaaaagaaaaatgaaaaactgctgaaatacaaggtgaaaactgaaagaaaagagaagaggatggatggaaggcgagcaaagcaaagaagctgttagtgggcttccttcttcgtcctcctacattccctcttcttccctttccccctccattagtactaagtactaactctagtttctctctctagttagttagtttggtagaaaattaggtaggcttttagcatcaggttggtagaaattcgaatccctctgcgtggacacgtagcggggagaggaaaaaaatcgaagcttttcatgactgcagccatcgccgcagatggccaccaagcgcgcgtacaagctccgtatcctcgattcttcttgccgcttgaatcctcggtttgggagttttagattaaatttgagttctttttttgggtcgagttgttcttgccctgcctgcttatcgttgtatgtaatctaggtttctgatcgagttggggggagtccgcgtgtggtgatcggtttcgatctgcgctcatgttattttctttgtgctgttcttggtttgatgattgggtttatcgcggtacgctgctgggattgatttggtacgaattccaatgagatgagacgatttgagaccatgtgaactctactgttcagctctagcagatcttccttttgtatgcgtgtgcaagtattatgtagttctctgcttaaagccagactaaattttgctgttttttttttttgccggaatgaccgaaggaggtcattcaatgtaattaagacggaagaaaagattacaagaaaagttttacatcgacagttggctgtcgagaaaggatgtgcaccagagcacacgccccgaaccatgtgccaaccgcctaaacacacgctacagagagggaagtccgttacccaatccgaatccaccatctgaacatcggcggcacatggcttccgccacacccgaactgacgcccctccgtcggccgacttcatcgaaccaccatccctgagagctgacccaggacccctccgttcaaccacccaccggcctcctcgccagatctggccgaaggagaacctgggactaggtggcattgcttcagcagcctgagcttcccccactgacaagctgccgcctcaatccagcttagaaactccccacaaagaaggggaggagctctaggaagggcgagggtgccgatcgacaacgaggaaaacgaccaaccgccgccaactccctttcattgccatctgggcctgcaccaatgccagaaacgctgccgctccggctccggtgccacccgccggcgccccctttgtccggcctccttgccccacctagccgtgccgcgccgctactggccgctaagggcaccgcggcagcccagctgcccgaccgtcgaggcctagccacgccatagggcccggcggcagcgaaggcagagtcgagggcggggtagccggcagggtgttgaccagcttccgccgccggtcccaaccgccgccgccgccgccgcacggttcggccgcacgccgccgccatgcacctcgacggcatccgcatccgcgtccaggccggcaccgccgccacgcaaccggagccgccaccgccgccgagctgccaccgtcgccgagccgcgacagcgccgccgaggcgccaccgccgcccctagccgcctcgcgccgagattcaggcgaggatggccggatccggacttggggactccggatccgccgcctccccgcaccgccccaacatcgacgtcgccaactccgaccgcggtgggggtcttcgtttgttttagttcgagagaataaagactattattagtgaagttttatttcaaaaataaatattagttagagcattgagttgtcatcttacaaaaattgactcctgtattatcttctgcttggatagtttctgctgcaaataggatcacactagggtcagatgctgacacttaccatgagaaaaaattggatggatgaattaatcaatacaaaatcttcaaatatttattatgtgtagctcttttctttaagaatttagatggtgagatatcatggataatacattcactgaaatgaacatggtttaacccgaaaagcattgttatgtcagtaaattgcgttaccttgttgaaatgtatattttgaaatacccttccaaaaaagtgattttctgaagcaacactgaaaattgcccaaatgccaaatggtaatctacaacagccaaccatgtttccttgacaatggccagaggagtttgttgcgcatgcttccgatgtcaactgtgtcaagtttgggaggaagacatcaagaatcctcatcactggtggggaggaccaaaaggtcaatctttgggccatagggaaacccagttccatcttggtaatattccactggcctctgaaaggtcaatcgttcatgtgtaatacttcttttttttcttccttgtctttgttactcagttttatggggtctttattagtcagtttgaaagttacatctcttcttacaagttaatgtcactatgaattgcagagcctgtcaggccttacgagtccagttgagtcagtgagctttgactcatctgaagctatgataggtgctggagcatcaagtgggacaataaagatatgggatgtagatgaagcaaaaggtacgaactaatatggataacaatttgctgcattattcatttaaagaaacacttcgctgcatttaaaccgaagtataaactgtagttgtatcacacaactataactttgttaatttttttttgctcagtcgttcgtacttttactggacatagatcgagttgtgcgtcccttgatttccatccttttggagaattcttcgcttctgggtcttcagacactaacatgaaaatatgggatatgcggaaaaagggatgcattcacacatataaaggtcacacacggcggattgatgtgcttagattcactcctgatggccggtggattgtctctggtggatctgataactctgtaaaggtacaattctgaatatgtctattaatacaaggcaaacacaatcacagcactggaaaagaaataacatgctatgctgattattcgaaccattaagctgtcatatgtatctctcgggtcactgaaattgttttctgatcatcttgctagatctgggatttgacagctggaaagctcttgcatgactttaggaatcatgaaggcccaattaactgcttagattttcacccccatgagttcttattggctacaggttagatagatgatcctttattataacacttgtagtagatgcattcactgtagtgtactagctggcagtttgatgacatgttttcctccaaaattatgctattatgaatattattatttctggcatggatcattgttgactgatgcttatttgtgtcatctagacttgacaggctatacatngctttctttgtttcaaaaatatttgcaggttcagctgataagacagttaagttttgggaccttgaaacttttgagttgattggttcttttggacctgaggtattgaatatataattggtgtatatcttaaagcaattcaagttaatgttcagagtttgagccaatttagatctataaataccatcgctatgtagcgctctgtcatactatctcctatatatgagggtctcatgtaagtgttagatacatgtcatcatgttcttggcttcaaagagattcaattaaaaccaagttccagtaatctatttaagtttatggtaattctgcctaaacctggtcctttaaaaggggataaaagaacacagcaagtcaacattaagcagtacttctgtgcatatttggagtcactaaatggtaagatatcaatctgaccagtgattcaggcatccagcatgtcaaaccaaatgatataatcatacctgaaattctctctctgcaaatagctttcaagagcttatataatttaatattcatttatgcaaaacgatatgtcagttcaagtttttacccacgttccttaatttgtacctttggaccctaatgttttgtcagttagataatacatacccatccttaaagaaaagattgattgtaccttgagctataccatgagttatttcaatctccgctccttatcttcttgtttcgtggatgtaactaatatattctgtttcttgcagaatagccgggaatactttgtgccagtacgttgatccttaatccattctatctatatttttctactcaaatggatggcagtgctttctgtctacaaagttctcgatgtaaatgaaataatcaatacttatcttatctgcatgtactcttaattttcaggctagtgtagttcggtctatgacattcaacaaagatggtaaatcacttttttgcggattacatgaaagtttgaaggtaactgctctgttggactgtcgatatcctctgaagctttggaaaatgacctcacaacagattttatttatttattttttttacctgtaggttctttcctgggaacccatcatatgccatgatgtggttgatgttggctggtccacattaggggatctaattgttcatgagggaaaacttcttggttgctcatataaccaaagttgtgctggaatatgggtcgtggacttgatggtatggttctacactatttactttgttaccaattgggcagttctgatatgttacttatcccaaatttcagaaaattgaaccgtatgctgttagcattgctgaagcacatttgaatgaaagcgtaaataggtcaatacaggctgataatagcatatcatcagtgttgggaaggttatcagtttccagaagcccaggtaaacaattatcatttggcgtataacatcaatataatttttcttcatccattatccttgagttatgattcttcaccctaaaactatgtatattttgctatttctcgaaaccgcagccaaggaagcatcttccgatactttgcttaaactctcaatgtctgcttcaaaagaagttcctgttccagcttcttctgcagtgacaaagaaactaccaaaagaacctataacaagcaatattcggctcacaagatctgattctctaccagttgtttctcctagggttagattgaacccaaagttctctgatgaccagaagaggcagacagattatgctgtgcctataacaactccaagaattcgctccaaagtggatctctctataggtgctagagcattccatcgtaactcagtaccatcggttgctcccacaaatagatccaggtccaaaatatctgcatatagtagtgaaggatcgtcgttcatccctgttgttgtccctaggcatatccctaaagtggattctggtcccaatctcagtaaagttctcactactgatttaacaattgtcgagcctcaagacatagaacgaggtggtctggctgtggattgtggagaagatgataaattggtgtgtgtgattgattcaaggagctcaaatatgggtgtacaaaatggccgtagaagaaaagccggtgatattattacacataaagaaaccccagagactgctttgacagttaatatggatcgtgacttcagaagaaaggctcctgaaactgaaagtatgcaacaggacatatttcattcagagcccattagttcaaaatgtaaatatattaaagaaacttcaggtgctggagacattaacttgtgtgcgtcagccattactgcaagtgtcaagtctaatgaaggtggttactggtataaggcatcatctattgtataaccagatttgtctgttgcaagagatccagaggcttcatacatcagcagaagtgcaatgtttggattgagacattcgtcggattcaagtgaagaacacgctgttgaacatggtaagtgttcaaaccgatatgttattatttctctttgtttcccttcaacttaccttgctctttgttgggaggacagggccttccaatttgtctgaagttatgagagaaatcagtatgcaccaacactacataacttggtatgcatactccaaatttccagattatgtcattcacgatgtatttattcttatgttggtaccaaatccatgttatgccctaccttattgtttctgcagaggaggcgctcttcggttgctagagaacagagtgcatcagctggtgatgaagatgatattgctgatctgatggaaaaccatcaagaattcattcatgcagtgaagtctcggctaacaaaactagaggttataacgagtatggtcatctatagcatctgctattttgagatacctcgagtaacggtaatctcaatgtgttatgtgtaggtggtttacaggtgttggcacaataacgatgtaaagggatctattgatgctacacgcaggattcaggatcttgatgtgtgtacttcttaattaccatcctgttctgttgaagttccatccattataatgtctgatgagttctaccacttttacaggttaccgccgatataattagtgttctgatggagaatgataattctatcacactagatatttgtacttgtgtcttacctcttgcctccagtgttcttgaaaaaagcagctatgacaggtacttttccttgaatatattcttgtagcatttctcttagtaagtatgcattgacatctcctattgcaggcacctgaaagttgccttggagatgatccttaagcttgtgaaaagctttggttctacaatatcttcagctgtgtcatctactccaccagttggtgtagacattgaggcagaacagaggtaacctttcttgcctctcattttcattgcatctaaatacattgctgaggcttcatgtacattacaatggttcaattcacacatgtgaatttgttgctactttgctaggctcaatcggtgcaatttgtgctttctagagctgataaaagttcacagcgttctctttgccctgacacggtaaattcttggtttagcttcaaaaagg

SEQ ID NO: 51112 - DNA, 1106 bp, Oryza sativa
agatctgcacaggagctaagcctctttcttcaggatatctttcagctgacaagcagatagatgatatgatagccatacggcgatatttcgcccaaatactcatcttttttccttggaacagatagacagctatagagaaagatatagataggaaacatacaggtcatccttggcaaatgtacagcaaattcttgtaccatccggtttgcaatcaaatactagtcaacaaaaattcaaaaatctctgcaagttcagagttatataattacagggcaacagtactgcaacaaagcaggtaccaaatatagtttttcttttcccatcagtcgtcagatattgctccttaccaccttgcgagcactatttagttgattgtaagtgtaatgagctattagagagagagagagagagagagagagaagtccactgctgctatagcatctccaggaaatgggaaatgagataaagtccaaaaacgttttaataggttaatgaattctgacgtttcaacatgtaaagattacaccaactgtacaatggcattaaatcatccagagtaacaatcacacaaacatcatgaaaacttcgatctcaataggaatttcattagggatatgatcgttcatggcacaacacatttctcatcagcaacgcagaatgatgagaccaccgttttctcgataagtacaatccaattttgacagcaacaattaaattaccgtacataaataatcatcaagttctgctaaaagtttgctgtccagctgaagggggctgtgtagggggaggtgggggaagtgacatctgcatttgcatcggcatgggcatctgcgctagaacaccccggtcaccttggccagaaagatccctacctggtatgcctgaattcattgagccatcaggcatgactccgaaaccaccttgcaggaaaaccattccgccacctccctgaggttcacctgcaccttcaggcattccctgtccaagtggcatcgactgaaatgggttgcccatcaatcccatgccccatggacgctaagcccctcagggaagcttaaaggaccaggtggcgtaggttggacccccgaggctgagccttgatccag

SEQ ID NO: 51113 - DNA, 923 bp, Oryza sativa
tcttggttgaaaatgttattattttttctacaaacttagttaaacttaaagcagtttgactctgagcaaagtcaaaacatcttataacctgaaacggagggagtatatcttatgatctactcagttgaaactcattttggtagaaaacttaacaactgaaggaaattaacacatcaatcaggaattctcagagatcatacgagaaacttcattccatacagaaagatcactttgttactgcatgttatcctactgagaataagtcaataaactaacaagatcaagttccagaaagttcaggagaatgcttacagatagcagctggaatcacttctagcacaggctaaacagaaagcatgttcacaaggaatctgaaataaataggaaaaaaaaagagatgtcataacactatcgtagggttcaccaaacatatagtaacaaaagaactatataaagttaatggtcatgtctatactctatagcaggctagtaatacgggcaacaggaaaatcatatatattagcttcaagcctacagagacaaatatataacactgaaactatcatgacaatcctagatacagatggttatcaaatacaaatactttgcacacaataagtctgtttcacttgcttatgtccttgccaaagctagaatcagacaagctttcaaaagtatcactgttagcacaaaatcgccaatacaaataaatccaaaagctccgaatattaaaaaatatgaaagaccctgtcactatggaaataaggtcataactagatttagcaatgactcccacagcatcaagaattcagcatattatctatatttgacatgcaaactatgtagagtcctctaaccaagtgctactcctaccatattagtattgtagcagaacaaaaagcacagcattcatctaaaatgac

SEQ ID NO: 51114 - DNA, 7081 bp, Oryza sativa
catatatacacgtgcaaaatcaattttagaatttacaaaaaaattcctccgaggccggtctgaccgagggtgtgcagccggtctgaccgggggccggtttgaccgaggcatcaccgccggtctgaccggtggtcggtctgaccgaggctgttcagccggtcagaccggtcgctggtccgaccgcgggacccactgcggtctgaccagtttcctcgaggaaaaaccagatttttgccactttgattttgcaaaagcaatctctctctccattttctgtttatgagctaatctgaaacaaaaaccaacaatatgtccatctttgccacaaaaagaacaagtatatttttcacgatgatagacacattggtagcactagtagatttagcaacatgagcaacaataggagattttgcatgcacaacattggattttgaagaagatgcattcatagtagacatgataccagcagatttaaacacagttttgttagtataaggtttaaccaaaatctcaccacttctagcaccaacacctaacacaacaggaggatgtctagaattatgaacataaggattaaaacctaaacctcggttatgtgtgctaacctttgattgatccaaaatcatgttgagattctttttaccatcagaaaatcctagcaaagaatttttcaaataagaaacctccttttccaaattagcacaattttcacaatctatcataacacttttgcttttacgacatttagggcaagaaagcacttcattgtttttcacgacgtcttccataaactcaacacgacctaaagcatcttttagtttcatcttgttcaaattacatgttgagcaatccaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactaaaagcaagagaagatctatttttcaaatcatgtgcagcattaacatctctaatttttgaaatatcattcattaaaacctcgcaatttgaacaatgatcatcattaggaataagagattttaatctatcaatttcagatttaagagattcaatgataaattcctgttttctatacatcttctcacacttcttattttttgcactcaaaatattaatagcttcctcaaaagcactcacctcactatcttcatactctgtgtcagattcaccacgcgccatgaagcaaacataggagatgttctttcccttgtcatcatctccactttcaccatctacatcacttagtggctcgaaggcggcgcaaacttgttgaaaagccttcctgagattgtccagcttcctcccttgggatgaacacttcgacttgttgttgggcttgtagttgttggtcttctcaccatctttgtcttctcttttgcctctcccaagcttaggacaatgcgaacgaagatgatcaattgaaccaattcaaagcaacgatttggaccacctcttttcctgttcctggcattattcatagctcgagcaattctgttagcaactaatgccaaatcctcctcctcgatttgttcgagttgatcatcggatgtggcattaaaaacagcaagaaaagaagacttagatgaagaagcatcaacatccaaagaggaaaccaaagcactcgacttagaatcaacttttcgagaaagaacattcatctcatgtgttttcaattttgtataaagtgaatccaaagtcaaagtagacatgttaatagattcctgaatagatgtaactttcatctcccaaatagacatgccaacaccattgaaaaagtggcgagaaatctcagattgtagataattagcatcataagaagaatcaacagatctaagatcactcaaaattttattaaaccgagaaagatagtcatccaaagcttctccaggtttcatctcaaatttaatatactcctttttgaaaagatcacgacgaagttctttaatattatttgttccttgaagaaaattactcaaagcagtccaaatctcatgagcagtttgaagatgagcaacacgatcataatccgaacgagaataccactcaaaagaatattgcgagctttgcagttttgttcaaaaccgttttttttagcagcagtattaatagcttaaggaatcacataaggatgagaatcttttctccaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaataaaacaagactctgataccacttgtaggatcgaatcacaagaactaagccaaccagaggggggtgaatggttggtatacccaaaaaccgaaaacttttagcggaaataaatgttaccctcgaattctacggagatcggtctgaccgaagttgtcatgccggtctgaccggtatagatcaatcggtctgaccgccgaagctacttgtcgcgcctgtcgccgccgccagtctgaccgccgtgcttccgtcggtctgatcgccgcttgccgccggtctgaccgccagtagatcgccggttagaccgccaaaaccgggtaaacacaaattgaataactcttaaagtagatgacgactttattgattttctttgtgtttacaaagtgcaccaacagcactccttacaaaaattttgactaaactcgaaaccctaactcaaaactcaactcaattgctctctaaagcgataccgggaagcctcacgctccccctctatttatacccgaggtaggcagcctaaagccacaaaccaaactcatactaggagttctaaacaccttaggaaaccctctagtacaagaaagaaactttacataaccaatcgtaccaaatttggactccttccaaattcgactctgcatcccacacgcacacaataactccatcgtatgccatatggaatctccatcaaccacgtgcatcaactctagcctaagtatcccgcatgatctccgaccaccacggacgtcgccttatccccaagccgactcccggtccatctccgcaaatactctcccgagacatcgagtcacctacacatggaacaaacaaagaaaccatattccgagactaagctatctccaacttgactcattagtagcaaacaacaatattacatacgtatagtatccatctagaagtcataatcatgaaataatcacggatatgcaaacaaacaacccgaaaccgaaaccaacacagtatcggacggtcagaccgtgggctagccggtctgaccgcgcgcattccgctggtccgaccggctaccagatctcggtctgaccggtcacatgaaataacaaatcctgcgatcacctgtgaaatccaatcatctccaaaaccacttcgtgaataaattccaaataacaaaaccaataatctccgatgcccaattgttcatcacagaataatcatcaaaaacacatttgattttacaattaaggctagaaatctatctatctattactccctcaatctacatatagtttttttagattattcctaaatgatctacatatttgtgtttattcattaagtctattcgttatttgtgcattggagtaaatggacattaatgtatgcatccatgcacacaaatatttataacccacatgcgatatcttgatttgctattggctaggaaatagtgggtatggtgcatgcatcgactttgttgctagagtaaatatagtatgagagttattagtttttcttagtcttggtgtacctatgaaatatgtatatcaatttggaatggagggagtatatactaaaagtccattaaacttcctacaaacgctctcaagcctggcacttctacaaatgctcctagaccgccacataccaatgtctaatctcaccgtcgattttcacttaaatcggtggatccaaataatttagactattagattagattagatgtattttatttaaaggaaacgaataccatactgttgggcggaaaaagaacggaaaacataagtactccgtaaataagtacgtacgactaaaaaacaatcaagcttacataatgttgatagaagaaaaaagacctacgcacagacttgcttaaaaaaaatagagccaaaaacaacgcaagtacttagtaccattgaagaaatataaaaaacaacaaagccaaaaaaaaatatacatacgtaataccattaaaaaaacgatgatctttagatataattttctattatttaaatataaaatataacactatataaatttaagcaaatattaccgttggtttttcacttttccaattttagcatgaactaaacacacccgaaaaagacataccagaatcttagcaagttgattgaaaggcacggcaagtgggactgcctagacatccgtttacttctgcagtaacatgcagttttacgggcaccaacacatacataatttgttcaagaaaaaagcatacataatcatacgcactgcagtaacatgtagtacattttcttattgcaataccacactattaacacataggatgaggcacactatgacagcaacacactatatatactgtacatgcagtaacatgtagtacttctttaggcagtcggcacgacggcggcagcggcggtggcgacgtcgacggggtgtaccgtgcgagccctcttccctgcctcccaccactgggcggcggccttccagccagcgcagcaaacaagagtaactgcagcgagaagtacgacgatgaccacaatgaaacctgaaaaattcattatttagtaattccaaaagaaaaaaaatatatgaagaactaggacttgaacctatgacctcctagctgaggaaaacaaattttctcgtggctaatgatttagtacagatgatcttcttggaactttgatcgtttaagactcatcgccattattacgggtttttattctaaatactaaggataaatataaagaagagataaaatccaaccaatctaaaaaaatagatactccatccgtttcatattacaagtactagtaaattttttttaagttcgactaaatttgtagaaaaacataggccttgtttagttggggaaatttttaggtttggttatcacattggatatacggacacccatttgaagtattaaacgtagtctaataataaaacaaattacagattctactaggaaactgcgagacgatttattaatcctaattaatccatcattagcaaatgtttactatgcaccacattgtcaaatcatgaagcaatttggcttaaaagattcgtctcacaatttacacgtaatatgtgtaattggatttttttttcctacatttaatactctatgcatgtgtccaaacgttcagtgtgaccacgtgaaaatttttgttctgggaactaaacagggccatactagtattttcaacacaaactaacatgaaaatatattcaatgttagatttaatgatataatttcatattttagatgttgttaaaatttttataattttgatcaaacttaacgattcaaacgtcttatgatataaaacggagggagtactaacattacaaacatgctccagctcaccaccgataatcgtcatcagtagtaagtactaacaaacattcaaaagaatcaggggcggatctagagtgtaacaagcggggcccttggcccccactcaattttgcagcgagcgggggcaaatgcccccttgacactttttacttcctgttaacggccaaatctggtaaggtgtgaactaggttcaatactaggatcgaggcggattcgatgaagagatcgattcgaagaacagagtatacatcggctgcgaaggtatcggctggagtgtacatcggctgggacggatcagacagagggtagccgatacagccgatagaggtaatgcagccgatgatgatgaagacggtttcaaggctgtttctagaatcgatcaaagtacttcacagggattgccatggtggagataaagctctcttatgtaattcccttagagatatgtttgggcaaaagtctgccgcaaagacttatggtatcttagagtttgttagagataagaatcgtgtccgatacggacatacttgtaattttcgggtataaatatgacccgaagccatgtaatcaaataacacacgttcaatacaatctcggcgcgtcgccaccctttcactttcgttttgtttcgacgagttcttactttcggattgagctgcatcggttttgatcttcaactagagataaaacttgttatggcggcttgcgttctcgggattagtgcttccatctttatgatactctaatattgtttatgtaattcgtcaagttatcatatattatatataatctttgacaatatcgttgtctaaccttaaatcgactaacatctattgttagaaggtagccgattaggttaaatatcgatgttgacttagattatatagggtatctaccatcctatgaaacaaccaacggcttgattgtctagatattgttatcctcttcacacttatagctgcatcagttgagtttgaccttataagtcgtgattagaatcttaatctctagtctgcttttgattgctgattagggcagtatcggggttttagccgatcttatctgatttaactaatttatatcttatatgcttgattggcatgttaaatccgccctttatgttaagatcttgttgtgtttaggtatattaacctttttgtttgatatatcctacttgctttaatatcttaatatagagtggtattggagtaattagccgatacatgctagatctatctgatcggctatgctataaatgtctataatctcattgttaatatatatttcgatctaagtgatttatactatctcggcatggcgaccgatctatcccaatcacttgatttaagtatatatcgatgtaaggattatat

SEQ ID NO: 51115 - DNA, 4788 bp, Oryza sativa
tgaccgatggatccaaatgaccctaaaatcatgaaacaaacctagtcgatgcttcaactcttggattattaccccatacatcgatctattggcgttctcaccagtcaccattttctgaagctttcagactgtcgttacaaggattaattttgaaacacctaattgtaaattttgtttgcggctcaagagccaacaagcagattctcagttaagatggtagaactactcaactacagacaaaaaaaaaagtcaaataagtcagtgctatgtttcatattttaagctaaacccttagccatcaacatctggtgttgaacttgaatttaattgtttgcaaccggtacgatcaacagccattcgcatcattatctaaaacaaatgatcatcaggcattgcatatgttgagtatgaaaactttcttgctactgaaaaattaacgcagaatacttccaagaaagggtaagaaaatattaacatataacaaaatctaaaaaataatattactacctccatctcaaaatatagtaatcttatactagatgcaatggaatctactttcctccgtttcacaatgtaagtcatcctcacttacattgtgaaacaaagtgagtatctagattggaagtcctaacatgtattacattggtcctaaaagtgatatattttaggatggaggagtaacatgcattattaaagcagctcatcaatgccactctggttcttgttagagcatgtagcccagctcacacaagtagtccaacttgtcacattagatccgctccaccatatatctaatcggaaccataactttaggtttcgagactacacatcccaaaagacgttatatatagtcgcctcgcgttgtccatggatatacttcatctatcattgaaagtgttggcaccttttttggcaagaagacaattatgatcgggacacctaaacatgttgtggtgatatggagtcacaaccacctcgatctagaccaagaagggtttttttaaaactaaaccggctagcggagccggtttagagatcaaaatcagcctctaggtcgatttagattgagatggacgaactattaaaactaaacccatctcgtgggtgaattggaaagtttaaagaacaaacctacaaagggcatcacactctcacagcgaaggcggacaatttatggcgcaaatcaacaaatatggatgaactattactaggtagaagataaagtagaaagcatggctaaaaagcaaagataaaagaacgattcaatagattatagggattgtggtctatggttagaatcgaaccagccatagcccttataaaggggtcgctcttgccatctacggaccctttccatgtcttacttggggtagagaccaattagaactcaagaaataccttccgaagcaaggaaacctgagacccgacaaaattggactcggcgtcagactgagccagtctgaccggcccaacaccccggccttatgacggcggttagaccggccccgtgaaggataccggatcatttccaaattcgtccatattttcctatttttgttctaggtgccaaatttgggtgttaacacatgccccctacctttttggcgaacttgcgagccgaaaagcatacaacacatggtcttagggtgacaatctatattggccataagggcttccaagtgcctagtagatctttctctttagagcactgctcccgtcctgcattttgtaccgcatggtacatgtaccatgtggaaccaaaacccatccagccgttgattttgcaagggtaggattggaacaggcaaagaagcgaggcaccgctccatcctttgattttgcgcgacttctcccccaaatcagacacgagacccgcctaccagacatcgtaaaccctagccgccgaacaaatgtccgccttctgaatcacgccacaaatctcgccgacgtcgccgcccgaaatcacatcgccgccggaaacatttgccgccccaaatcacatcgccgccggaagcatctgccgccacaaatcacatcgccgccggaagcaactgcagccccaaatcacattgccagaagcaactacggcgtagcagttgccatcgtctgagtcgctggagcagccgccattccccttgagcggtgtacatcaccggcgaagaagcccttgcgatgcggcggctcaattgggacaaatcgctagggttaccccttcactccagcactcatcgatccagatattgtgaaaagacatcagtgcctttgcaccaaacgttccaggtggtaccgcgtggtaccgtgaattcctaaccattagatctgtgcgaatcaacggcgcagattttgtacctcgttggtaccgcgcggttcctcgggggtgtgctgtacgataaaattcctattctctttatagtgtcctaacatattagcaattttcttagagtgattcacataactcagcatagatattcccaactaaatgattacccattgagcacctcgcacttggaccctaacggtaaaatcgttttttgatgccaagtccctaatcttgaaacgatcttactccaattataaaacttggctatacttctcctttcatctttttagtccattccaaagtcttcaagccttcatcggtccctttgtcactgttagtgtcttataactattggctgataaatcaactcactgaacataggagaatcaaccagctgaataatacatcccccaagccaattgataagttccacgatgccttatagcatttcatccataagatttcaggttgaccggtatctaaacatgtatcttgaaaatactaactccatggtttggcaatgcaattctttattaaacaaaatatatttaaatgcttattgccgaactctccaatagatcttatccgatcaaccatcttgcttagatcatggaagtattaaactagtggaatcctccaattggtaaaattgaatttcatagcacatcaaccgaattttataggatcaattcggctatataatcaaatttaagctcatgcccccagctacatactgtgggttgccatccccggtcagggcggcattaaagttatggtctgaccagttctatattcggtcagaccggtcgagaagctacgattagatcattcaagaagcattggtcagaccggtgtggttgcggttagaccgacctgatctggagtaatcaagcaccggcttttagaacatgcctctcctatctttatggccagatgtttggtgtgtcaaattactggtcaacatgatttctcaagtggctattttaaataactaggaaggtagccgcgcattcgcgcgggcatgtgtcgtacgcttagttcgaaacacttataagagtgaaatattaaacggataacatctgccacgatttctccaaaaattgtttacgtcggcattaattgcttttataattttctaacttatattatatcataattaagtaatatctataagcaattgaaaagaaggtagacttattttcttaagaaaacatgtcaacgaaagtaaaagtaaggtgtttttcttttcttagttgcatatattatcatggattattagaggatgaattgtgttagacacgaagctccactaaatgtatgggtttatatagacactaataattgatgtagtttgagaggtgatccatttatgaacatttcatgtagagtgggtcagaacctccacgcagcttaacatgaatacgataaagatgaaatataattgcgcagtaatatttttgaaatgtgatgtaccatgaatacacacttgtttttttaataagatagatctaacaattagaaataatggttctaccggtttaaaaggcataggtgtattccaaaaatgtagcataaaaattatagttgttttagtatccaacattattataaagcaagcgtagctcaactggttaggttacttgttctggaacttgccacctgggttcaagtcctatacttgatatgggtgcttgcatttacgattaattgttctttcagttgtaggtgacgtacccatcaatagtgaggcatccgtggtgatttctttaatctcaaaatatgccggcccagtttttcggagatagtcataatggtaggtatgtgtgtgtggattcatagtatgactttttacgaaataaagacaaaatatattacttcataaatataaatatacttagttaaatcatatagtaaaattattttaacatagcatgatttcatagtagcaggactaatttctttcctatttttactttacatatttatgattatttgagcgaccggtaaaattttagaacatgaaccaacacaaaatatttccttttcaagaatacctatgaaatagatttttttctcgcaccataaatttaatcgaagttgactggcaggctaaaggcccagcaatgtctccaatattcttctctcgaggcgtcagatatttcattatgtttgtttgatgacttgaattattcacttcatctctcaaatataatggaaggtccggagaggctacggcatttaattgtaagaaatataacggtgtgagcgaataataattgtttgggtacctaaaagttgcttttttgagatttattatgataaattaaaaatattatctcaactacttaaaaataaggagtaaaggggagataagacgaggtgaggagaggggtggtgggacagttggcagaaaggcattgtgtatatttctaatgatagaaaggcattgcatatatttctaacggcat

SEQ ID NO: 51116 - DNA, 957 bp, Oryza sativa
ttaaagcatatctaatggtggaaaatttgcatgtttttccccatgattttctttcaaaagataaatatcagttccataaaagtttgagaatttttaatgatcgtctttatttagtggtcttggggccaacgtgtaatatttgtcttttactctgaaatatagttcaatgcgcctgaaatcgtttgagtaaagaaatacattagaatggttcaaatcgatcacaaattggttatatacaatttaaaagccataatcacttaaaatactgtttatttatttttaaaaggtccaactcgaaagtataaaccacaaatgcatgcgaagtgcatgggtgcaaccggtgtatagtccgctctcagccttcacgttagaaaaagagaagtgagaatttaattaagtttctatataaaataggccattaaatatcttaaccaccaataaaaaggaaaaaaaagaaataggggcctacaggaggtggcaggtacgtgtgcgtggagagagctttgggcctttggcaggagagggacctgtaaattaatctaatttaacggtgtaaaattatgggtccaccagtttaaatgaaaattaatggctagatcttttgcttttttctcggaatttctaggactttctctaatttattagaacgccaagtggcgacgtgagagcgttttgaggaagtttaatgggcttttaagtatgtaatagatcgttgaccaataccaaagcaaacaaccaatgttagacgtgtagtagctgtatccatagtctaccacaattttaagatcaaagccgtgcctcctagtataacctggatttatattattgaaaggcaagattaagattatgtttgtttaaaaatgttgtcaaatagattaagggcaaactaaagttgtgataatggtattttataataatttagggttctatttttcttaaggtatctcaaaaaaccat

SEQ ID NO: 51117 - DNA, 4089 bp, Oryza sativa
caaaaggaaaatgtgctgacgtgcattgtgcagcgggccaaagagggaactttggacgctttatttattatcaaataatagattcgatgatttaaataatgggtccaccgttttagtttaagtgtaaattagttgatatatattttaaattgttaatttaatgggtacacaatataatgttgtagacttttttttgaaacagtgcattatttgagaatgatagtccactgtaataaaaaatagatccgatgatttaaataatgggttcatcggtttaagtgcatgtataaattagttaatatagattttaaattgtttatttgataggtacacaatataattgtgtatactttattttaaaatagtgaattatttgaaaataatagtatgagtacgacggtttattctaattgaagttatcttactccctccggtttcattctaattgaagttttgaacaataatacggtctacaaaaatatctttgatcttatttttctattataatatatacgataaataaatatatgtttacttttatcatagttttaagacaaatctatatatgttgttctagttcctttaaactaaatatttttaaagtcattgatagtcaaagttataaaagtttgacctcgaccttgttcaaaaggtcaattattatagaaccgaatggagtatattattaatttaatgggtaccatataatggtgtcaattttattttcaataactgtagagctaatttagttacatgtgagttgtatgatggtagattctttgttagtaaaattatgattacataaaaaatatatatccattatataaatggaaaaagaagaaaaaaagaaaaataagaagggaaggaatgtacgtacgtatacctatacatgcgtgggagaagaggagaggtgggatcccatagtatttggtttgtttattcttggaatttttatgattttttctaatttattaaagcgtcgcgtagcggcttaagagcgtttgtaggaaatttaatggacttttagtatagctacacatgcccaggagaagaggagaggtgggacccttagtatttagtttgttttttcttagaatttgcaggattttctctaatttattagagtgtcacgttgcagcttgagagcgtttgtagaaagtttaatatgaacatttagtattaataataatagatagatagatagatagatatattttattttttttaaattgtagtaaatcccgtcgattttctttccaacgatggtagtacgtacatatgtttctttggctttattttcttttatacgaatatggtcttttttttttcttgcggcacagtaggtaagctttattttttttcctttgaatcgtacctagtacagacagttatatatttgttgtgtgggaggaaggtattattttttttaataacagatctaatctaatggtcaaaaatatactgcaccaatttaaataaaaatcaatggtgggattagatagtgccatgtgtcaatctaggagcgtttataggaatcccacatggtctttttttttcttgcggcacagtaggtaagctttatttttttcctttgaatcgtacgtagtacagacagttatatatttgctgcgtgggaggaaggtattatttttttaataacagatctaatctaatggtaaaaaatatagggcaccaatttaaatgaaaatcaatggtgagattagatagtgccatgtggcaatctaggagcgtttgtaggaattccacatggcgacttaagagcgtttgtaggaagtttaatggacttttagtatataatagatagattaccaaagcataaaagattctcagccactcgttgaatgaccaattatgaattaccaaaatcatatgttctacacatatggattctatttaatactagcctgggtactttggctcaagcataaatgcaaaatattctaatagggccaatattgcaaaaacaacatctcttgataataataacgcaaagctagcccattggccattcacaaaagccggattactaagaagcacaactttcatggtgcaaggattataaaatcgatatcttaatggtgatacataaaaacatacatgttttggcttttaataaatatcaaacactcatgagccaaatcatacttcaaatgaatcgcttctttcatccggaatgtaggtatcatcatacctatgccagcactcggctgtcacgtgaccccatttcaagcaaacctaagagatggggcgatcattgccaccctgggttgatttccgctgttgccgcgtccacgcccagcggtggcaggagcgccattaccgcgcggagtacttccgccacgacaaccgctacatttgccgatgccacatgcacttgccgaataggtcacctggtctcaaaattaagaagttgagaacaaacttctgacattgtgaccgtctcattgcgtgccacaatagcagatacaacaggttcaaaatcctcatttagcccatccagaatgtaagcaagtaggtcttcttcatctaagggtttcctggaggtagcaatttcatccctgagagctttcatcttgccatagtattgagaaacactcatgttacctttttgtgcattgatgagtataagccggatgttgagcgactgtgcttcggtttgggtagtgaacatggcgcaaatttgctgccatgcttgcgccgccgttgatgcaatagccacctgggtgagtacataccttgatagggtggagagcaggaaccctaatacctgttggtcggaggcgaaccactcttgaaaggcgggttgacgatcttctctgtcctgccgtcggtggtgcgctcgatctccatggatgggacagtgatggtgccggagatgtgcccatccaagcacgacccgcgtatggctgccaaaacttgctctgaccacaactcatagtttcctttgtccagtttctcttaaacttgaacgctgaagagaggattggtgagggtagcactcaacgaggaacttgccatcaccaggcttgttgattttgccggactttacagctctgatactgttgacgaaaaaaatcgaacacaccggcctgagagatctgcttagctcctgtgcaggtccaaagattggtgagatgcgggcatgtcagtcagtttaatcctataactgacaagatatgcaaataatagacaaaacagccaatcggctgacaagccgatggagcagttccagccgatagccgataatagctaaatgcgataccagccgacagcgatagggttttgagcaatcggctatacgtccaatgtagattctaacattttagtaaataatgatatatagtcaatcggctactgataatgaaatataacagtaatatagtccagtataaaccaatcggctagcattgatatgatagaataagcactgatttaaaggttaaagcatacatcggctggaagtccgatgtcatgaaatccacaagattagattaaacagtgaaacctttgttatcatcggcaaaatccaacttatatgtatatgcaatccttatgagctgatgcaacgtccagataactcaccggctaaaaccccgatgaaaccctcattagcaatcaagaagcaggctagagattatggttcgaagcacgacttagtagatcaagcttaactgttgcagcactaagtatgaaaagaaacataatatctagaaaatcaagccgttgattgagtttttggggtggtagatgtctaagctaatctaatctagcaacgcgatttagccgataccaacagaaaccctaaaacgagaagcagccgatagagctaaattgatatgctaagactagattaacagagacatatgataaatagttaggcaaatatatcatccaaaccagagcaatccaagaggtcgaatgtactgatgcagccttccccctagccggagatcgaacaccgatgcagccccacgtcaggtgccaagtcccgtcggacgataaaataaagtagaaaaggtaaaaggtggcgatgcgccgaattgtattgatcgtgaagatagtttacaa

SEQ ID NO: 51118 - DNA, 4555 bp, Oryza sativa
tttcagaaaaaaaaatagcacagtttttttatggtgctactttgaaaataattggtccaaagttccaaacctaaaatcatgaaaagcaagaaaaagaagacatgcgtgtagatggagaaaatatcgtgcaaaatcatatttatttctcagaaaccggttaattaaaccgttatggagggggcacatggaaaacagatcgaggtgattttaagaattattatataagaatgtgcaaggcatactggtaagcaaatatacgtcgctattgtctattggacacgttgaactcacgatgaaatgtcatgtaggtttcatagagatctcacatttgcattaactgtgagaagcctcggtcatagccggtgatgtctcgtgcaagtgacaccaaaatggtgtgatagatagggatcaaaatggtgtgacagcaaaatggccgcatcaaagctgaagagaggcatgtggcacagtgaacagaccgatgtgattattgtaaatcaccatctccttctggatgaatgtcaatgccatctgtacattgaccatgaaaaagagcacctgtgatgcacagacagggcataagacgctgtttagatgggactttaaagtcgctatcatatcggatgtttggacactaattataaatattaaacgtagattattattaaaacccatccataatctggactaattcgcgagacgaatctattgagcctaattaatccatgattagcctatgtgatgctacagtaaacattctctaattatggattaattaggcttaaaaaatttatctcgcgaattagctttcatttatgtaattagttttataagtagtctatatttaatactctaaattagtgtctaaatacagagactaaagttaagtccctagatccaaacaccaagagcagcagcagcatcttgtgttcctccatctggtacacaatgcacagcctccatgggcccactactacataaatcgttttcccaaacggccaaaagtgattttgcatctggacgggtggtctgcctacatgcaaaggcctagaaaaagaatataattttgcatgtgaaaatccgattttcgtaggcggacgccgcatgcaaaaataatttggagaaaaaaattccaaaactaaaaaccctagatccacgatacagaaaccctaatacgttgctgccgtcacaccggatccactgccatcgtcatgttgggatccgccgtcgtggtcgtcgatcgaggccaccactgatgtggtcgaagtcacctgggcccagtggtccaacaacggtggatctgcaccgtgctcgaagtcgcccgaggcccggcggcgcacagatcctgtgtgcccgaggccttgcggtggtggatttgcacacccgaggcacgtcaactgtggatcctgccctccgctgccacccggcgtcatcgtcggtcgtcgcagtatatgacatctgctcgctcctgccgcctccgccttagccgttggagtgggagggggagaggaaaggagaagagggagtatgaaaggaagagatgagaaggagaggagtaggagtggataagaagagtgtgagaggaaaggacaaaatgatgcaggaattgttgcgtggggcccacttgctctcccctttgttcggatgcaaaaatcatgtggtttcttaagaaagcccagctgaaaaaataagtatatttctgtacgcggacctctcagggggctacattttcacatgggaagtggcccgtgaaccttccctcggaaaacgatttttgcagacgcgaccaattacagtccacctgcaacctttatgggtcctcgtatataaaaaatgtttctgtagtagtggcctgtatgtgttgctactaattcctttgttgtccgagggtgtcgcggtagaaaggcagccttatcatagaacctggaaaattaatatataaatcatgcaaatgtagaaatacaagtgaactattaaatattttcaggttgctaatgttcaaacaaagtatttcctaggtacaatcaacttacgtggatggtgattacttacccctttacttgttgagtacatttagattgatctataatggtagtattttaccactattatcactcataaaagtggtcttggctgttgttttatatattgtagtactagtaggaaaaaaatattttagagtaaagtgcatggctggtccataaacttgcacgactatatcatctaggttcccaaactcttaaaatatatatttagatcccaaaacttgtaaggtgtgtcattccggtccaaaatggcacaaccccttcaagatcctacgtggcgctaatgtggcatgccacttaagcgccaccaacacagtatcatcactaactctacactgacaaatagagccttggcgtccaaatgaagaagaagaagaagagaaggaaatgaaaatgaaaaaaatggagaaaaaagaaaatttctgaacgggccctacttgtcagtcggtgtaggattggtgaatatgccacgtcaacgttcatgtggtatgtcatattggcatcatgtagcatctcggatgggctgttgtactttgggactgaaatgatacattttgataaattttaggacctaaatatgcatttgacagtttaacgacccatataatacggtcgtacaagtttagagaccatccgtgcatttttactcaatattttactaccaatagttggtgtggtagtataaatagatatcatccattggattagaaaaaaaaaactatgtagctagattggatcttctaccagtagagagttttaattgaagaacacctcttgtttttggactattgcatctcatgttggagtaaaagtactctattttaagtaatcacataacttatacttgcagaaggcccttgcaaaacaaacatctcacaactaagaaaacattttaaaaaaaattgtatgcagtaactgaattatttcatcataactcaagtacctgaatttattggtatgatggatcttataacttgcttctgatagtaatgatagctcatggagggttgagctataatcaagtaactttggatggcgatttcttactaacggaataattacttgagaaacacttttataggactttcttcatgtttcttgaaccagtacaccattctaccacccacgaacacagtgaaaccaacagtcataacaattatcgggattgtgaatctgacaccctaaccaatattgtcctacacccaaacaagaacagttgctgacggcaattatccagtagtagtaccagttgaagaattaatgagcactccttatcccactttagtggtcagcaacatcaaactgattggcccctagggctgaagagcagagcttgatcgatgcctctagttccatctgagacaagatagtgcccaaggtagacggtaacatgatgaacactgctatggtaggacaaatgcaaatgcaatgaaagtagagaactattagaatgagcatcaccaatataactaacagatatattagaagtcacatgcgagacatgaccaggattagaggattatattaaccggttgatatttttcttgttacacttacaataataaaaattaagagaaaaactattattatctgctatcttccccaagatctgatagcaaataattctccaataaacaacgtgaaataacaacggctcatccaattaaacacaattcttgccatgtcaagatatgtaaatgaaccgtctataaaatttttcacaccttgataactgattgcatatttagctttacaatccttattacatatccagctttacaatcctttggaagtccatgataaaccccaatataacatgctgccacatttaccatagcatctcccgatgttccagccgtaaattgatactcaaccattttaattaaactcatctgatatcctttcttaatcaacctaatgattgtgtcatatctcctactagtataactaatgtgcccacaaactagagtgcatcttatcacaatcgagaccaccgtttgtgaaaataaatattcagactgaattagtggtaatttcactatgttgatacatgtatgatcttcagaccaaccggtgaaattatcggtgtcttaataggagaagggaatatcctcaaccttaaaaaggattagatctatttcgatgttaactacatctagtttttcatcttagaaacttctgtgtagttcaacaatatcattggttacacattgggataaagaagatatctatcttcatggatgcatatgattttacaaataaattatctaataagatctctatctgtaaggacatgttttcactcattacagtaattgtctaaaacatgtgttacggtcaacaaatagagactattttcacgccgctcaacaaaaaagctggtaacattagttgtctttatttttaccttatccgcccgcttaacattgagcctagatatgattttataatgatagaaagcaagactcgttattttttttcttaatgctttatggttaatttgatgtggaaaa

SEQ ID NO: 51119 - DNA, 15825 bp, Oryza sativa
aataggaaaaaaagtagaactattttgttgaaagaccaacacttctaccgaaaggcaggctttgctcggtgagtggaaaaggtaaacaatggttgtgtatcgatttctcaaaaattagattcccttctaaacacccatgggggctatttataggtttacaactaggttagcaaaccctatggtttggcttgcatgtgttattacattattatccccttgataaggatatttacaagggtatccatgctttctgcctatctaatcagccatctagccttattaggttagtcagatggtcgtgagtagctgttgacggtggttaacgattagtttcaaccgttgatattaccgaaatagaggagaactagttattcttgcaatgcatatttaagttagaataataatattccactagtattaggtttactatccttttgcagagaataaccataaagtggaggagaatcgacatcaaaccagacgatcaatcaatcggacaatgtcgacaatcagatttatgtatgaataggccaagaaatcagaaatgatacgtcgaataggaccaaaattcacaagtctgcggaatagagcaaaagaggaggccacctgccgaaactaggccagggaaccctcctcggcgtcgttggatgcatggcatcttttggatggtgtggattgcctccctatggcggttggagggtattaccgacctttccaaccgccataaccatcattacctgcctatttaaggagctcactctctttatttcttcacacacttcaagcaagaactctctcatattctctcaagtttagtttagtagtctcaagctagtggagtccggaagtcttcggaagagttcgggtatggctctagtagctctcctttcttcttttgtaagacttgtactttatttagaatattcttctttatgcaattctggtattgaaatactttccgagtatatgaatgccaacttactttatgttcatgttatactgattatactgctagcttatctgggagatgcatagttacgggtataaagtttgtttatgcaattactccatgtcatgatgatgatattagagtagtatctggtagtttaggcgtggtgtctagatttcgagatatcattatttggggttatatgctgcagatgagaggtgggccactgatggtgacagttcagtacgggttaatttcatggggagggtactcctccgtattttgccccggttgtatggtcatgacgggctatcataaggaactcggtagtcaggggtggcttctcgaagtaccaggagggcatcagatagagggtattagctagttaatcatataactagaatgtatgtataatatgtatactagaagtataggaatagattcttttctattttctttccatttagcttgtgtgtcatcctaccctttggattatgcttgtgtgtcatcctaccctttggattatactaacccctgcttagactatgattattacaagtaacatataaactattagtacggttctctctactataatctttccacgggattaaataaatacgattcccttggaatactctcgggtgaaatgctacaattgtatatctgtgcgcttgcggatgaactctgtaaccacaatatactaagagtatttcagcgccattgctgggaattaaatttctagtaatgtcgttaagaaataccaacggtagccttgttccaatcaggcacactagagtcgttccccttggccacctagagtgctttggctttaggcaatagctacctcgttgtcggcttgcttaatgccactctgctttgctgaacttcgccacggtttgcttcgcttcatgttgcttcgccagttttttatgctttggcaggttggtcaaaaggctcactagcctgtccccaccaaacttcacatttgagtatttatactagaaaaaagtgtcaagatgttgatgagctgcctcttacctcatggagctgtgcaataatagcagaaaatttagggaactaagagcagccatcatccagaagtacttcctccatttcatattataagactttctagcattacccatattcatatatatgttaatgaatctagacatatatatatgtgcctagattcattgacatctatatggactaggaaagtagcacgcgcattcgcgcgggcatgtatatattgtaggatgtgtttgagaaatttataagatgaaatatcaaccgaatgatctggcctctacgcttcaaatgtattatttctcttcaaattttcatcatcggcattatttgaaattttccaaactatttattagctttaaactatatatatttaatttattactataagatttatattttttttcattatcttgagaggagtttgacttagtttgtataaaagatgtcttataaattaagtataaattaaacatatggtgttttccagatttaattgaatgtttagagtccctattttttaataaattatgaaaactatgattgctaataaatgtatttgtcgacggtgggtacccgtagaccggatatagagggtattgggtacgctggtacgaggatctacgtagtacggcatgaaggaaacaagagacaaagattatactggttcaggccccttagcaggtaatagccctaatccagttgatatgggattatatggaaagaaccacagattacaaagggaatagtaggactcggcggtaccgacgagatcgtagtcgagttgattcgactagatcacctggcgacttggcttctatagtctccgacttcgtaggctgtggtcattttgtaggctcttagattcgatgccttaggtccctccagagggttccttttatatcgcaggtcaggcggtctccaagtaggactcggagacatcggaccctgcacatatagtaacgacccagccctatacgggtaggaacctttccattggtaaacttcgtgatggatttccttagcatgttcagagaacgtccgtatatgcaacgatataccgtattgccgtatagcatacatccaagggtagagggtataccttatccataaccctgacaggagcccccgacatcaacttaaatgaactcgtgtaaccaatcgtgacttctaatgtcggagttgttgtcgttctcgattggtcgatctcggtgtgaggaccgtagagacaaagagtgatcgacaacaccatgcgaagtcgaacggttatgagtgaatttaaattgaagtccaagaaaccgcgtcgtgcaacggacctagaaatttccggcggccatttctctcctttccttggaattcacaccgtcggtagtacgcctatttatgggagttttgggaatccaatttggtgtccggctgttgtgagaactatcttgcctccaaacgctcttcgccttctccgcttccacacaaaccctatgttcgcccgcctcagcttcttctcagggaatggacctcgacaagtccacctccagcaatgcgtccttggagaaattgcaggaggagggcgctctccccggtcacgggaccatggagagggaaccgggaggtactgaacctgaacccatcctgggccgcatggttgcggttgaggactacattctctgtggttttcttcctccgccttccgagtttttccttcttgtcttgaacttctacggtctttctctgcttcatctgaaccccaactccatagccttccttagcattttttctcatctctgtgaggcctacattggggtagagccgtttcttgacctgttccgcttttactacgagttgcgctggatggaacctaaaaaggtatccgggtgcgtcggtttccgacttcgggatggcctgaagtcgtgatacatccctctccagtgcccctcatctcgtattaaatggcgggggaggtggttctatcttcatatagaagattaggatccagtcttcattgttcctgaggagcaaccagacaagattccgtcttggaccgccaaacccaccttgaccccatccctccaatctttcattgatatcattgatgacctctgaatacgagggctgtcggggtatgaagtcgcagccgacttcattggtagacggatccagccgctcaaggctcgagcccatctagcctttgactactttggactggaggacacgacccgggtttctcctcggggtatttttcttgtattttgggtttctctgcttttatgcgcattcctcctgacttgtcgaaacttggttctcgatctgcaggtctgagcagcacaaccgtggagcaccgtgttgcccaggtgatgattagcagtcccacgacggcgagcaacgtccccacccctctttgtgagagggaggcggctgagcgtgaagccgcgatcaacgtgagtgtagtcgatggtcctttacctttcaattcttagatcgcatcatgacttcatgttgtgcaggctctcctcctgactgacgccatcgggccgctcgtggaccaccagacggcggcctcgttgaaggagggcgttgcccgggaggcgtccgacacggccattgtcattgctgctgccacgaccagcggcagcaaggttccgaagaaggggaggaagttttcctccgtgctcggcaaccgccggaagacgcccactccatcggtaagctttctaggttattgatttacgtagttggagaatgtcgccctcatgtcgtactcggtttacttaggtctcggatgcgtctcccccacctccacgatggcagaggctactgacactcggcgagaagtaagtggacgaaatttgaggttctcgacttggttggattttgtcgtcttgttacgatgaccgacatggccgtctttcgtagggcggcacgagcgaaggcagcgcaagatgggtctacagcaaactccagtgcgtctcctgcagtggcctcgtccgaggtcgtggtcgtgccttggagccgcgaggtgacgcccagcggcccggccagcaatcccacagctggtcgaggcccgccggctgccgtcctcacctgggaggaactccaggtcgagatggggcacatcatcgaggctggcactcacggcattagtcacgagattgcggaggcgagggcggcggcggcatcgtcggcaaatgagcgtgccgatcggctgacgcgtgatttggcggaggttcgcgaggtcctctagaagatgagagaactggtggccggcaacgagcgacaactgcaggggctcgagcaccgtatgtcggagctcgagaatgacttgtcggagatccgtggctcgctgtgggtcacctacactagtctgcaccagctctccggggagtgcggtgtcacgaccaccatcccggagaatcccgatgagttctcgctgacgacttcgctcacggaactggcaacggcgatggaggcgatcccctctaagcacgcggccaggatcagagaggagacgtccaacgggatctacaccggggcgtgccacgtccttgcgtgtgtgaggttggcacaccctgaactcaatctccagaagatcttggatcagggggcggctagcgacgcgcgcaaagatgtgatggaagaagtcggcgaactaggggagtctgtcctcccactttttgaagagtagggccaccgcttgtctgtaccccttaaccaatcgcgttttttaaaacttttcgttggttccgactgcctttgtgtgtgcaatcatcaccttagttttctttggcgttttgattccgggtaattagtttgttgtttgtagagatgtcgatgtcgaggatatccagcagcgcgggcagcctgaattgccggtagtcgttccagcacttgagcttgagccgtatgtgccgcaggacggcgtagaccaggatctgcccgaggagacggacgtggcgacgactcctttaggttggttcttgtcgtttccatttcctttgactcttctgtcttgattagcttgacttcagtgtttgcatgtcgagcagacctcgaaaatgcgattgctgatcgcgaccgtcgcattcagtactggaggacaaagttcgaggtcgccgaacttgagaggactatattggaagtgaagaaggaccgggccatggaggcgctccgaggtcgcgaggtatggttcaactcgtacctcaggagctgttgcacaaccatggccgttgtctgcagggagctccgagtacctcgtggggatcccgaggagtcagcggctggctacatctcgtggctaaacggggctggtgctcagcttgaaggcatcggcaggcgtatcgatgaggccctaaagcagaagtgtcgtcgattgagccgatacgctggagggcacgtgttggcatgtatacgagatcatcgtccgcagttgcacctagagttcctccacgaagggttttcccgttctcggaggaatcccgcggagatagacaacctggcgaagtcgatggctccgttggcggagaaaatctttcagtcaatggattggcgttggccttcctggtagtgcttgtatatctgtgacaaacatcttaagaaaaatgtaatgtattttggatatcttttcggtctgtaggaaatacttgtgaagtagaaaggaaatctatgtaactaagctttcttactctggatgcggtgtgtacgagtgtcttctcacttcgcgacttcgatcagtcacttgagttatacactctccctagcccccagccttgtcatcggagaactcatctcggaagataaagctcttggaccttcgacttgccttagttgaataagcactgaccctagcccccagccgtgaagttggaaaaatccatttccgattacacggcttggttaatacgcacggcgagaactcttacatgaccagatcttacacggtctttcgtctctgaaggattcgacaaggccttatcagctctgggcgtccccagccgaagttcccttaggttcctcggaggccttgtcaagacggcgtaaagggacatgaggataggtttcaacgctaggtgtcgtctgggtaagggatcatcaggaaggaacactttgatgtcttacaagtgtggacactattgacttatacatagaatttacgcaattggtcaatgatccaagaatttgctaactcgcgaccatcaccgtctgcaatcttgaacgcgcctggccgcaagacctgtgtgatcgtgtatggtccttcccatttgggcgagagtttgtttcgccctgcttggctttgaactcgtcagaggacgtagtcaccgatcgaaagtatgcatgctcggatgcgcttctcgtggtatcggcgaagggcctgttggtagctagctgctctgacggcaacccgttctcgatgttcctctagtaggttcacgtcgtcgtttcgctgttcgtcctgatcctcgtcggagtacttctgtactcgtgtactctgatgtcgtaactcggtaggtagcatggcctctgagccgtacacgaggaagaaaggtgtctccttgttggacgttgtcggtgtagtgcgcacggcccattgtaccgaggggagttcctcgacccacttcttgtcatgtgacatgagcctgtcatagacacgggtcttgatcccttgtagtactatactgtttgccctctcgacctgtccgttactctgagggtgagaaaccaaggcaaagcatatcttgactcccagtccgatgcagtaatcttggaaatcagcgctgatgaattgggagcccgttatccgttatgatgcggtgaggcaatccatatcggcaaaatatccccctaatgaatttgatggcgttatcggccttgatttcccccgtgggtgttgcctcgatccatttggtgaatttgtcgatcaccacgaacaagaatttgtagccgccctgtcgtcgtgggaatggaccgagtatgtcgagcccccagcacaagaacggccaagtgagagggatggtttgtagtgcttgcgctagtagctttgtatgtttgctatgaaattgacaagcctcacaccattgtaccatgtcgcaagcgtctttgagggcggttggccagaaaaatccttgtcgaaaggcttttccgaccaatgtacgaccggcggcatgtgacccgcagaccgcttcgtgtatgtcgtggagaaggtgtttgccatcgtcggacgagacgcattttagaagtaccccgtttggcgctttcttgtatagatcgttgccgatcatacggtagatttttgcttgacgggttattttctcggcttctgcgtcatcctcgagcaactcgtcgctgcttatgaatttaatgagtagggtccgccagtcgtccgtggtcttgatgtcggcaacggcgcgctctacctctgtagcccccgagctgatgtcgggggtgactgagctatcttcgtcatttgcctctttcactgatggttttgtcaggatgtccagaaaggtgccgggttcgagtggctctcgtctggacgcacgccgtgctagatcgtccggctcgatgttgtccttacgtatacgtgtcggacctcgatcctatcaaatctttttccagcttcctgacttctgtgaggtacttcgacaactcagggctagagcatttgtaatctttgtgcacctggtttatgactagttcagaatccccttcatactccaagtgcagctgcagctcttatcccagcgagtagtccttcatactcggctgtgttgttggtcgccctgaagttaaggtgaattgcatgcttgaactgatctccgaaggtgatgtcaagatgaaccccgcacctgctccttggctgttgagcgcgccatcgaaagccattgtccatgtttcgttgtctgtcttgctgtctaacccgttttcaggcatagtccaatcggctacaaaatcggcgagaacttgggacttgatggctgttggtggtacaaagtggacgtcaaactggcttagctcgactacccatttcgcaatgcggtcgacaacgtctttgtttctcacgactttgccaagagggaaggcggagacaattgtgaccctttgggcttggaagtagtggcgtagctttcttgacgtcatgattacggcgtagagcagtttttggatctgttggtatcttgtctatgcgtcgtgtagagcttcgctgacgtaatagactggtctctgcaccttttctctttcgaaaataatgacagtactcacagagtagggcatggcggcgatatagaggaacaacacttcattaagttggggagcaacaagtacagggggatttgacaagtagcgcttgagtgcgatgaacgcctcttcggcttcctgtgtccatacaaatttgtcttgcttttttagcagtgcaaagaagggctgtcctcattctcccatcctagtgacgaacccacttagcgccaccatgcatccggttagcctctgtacttccttgagtcttgtgggtgacttcatattctcgattgccttgatcttctcgggatttgcttctattcctctgccagagacgaggaacccaagcagtttgcccgacggtaccccgaacgtgcacttctcaaggttgagcatgaggcgatatcgtctgaggttgtcgaaggtttcccatagatcgtcaatcaatgagtcacttgtcttggtcttgacaatgatgtcatcgacgtaggtctcaacattgttacccagctgatcgctaagtgccccttggaccgtacgctgaaaagtatttcctgcggttatgagtccaaacggcattttaacatagcagaatacaccaaacggtgtgatgaatgctgtcttctcctcgtcctcttttgccatgctgatttggtggtagccggagtaagcgtcaaggaagctgaacagctcgcaaccagctgttgagtccactagttggtctattcaagggagagggaagtgatccttggggcacgccttgttgaggtcggtgaagtcgacacacatcctccacttctcattggccttccgcaccatgactaggttggctagccactctggatggagtacctctctgatgaaaccagctttgacaagtttatcgagctcttctcgtatggcctgtttccgatctggtgcaaatctctacagtttttgctttactggcttggcatcgggtcacaccatgagtttgtgctcaatcacctccctggggacccccggcatgtcggacggctgccaagcgaatacgtccgcattgtcgcggaggaaggtgatgagcgcgagttcctatttctcgttcagtgatgccccgatcttgactgtcttgtcggggttggcactggagagtggaacgattttgattgcgccgtctggtttcggcgtcttagtcgttttgatcactttcttgggtggctcggttgtggcgggtgggctgggcatgtgctcgaccatgtcgaggctctgcttgtcgcattggaccgccagctttgcgttcccttgaatagtgattgttccctttggcccgggcatcttgagtacctcatacgcgtagtgagatgcggccatgaacttcacgagtgcagttcttccgatgatggcgttgtatgctgtgtcaaactcagcaacatgaaaagttatctgctttgttcggaagttgcttgcttggccgaaggtcacaggaagcgtgatcttgcccaatggcttggacgaggactgaggagtgattccgtggaagggttgatcggtaggtgtcaactcgcttcgcggaattcccattgcgtccaaggtgctggcgaagaggagattgatggagctgccgccatcgacgaggactagtgctaccttgatattccgaatagtgggttcgaccacgatcggatatcgtcctgatataatagcagccttgcggtggtcctcatctgagaactcgatcttctgttcagaccacttcatcttgggtgcagccccctgccatgtcgaacaaacctcacgttccacttttttgtattctcgctttgaagagtacactatggagcctctgaagatgtgcgagacatgaagatcggaatctgggtatgtgaagtccgaatcctgagtggttgcctcagtggccttctcgactacacgtacttgcttgcccttctccaaagccagctacttttccaacgacttgttgaagatgaggcactcctctagagaatgtctgtccgacttgtgtatggggcaacatattctcttcgtatcactaccttgtgggtctgggtgtttgggcgggcgcttgtattcagatgcgaggacttctgcttgagctttcctcttcccactcttgccgcttttcttctttcttgattcgggtgcgtccttggctggcttcttctctcctcccgcctttggtttgtcgttcttgcgtctcagcgcgtcgtctgcatgggcgcatcgatcgacaaccttgaacaaccttcgagtagttgtgattcgccttgttgccaactcctgggtagtatagcgatctctgacaccggttttgaaagcgcaaatcatagaggcatcggtgatatcggggatcgtatttctgcagtcattaaagcgccgaacatagtccctcaaagattcacccggattctatgttaacgcgtgtaaatcgtcttcgatcgcgtggcgcttgtaagttccctagaagttagcgacgaattgttgccacaaatctgcccatgaagagatcgagtaaggtgggaggtgcattagccatgaacgcgcagaacctttcaacaccgttggcaaatagtttgctaacatgttgtcgtctaccccagcagcgtatagtaccgtggagtagacctggaggattcttcagggtcaatactcccatcgtacttctctattgctccgggtcggaatctctcgggccatcggacatcacgtagagaacggttgaaagctctacacccagcgctagggcggtgggttgtcggcgatcgtgtgtcctccgtgggtgtctatcggatgacgaagatgaagatgatgacgatgatgacgatggttcactcggctccggtgtgcgattccgcgggcgacgttcaggttctcgagagttctgttgtcgtccaccattgttgtcctggcgctgacccccgttatcgtcaccgtcatgctgacgccctcgaccagcatcgtctggtgttcgctgatcatcgcggtcgcggcagttgtgacgatcatggcggtgttggtcctcgttcgagcggcctcctcgctcttcgttctcgtgacgtcatgaagaaacacgatgtcgggaacgattctcgttgtctcggcgcgtcctgcttctcggcggccattcagatggtcatggagatcgccggtgccgcgaggttgaggggtagctcatctcggcgacgtccgctgcttcggtggttcgccgtcggcaccttcagctgttggtcgttctggttgtgctctggtagcagcttcctcgaacgcattactgagattggctaccgattcccgtagtcgttctgtccaacgtgcgagatcattgttaagcacggggtcgtagggagcttctctcagtattgcgttgacggtgccgagatgttgggtcggcgtgaccgtctggttctccgcctctgcgttagcctgtgcagatgtgttagtcccaccgatggcaaacacgtcgcgcggtgtactggaagatgacgagccatagtcttcgagtaggtgaaggaccgatggctcatggggatcgatgtcgattactccaacgaatcgatctgaggtcaacgtcgcttcttgttccttgtctgtgtccttgagggaggttcctgactgttggaccttaggaagcgtcgttttcatggtgcggagaaagaccttgcagcttgagaagtcgtgattcttcgtcttgtgaataggacaatagatatcacgagttggagaagtacgctggattccacgctatttgcaagcaggaatttcagcttgtacattgagaaaaacccagcaagcttgcaagttgtgcttcctggatttgtgaataggacaccaggactttgtcacttcggaagatgtccttgtcggctcgcagttcttgtcggaaggacaagatttggccgaactaggaaccttctcgggctcatatggcatcgatgttccgttctccgccacggcgggaggatcctttgacacaggatcgtccgggtttatagccacgacgttctcgtttctggtcattgatgaatctgtcgagattggtaccgtggtgtaaaccggaaagacgatttcgccgacttgagtccacaccagcattgttgaagtagggactcctaggatggggccggtgttgacgccgttgtcgacgaagcttgatgtaatagtagtagaaccttaagcaccaaggccccctacctagcgcgccactgtcgacggtgggtacccgtagaccagatataaagggtattggggtacgctggtacgaggatctacgtagtacggcatcaaggaaacaagagacaaagattatactggttcaggccccttagcaggtaatagccctaatccagttgatatgggattatatggaaagaaccacagattacaaagggaatagtaggactcggcggtaccgacgagatcgtagtcgagttgattcgactagatcacccggcgacttggctcctgtagtctccgactttgtaggctgtggtcgttgtgtaggctctgaaattcgatgccttaggtcccttggggggtcccttttatatcgcaggtcaggcggtctccaagtaggactcggagacatcgcaccctacacgatatagtaacgacccagtcctatatgggtcggaacctttccattggtagacttcgtgatggatttccttagcatgtttagagaacgtccgtatatgcaccgatataccgtattgccgtatagcatacatccaagggtagagggtataccttatccgtaatcctgacaatatttttgtttgtaccatggggatagcctcttccttctaattggttcagattgatacaatttgtttcatacttactatgaataaggccttgtttagctggagaaaatttttggttttggttgtcacatcggatatacggacacacatttgaagtattaaacgtagtctaataacaaaacaaattatagattccgtcagaaaactgctagaggaatttattaagcctaattaatccgtcattagaaaatatttactgtagcaccacattgttaaatcataacgtaattaggcttaaaagatttgtctcacgatttacacgcaatctgtgtaattggttttatttttttccaacatttaatactccatgcatatgtccaaacattaattcgatgtgacaacgtgaaattttttgttttaggaactaaacatggcctaaataaagacaaagaagatacacatatcatatatctcgcttctataatatattcttatcatagaaaaacctagttacatgagtctaaaaatttgaatttaactaacaaatatatataacttttaaaccaagtatgtattattaccttagttaccttagcgtggcttatatatttaataatatatgaagaaacttataatagcatggcataggatagatgtaaggtaattagtatgtccacattatggacatggggtgtttgtttcgatttaggagaaaattaagaatcatactattttaccaatccctttttagttttgcgtgtcctttattttcgctattcatgttaatatctcgttacctgtctctctcctggggctaaagttaaacgaagaaaaaaaatcagatcaaaatagattaaactcaataaacaccgttgtttgatccaagtgtaggttggtttcaggcctaaaacatattgctttcagcagctttggttcgcgtccctatgtgaagcggcaaacaaaattatctcaggataaagcgacaaacaaaaatcgttaggagattagaacaatgcagaatgaaatctccggttttctttttctgttttgttatggtcttggatggagaccattcctccattgtctatgctctgattctgccctatgcccttgcactttgctggctcgcaatggagagaagaagaagataaaaaaaaaaaaggctacaaccggattattgatgccgtggaaacacggatcggaatagggaagcctgaactgggaaggcggcgccggacccgtaggagtacgtgcaggcgtgcctgcggctggaagtggtggccgtttgggctctatgttttacatctcaatcaaatctaacggtttagaatattggacccaccatattaactaaaaatcaagagatagatattaatgctatgtgatagtttgagagcgattttagattgctacgtggcggtttaggagcgtttatagcaagtttaatggacttttagtatataatagatagataaataaatagatatggataatgctaaaaagtcttataacagtagcagcagtagtctaggtgcacttcatttaggctctgttcgtttcctggagttcccaactcccccatctcattttttgcgcgcacgcttttcaaactgctaaatggtgtgttttttgcaaaaagtttatatacgaaagttgcttaaaaaaattatattgatccattttttaaaaaaaattagcaaataattaattaatcatgtgctaatggactgcttcgttttctgtaccggagggatgggttcccaactcaaccaaaagaagccttaggttggatgggaaccacccaggcgagccccatcatgcgacgtgtcattaccacaacaatgctgagcatgctgg

SEQ ID NO: 51120 - DNA, 6391 bp, Oryza sativa
atactttgcaaaacaaacatctcacaacaagaaaacaaaatttcaaaattggaaactttcttattaccaacatgcagcagcttgtatttggtgacaattcaagtacctgaattcactagtatgatgggtcttgaaatttgattctgtagttaacggtaactcatggagggttgagctatcatcagatagttgcagatgtcaatttcttacagacgcaaaaatcatcgggaatcacttttcactagactttcttcatcaggtttatttcacttgtacacccttctaccggccacgaacactgcgatacagagactcatcagaatctgaccccccaaccaatgttgtcccacgcctagagaagcacaattgctgatagctgggatccgatgttgatcaagaagtagtagcagttgaagaattagtgatgagcactttttattcgtctctagtaggtcagcaagatcaaactgatcagcccggaaggctgaagtgcagaacttgatgcctccggttccaaatgagacaaggtagagcccatgatacaccgcaacacaatgaatgccgaacaaatgcaaatgcactagaattgatgctgaaatcgtcggaatgagcatcccgtgattaaaagatatattactattggcatataaaatatggccctaaatagattggccagttaatatttttcttattgcacttacaattatttaaattgagagaaaaattatgattacccaatatttttcccaatatgtatcagccaagaagccaaagaagattcaatataggttgcttttgaatgttaaagaggtcaaaagaggaccgtaaaaatgaaatcttgaatcaacatgaccttttcgatattacctaaaatgaaaaggcatgatctccaatttccaatcttgaatcaatgctatgcttcagagcaggctggttgttaaaatccaccattgcatcacttctatattatgaaccttcatcctacatggcaagctatatatctaaagtaacaaggttgacaaattcaaaacggttggataaaacttgaatttgtcaacctggttactggttactttagatagtttgaacaagaaaaagaaaataatattcactagcttagataaaatttggaaataataaactcaatgtactgtaatgaactcaggttgacaaattcatcctacatggcattcattgaatttgtcaacctggttactttaggtctgtttaatttgatgccattttcaaccttaccaaattttggtaaagttactaaaaaagtggctacatttaatttgctgccaaattttggtaattatataagaaatcctaccagttgccaaaattttggcatttgccaaaatttggtaaggtttttttggcatcaaagtgaacaggcccttagatagattgtcaacctaaaattttttactttagatagtttgcattcatttcggttagataaaaatttcataaaattcagaaaaagaaaaaaaaactcaggtatttagtagtatactagaatttgaacaaatattcactagcttaaataaaactagatgggtggcccgcgcaattgcgcggctagcatccaaacaaaatcatatatttttagtatgattttaattaaaatttattaaatagctatctcattgtcttaagactttgaaagaccaaaacttatcatccccgtgtttttaattatatagttatttaaaagtcacaccagttgctacccattatgtcatttccttctttatttgcttgctcgatctaccactatttctatcattctccttagaacctttaaaaattggatcttatagtttatagagtttattgtcacgttggatttcgtttttataatttctagacgtcccgtcaaacgttgccattatactcctctatggcctgtccattatctcttttctttattgtcattgagattttaaaaatcgaacataattatcgtttgggttcaattttactttctaaaagtcctgccaaaccatcagcgactttgccattgaacttctctagggctcgcccgctgcctcccttctttattgtcattgagattttaaaatcgaacatgattatcattttttttttactttttagaaattccgaacctttaaaaattggaccttgtagtttttagagtttattgtcttgtgaggttttattttttataatttttagaagtctcatcaaacgatgccactatgcttctctatagcccgtccgccgcctactctttatggtcattgtgattctaaaaatcaaacatagctattgttagaattcatttttttatttcctagaagtcccgtcaaacgtcggcggctctagaactatactcctatacaccccgctgttgacgtaaaatacgaggcctgggagatctggttaactccagtacaggtccaaaactcgccttcgggtatgctagcgtgccagttgatttgatcctgtaatccacaagaaataaaaacaaagaaaccgcggttaaacctataaacgatagccgatcggctaggtgccgatgacatctcatttatctttgagccgatgtcatatgtaaatcgatcggtggttgtaaatagataataaagaactaaatctattcgatcggctgtagatatttgacggagcttggggctcctcaccgggagaccgcgcaggcccccctttgccggttcggccgggggccctgggtgagattctaagctcctagtctatgtgtggaaggttcgcgagagtggaaacacacaagacacgggcgatgtatacaggttcgggccgctgagaaacgtaataccctactcctgtgttttggtggatctgtgtatgaagaagctacaaagtgccagccagcccccgatcgttctgggatcgttcttctttctttttcttttttttctttctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggataaagcctggcatatatctgaccggaaccaatgtgccatctccaggagctaacacgccggctccggctagggacgagtgcttggaggctctcgtcctgacgggatggggcgaggcgtgcgtcagaccgcctgtcgccacctaacccacgatctgatcggtctgtgactggtcacagaccgaataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccatgtgggtgatcgtgtctgcctcaagtctctaagtcatgatactcccggtcccatgtcaccgacagtagcccccggcgttatgccagggcgatcgccctccccgagggaagcggtcgggcgtgacgccacttctaaggcctggtgataggtggggccggttcctacaggtgccgtcgaactacatcacccagagggcggtgtgaggcagctgcgatgggcccgagctggcctcgggggcggagacgagctcgggagctggggtccactccgccacaaagtcggcgagggcctggctcttgatcgcgtggcgtggttcaaagcgcaaatcgaattcagagagttcgattgcccatttcaccatccgtccagtaccctctcggttatacaagatttggccgaggggataagacgtaaccaccgtgacccgatgcgcttggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggtgcactcgtcttctgtgccgacgacctcggggtcggaggacgacaggcgcggccttcccgcagtggcctcggggccatcctgggggtcgggggcgcctggcaccgtcggacaagcaggcggagggccagctccggccgtctggggccttgggccgccgttcgactcgggggcctctcctccctgctctctctctcttcgggcagaatcccggcggtcgcaaatcgcgcgcatcagcaagggaaaaccgaccgacaataatgagcggcccctcggctcgcgtttgccttcaactccgacgaggagtgcggtgacgacggtgcggacgacagcgacggcgaggccggctacccgggcgcgtcggagtgagcccccaggcctccgccaatcttaatagcttttccttcttgttccgaggccttcgggcccccttcttgtatagactaatttaatctgcaatcaaataaagaggaaattttttgtgtcaattctatttgttgtgtgtatgagacgacgatgcctgtgccacggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcatcacgccccggggcacggctcggttctgggccccgtttggcgattttagccgacccgagcccccgagagcaggattgaacacgagtgacctatttcaagtcaagatcctttaaaaggaaacaacagcacagatacagcctttaggaaatcgaaaatgcttttattgaaatacagaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcatcgacgcagagtgatcgggcccggacgtggcgctgatggtagcgccgcaggctctgctggtagcgcgcggctcgaagggccgcgcgccaccttcgctcctccaagtagccgaggtcagggagcgtcggcttccttccttttgtcgctcacaggcctcccctttcgggtggccagcgaaacgccttcgacggcgaggacatgaccctcgtcgtcggaatgggccgacctcttcttcctcctcctgtcccgccgccctgatcgagcggcggacccgggggcggccgaagccgccacaccggaaccggagaggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaagagtggaaggacgcgggtggcaagttcattatccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggttgatccccgcgtctgtgttgatgtgacact

SEQ ID NO: 51121 - DNA, 935 bp, Oryza sativa
atttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggacgagagcctccaagcactcgtccctagccagagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccttcccatcagaaggtcattcggacggcagccatacaaatctccgtccattaatgaagagaagtcaagttggagggaagagaggatgagtccccacaaaaaagaaagagatggtgcatgtggtatccccttgaggtataaaaggaggaccttgcccacttagaagggatggatgatttttggagagaagaacgatcccagaacgatcgggggctggctggcactttgtagcttcttcatacacagatccaccaaaacacaggagtagggtattacgcttctcagcggcccgaacctgtatacatcgcccgtgtcttgtgtgtttccactctcgcgaactttccacaaaccaagagcttagaacctcacccagggcccccggccgaaccggcaaaggggggcctgcgcggtctcccggtgaggagccccacgctccgtcaagaaggcaggctagagattgatattctaagcacgacttaatagatcaaactcaactgatgcaacattaagtat

SEQ ID NO: 51122 - DNA, 2757 bp, Oryza sativa
  unsure (1)..(2757): unsure at all n locations
ttgttcttatcctcatctccgatactgatataaccaaatttggttgttaacacccgcccgctgcttctcctttttattgtcattgagattttaaaaatcaaatatgattatcaatggggtttatttttttactttctagaagtcccggccaccgccttgttcatttgcttcacggcctgcttatcgtccctccttttaatcgtcattacgattctatttggtgttttattaacagtttttatatgtcgtatcaaccgccaccactctactcctttatagttatgttgcttaatttatctcgtcatgtgttttagatggtcttttctttcagtagtctttatgtttatcaaaaattttagttatttataaattgtattcctaattgaaatcttatttttctttttctaatttcagaatttattttttcaaattttaattaatatcgtattgtgttcttttaatattcttattttttattttcaatttcatttgttttaaaattgtatttctacttgaactctcttttagtttttctaattttggatactattttatttttattttaaattttaattaatctcgtattgggttcttatatggattcttcttttaatattgctttttttaattcttaatttcagctaattttaaattgtattcctacttgaactcttattttattttcttttgctaatttcggatttatttatttttattccgaattttaattaatctcgtattggactcttattttaatatttcttattttttaattccgaatttcagttatttttaaattgtattcctacttggactctcatttccttttctaattttgtattttattttatttttatttcaaattttgattaatctcgtattgggttcttatatagaaacttatttcaatattccttatttttaattccgaatttcagctatttttaaattgtatttctacttggactctcctttcctttgctaattttggattttattttatttttattttgaattttgattaatctcatattgggttcttatatggaaacttctcccaatattgcttatttttaattccgaatttcagctatttttatattgtacttctacttggactctcctttttctttttttttctttttctccgattaatgtgggaatttctaccccccacagcgaatgtggtacctcctttcaaagctgttttaataatataactagctgggtggcccgcgcaattgcgcggctaagcacctaaacacaattataaattttttggtataattttgcttaaaatttattaaatagctatcttgttgtcgtaagactttaaaagaccaaatcttatcatctccgtatttccaactatatattaaaatttattaaatagctatcttgttgtcataggactttgaaagaccaaatcttatcatctccgtatttccagactagatagttcttaaaagtcagaccagctgctacctcttacttctgtctatccttctttatttgcttagatctaccactatttctattcattctccttgaaacctttaaaaattggatcttatagtttcgtttttataatttctagaagtcccgtcaaacgctgtcattatgctcttctacggtccgtccactgtcttttctctttattgtcattggaattttaaaaatcaaacataattactgttcgggttcatttttttactttctagaagtcccaccaaactgtcaggggctttgctattgtactcctctatggctcgtccgctgcctcccttctttattgtcattgagattttaaaatcgaccatgattatcattgtttttttactttttagaagttaccaaccttaaaaattggtagtttttagagcttattgtcttattgggtttcattttttatagtttttaaaagtcccatcaaacgatgccactatactcctcggaggcccatctgccgcctactctttattgccattgggattctcaaaatcgaacaaaactatcgttagaatttactttttattttctagaagtcccaccaaccattggcagctctgtaactatactcatatacaccccgcccgctgcttctcctttttattgtcattgaaaatttaaaaatcgatatggtatcaatcgggtttatttttttactttctagnaagtcccggcaacccgccttgcctatttgcttcacggcctgcctatcgtccctccttttaatcatcattaggattcgatttggtgttttattaacagtttttatatgtcgtattaactgccaccactctactcctttgtaggcctgctacttaatttatctcgtcaaatgttttagatggtcttatacatgcatagatcatactggcgaagatattgtaccttaaattttatttgccatgtcttataaaatacgaatatgtttaggccagggtgaccgacgggggtggagcaggatcgagcgctccccccctccccgtgcgcacgttccctggccccaccacgtgtctcaaaaaaatatttcacctggtgtactcataatgttttactatctatagatttaatgttgcagtgaattaaaatattattttgtaacaaatcacccacatattttggaaaccctctattaagaaaagtcgtttcatttatttgttccactaaaaatgtttcacctagtgtactcacaatgtttcactacgtatagatctaatgttgcagtaaacaaaacttcttttgcaacaaatc

SEQ ID NO: 51123 - DNA, 1408 bp, Oryza sativa
tatccgattaatgtgggaatttctaacccccacagcgaacgtggtgccttctttcaaggctgttttaataatataatagataatagatttggaactttcagccagtagaccatccaaccagtaaccatcataaacccaaaatttttggtccgaaattgtgaatccttgttatacttagagatgcaggatcacaattcacatcaaggtgatataatagcacctggcgagaggctggtgatgaatcagaggcctctgatcatctgctgcatccattatggcctcactgctaaagcctacaatcttaatattttggtacgtaaaccaacaatgctaagtaactcgtgacgaaggaattacacacatcccgatgtacttgtcaagcatctcctataatcatcgttctcaaagctctaaatggtactaagaaagcacctttgttgtacatgttatggagggcgtggtatgtccgaaatgaccagattcatagcaaaaggcatggcaaaaaacctgggtctgtagcctttcttgtcgattatgaaaacacattgttgccgatccgacaactaatgatgacaaagggaaatgaaagatgtatgttgaacaaactgagaatgtagggcatggtatctctgaaatgatcagattcatatcaaaggcatgaccaaaatcagcttgtgcagaatgagaaatggcaatgccaccagaaggacatgcgaaggttaacatggatgtcactttcaagaaagaaactagtgaatcaagtggtggaattaattatcgtgagagatagcaggggtctggtgttgctggcaactagcccttgcaattatgcagctctgtggtgctggctgaggcactagcctgcttagagtgactccgggtggcaatggaatggattcatacgccgcagcttctccacgccccctttgtcggttcaggcatgcagctcatgttgcgccagccatgaaaatgatggtcttgttcttagcgtctgatgagctcgcagacgccgtattcgtgaatcgtgatggagtaggcagccatggaggtgaggcagggcaaagctagggcacacaacgagagacgggggcgatgtcattggaagtgttggcacgtgctttgctcaaccaagagcgtgggggcagcagccaacctttggcctcgtacattacatcaactagatgatgccccgcgctttgctgcgggatatatgttagataatggagaaataatgaaatgatttggattgaaatattatgaaaatgatttgagaatgatgatctagcatgtgtatgtttagttttagaatgaagtaatttgttgggctttgtgtgcttaatgggttgatgcagcatgcttgaatttaggttttataagtgctaataaatacaatgcttccatgttgagc

SEQ ID NO: 51124 - DNA, 1606 bp, Oryza sativa
  unsure (1)..(1606): unsure at all n locations
acgccgatgcgctgcaggtgcgagaggccccggtcgttgccggtggcgcgccgtgccagtggcaccagcacggcgtcgtagacggggacccagatgaggacggcgacgacgttgaaggtggcgagcgaggccggcggcacggtgaaggggccgacgcggccgtccatggccgcgctctgctcgatcagcgtcgacgacatctgtgcggtcaccacgaagaagacgagcagcgaagcccacaccgggaacacccggagcagcatcttgagctcctccacctgcgacaccgtgcacagcctccatgggtccggttgcaccggcgagttgtcgtcggagtcggacgggatggcagctttgtccaagaacctggacaccatgcggagagggagggcaggggattatgttttctttgagattagattttcgagaatttgaaaatagtgggcccattgtttggttcataattcttagacattttagataaggttgagattaaatttttatatctttgacattcaataactttaaattatttgtcttacaaagtactataataaaaggaaaatatatttatttattgtatgtattataagagaaaaacatagttacatatatattttgtaaatcgtgttaatatcaaaaatatcaagaagtattatggaacaggccaagggagtaataacttttaagatagcaaataacctttacaaaaattagaattggaaaatcattaattaacatctgttaattaagtggtatattatcaaagtaatctatagagtggcaaatagttagaacatgcctggcaggggtttaagctcatctggatccttatccggtagagctgaagcccatattccttttctttaagagcagagcaggtgaatctaatttataaaacattttaaaatgatggagttaacttttcctaggtccacaactctagatccatttcagattttggagctcttcgaacatgctgttaattaccccatatgtcgcatggcaaatcgcctcaagaaagaacaaggaattattctctgagagtaaattagaaaccgatgtatccttaagtttttggttgcattggtgtttttaggtgttaagtgtagctttgaggaatgatcttgagaagtttgtaggatggtgttttccgtgtgatccctttcttggtaactcttatcaatgaaatgagacaaagttctgcttttgttttcaaaaataaactgttgatatctcttgaagcaatcgacgaaggtgaattccacatataggaaattttagtccacaaaacgcgacagatttttcttggtaggcgtggtataattataagctcaatgatcgttcaataaattgttattagaagattcctgcttagtttaaggttcaacacatactctaaacatagttgcacaaaatgccactcatatcataagagtgatggtgaaaaatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 51125 - DNA, 739 bp, Oryza sativa
atccacgattctcaggactgtaagcttgtgaggcagagttgttggacaagaggaaaatagccacagcagggtcggcacaatggaaggctccattactgacgccaaactacctcttcttcctctcctcaatggcacaccttctctgcaggtaaccattgctaacctttcatgcatgtctctgctttcatcttagttttctacttttcttctgggcgagggtaaaaaaaatcgtttgtttgtttgagaattgagacggatggttaaacatacctcctcagttgcatgcattgatttatatttcatatgagaaagttgaactttgttggtgagatttttctttgatttcctttttcttggcagatctagttgtttttaacaaaaaaacaagagaatgaaaggatggttttgtacttttgggaagggcaagggcagccgttcgtttttataactcattcctactttcctaggatcgatgtgatggtccggaacattattttaaaaccttgtttttggcttatattctgattttttatgtttgtatttcagaatattataactcacacgtttatacagaaagtttcaaattatttatggtatgtactgattctgctaagaaaaatttggagcagacgcagaattaaagctgcgagcttatatgtgctatcgatatatgctggcattccggaataaacaaaactcctttatgtataaaaaaacatatttgttggcatattcaaag

SEQ ID NO: 51126 - DNA, 1020 bp, Oryza sativa
tgctcaatcagagatagaggccaataataacacactgccatcttgacatttatactctttttcgtcatcattttctaaaattaaattgttgtcactcttttttgatctcttgccaacttactggggatgcaagaaaatgcagattttgtatggaaatctaggccaatggaggcactttaacctactacctccattccaaaataagttaagctagtacgggaagtgacatatcctagtagttatatcgcactactgtgaatctggataggatatatcatattccgtactagattaacttattctgagacgaaggtaatatatttcattttgcatttctgaaaagcaacacggccatattttaccaaaatttaatcacagatgggaaacggagatgactggaaacccaaaataatttcaactttctttgtgtgatgaacaattggcatatgagattattggttttcatatttagagattattggtgaagtggttttgaagatgattggattttcaggtgatgaataggtgctgctgattgtcaggtccggtcagactgggcaagtgctgccggtcagaccggaggtatgtgaatggtcggaccggcctgcccacggtttgtccggcggactctgtatcagtttcggttttggtttcgggctgtttctttggatatccgtggatagttcatgtttatagcttctatatggatactatgagtatgtaatactgttgtttgctaacaatgagtcaagttagagatagcttggtctcagaatatggtttctttgtttgattcatgtgtaggtgacttgatgcctcaggagagtattgccggtgatggatcgggagtcaacttggagataaggtgacgtccggatggtcaaatatcatgcggaatacttaggctaaagatcaatgcacatggttggtgaagattccatatgacatacgatggagatattgtgtgcgttgcggagtcaaatttggaaggagtctaaatttggtacaattggagtttgt

SEQ ID NO: 51127 - DNA, 2085 bp, Oryza sativa
ttttacagctataaattaagaaaagcaatagtacttactcaacgaattcgaaggataccaaaactacaacactactttaaaaaatgtctatagatgcaggtttaggaaccgcctgatctgacggaggagacggtgtgagcgccgcagccgcagccttccatcccgccgcctcccctgtggctggatttggaggaggggagggcgcggatgccgccggcctccactgccgtctccaccgggccaccgttgcctcctcggccggaccgccgccgaggtccgctacctctcccctgtaacaccccaggtaaccacgtacctagagtgccacaccaaaatatattcaaaaccattaactttcaaaattattagaaatttcagcagagtctcccctataaatacggacatccacgataggcagttataagataaatcaataacgaaataattcatactttccaaaccatcctagttccataaattccacataaaaatacgaaccagaactttaattgacctttacaagttctacgcaaaacttatactaagcagaatcataatctaaaacaaaatttcaatagtacaataaaatgtgtaatccaagggagctacttcttgcccatgcatgctgatctcaatgtgtacctaaaagcaaataaacacgagtgagtacggaaatactcaacaagtatattatggaactagaagacacgcatacacatcatgcgtaataaagcctgaacataaaactttcttttttggaaaagagtcacatttcaaacaccaagttaaaggcagtcgtagttcccattccaggcaaacatgaattaaaatagtagtttccatctcggacaagtgtgaatacatccgagcattttgccggcaaagccgagtaagcgtgattagcgcttacccacaggaatatgagtaaaaaccatatagcacatccatgactcacatggaacataaataattgaaactagaacaaagaaccaaattaaaaccatattgcacatccatggtaagcatggaacttgaactatttaaccaaaacctgaatctggaatattgaaacaagaataacgtcgtaaacataagataaagcttgaaatctaaatagcattaacaataatctgaacatatgcaatcccatatcacacaaaaatatattgaaaataaatagatagagcaaacactcagagaatcacacaagtagttcgtcatgcactcgccttttaacctcgacggcaacccgacgaaaccccttccacaccagatctctccacacccgtggagtaaaactacgcataaaccaatatattgaactaataatagttataagagatatttactaaaatcgaaaccacatataaactatttaccgatttatattaaacaacctatagcagttccattactgttttatgcgtaactctcataccgtctaacggaatctggcaaataatacaacttcgatcatctaaaaaaaattttctgcaactttcatgttgggagaaaaatcagattaagtctttgtaaatcccagattaagaaaaatgaattgttgtcccggtttttggacccggtcagcagtactgtttctattgtttctcctaaaccgtttatcggaatcgagcgaaaccagcgacgttaaaaagatatagacgatgactacaaactttatttaggacaactaacctgaatcccgatagtttaacaccagatttgaaaatactattgtcagcctataatcagcaagtaagaaaatactcaaccaacgatttaatcgattcccacgtgaaaattgtattttttttggactaataggagttaaccttgcagaggagaaaatcaaatttgaggtcaatctgtgaaaacccagaaaatccccaacttttgcctctcttccctttttccttcttttctcctcctgctttccctgctttctgaaactcctcctctctgttcgttgtagaagcacagcagtagaccagcagcagcaacagcagcaacagcgaggaacgttagcagaaacagccacaacatggaaacatattagatcggtggcagcagcagcagcagcaagga

SEQ ID NO: 51128 - DNA, 3048 bp, Oryza sativa
cttgtttggacttcgattaatctaaacttatactctattttgcactatcggcgagctttacgcatccacggttcctaatcgcctatttgaacaacggtttaaaattttaacttttgggcgtttgttctaatatttcccgaaatacaataattcgatactcggggtatcaccccccccccccccccccgggcggatctggcagaggggagagcgcggtcgctgccgagattggtgagagagacggagatattagatatggacaggaggatggataagatcgagagatggatatggcggctcgctggctcggctcagtataggtagcattttttttaaaaaaaaccgacacctataatagattataggtgccagttttttctttaaaaccggcgtctattgcttaatggtgccggttttatgtgtttttagtctgcggatgaggggaaagaactatatatgacagttttaactgttccaacacctatagtgtcaatctctatgagcttttttaagtagtgcaactacatatgttgatagaggaatgtacagtgaactctagaccggtaagagaatcgatcttgaccatccatcctttctcatttagatccatttgttccaaatataaacatttctaaagtttttcattgagattaaggtgaagggataaattaaattaaacagaaaagggttttgattggttgagatatgatgatgaaatatatagttgcagaagttgctatatttagagataaactatatatgctagctagaagttgttatatgtatatttttttattacggagggagtatctataacattgccacccaattactgttagattatcagttttataatagaattcctaaattaatggttaaaatcatttttactgtgaattaatggtgacaataccggtagtattctactattagtcaagaccatggtaggttagaggaattgaaggcatgcttcactacgccagaccaagtcatctctgacgggcccaaaccctaacctttaacgggtttggtcttggtcagtgattagtggtcacttatgacaaaatcacctgtgatgggtgaaacacccgtcatagataactcatctctgaccggtatataagtcatctctgacgggttaaaacttgtcacccgtcacagatgtgtcatcagtgacgtgtcgtaactacctgaccgtcactgatgactaatctctgacgggttgtaacttacgacccgtcactgatgacaaagcaagaaatacaatttttgaattttaaacgcaacaaaaaaacctcaaaaaaatattttgaattttactagccatcctatacatggttacacatcactacccacaaattcacaatttttcacgcaatataacttgcatgctaaactatacatggttacacatcactacctacaaattcacaatttttcacgcaaatataacttgcatgctaaacgtgagattcaaactcaagacctcaacctccatagagagctcccttaccaactcacctactcaacacatattgactactcacccaatgttattattttgtctatgcttgtctgaatcatttaacatatatttaacaccctaaatgacttcaaatgaaagtattatcaactaaatagttatagatctcattgtgttttataacttttacatagaaaatatcttcatccgatgttgtttgaagaattcaaaatttcatttttcaaaatagatttcactttataacatgtattttgaacatgtaaactttgtcaaatgaaaatattttcaattataatgttgtagatctggttgagttctataactttgatatggggcatgtatccatccatgtcatttgaaaaatactcaaaaaaaaatttttaaacgtaagatctcatcacttgtaatgcatgttcggcgatgtaaacgatctctaatagaaatattgttagttataaagttgtggatatcattgagagctacaacttttatataggacatgtctcaatccgaggtgttttgtaaaatttaaaaatttgaattttcactcatcactgacgggtcataactaccacccgtcagagataacgttatatgtgacgtgtgttagttaaagacccgtcagagatgagtggtctcttttgtgatggttcataatactacacctgtcacagatggcatatcatccgtgacaagccatggttttctatgacgggttacaagtgtaagccatcacagatgacttcacatctgtgacaggtcctccatagtagccatatattgaagaggatatttttttggcccatcagagatgactcatctttgacgagttgcgttggcctgttacagataacccgtcactgaagcccggatttttagtagtgcttgtagctagacacccatttttaacatgcatgcatgtattatcccattatagctggccatattttcccacacaagaactttttgttggattttgtcggctataaaaattatatctgccaaacttcatgcttccaagatagactttacaaaatgattgatcgaagcaaacgccatgcaaaaatttcgtcaaattaaaacaaattaaacagaatacaaataccatgcgtttgaattattagagcacatcgtcaacattgcaatcattaaatattcaaaatagagcatatatatagaatcttctttggaaggcaacattgtaaacacctctctttcactcggcgacctatagttgaacgagtctgcacatgtaaacgtaggaacatgtatgttgacacgtacgattaaatatttggccaacaatctctttcatggaactagtgttaattagtgcaccctgcattaatgacatgtgtatgtatatactaaatctatccatgtgcgtgcgtggtgcacgacagcacacacagccacaaaccaagtataatgataaaattagataataaatcgcgtacttagttctccattaaatttatatctctaattaagcacgtacttagttgccctttaaatttagtttcccacaggaagacggacacaca

SEQ ID NO: 51129 - DNA, 762 bp, Oryza sativa
ccgttagtccatcttggagaatagcgtctgtcgggccggcgaggatggcgggattccttaccgttgtctgagcccttgtggtggcgccgtggcaacaaagtggtgacgcggggaaaagcggcggtttcaccggctaggagaggagggggaaggcgtgcgacggccggtgatgggcacggtggcccggccatggtggcgcggcgcctggtagcggcgttgccgctttgccccccggggaaaagggagatggagccgggctcgggaggaggagtgttagacttctccttccgctagcctgggagaggaggaaagaaaaaaaaattgggctgttagggaggcaaagtggactttttccagagagggtgaatttggtcgaggaggctgagtttaggggaggtaaacatagttttatagagtaaaacatatttcacaaaggaacaatctttttaaaataagcttttcgagaataaatgaattttaggtttttaacaaggacatggcactggaataggaagaaaatttcgaattggcaaatccagcatgatgcaaatttttcgcaaagtttttggggatgagtttttgagttctcggattttatttgcgaatttttcaggatgttacagttaggtactcctaccaatgttgaacgttttgctagcacagtactactagcagtactcaaatgatttggttgtcaatattctgcaaacacaacagatgaaactgtagagatagttgcaatcttcaggggctgcaggaatt

SEQ ID NO: 51130 - DNA, 748 bp, Oryza sativa
atccaaaaaaatcataattagttatagttcgattttccgtaaagatgatatgggtatgtattaagaactagtggaggcaggcatattgatcgggggtgtaattaattatttctcgatagatagcgaaatcgaggcacatttatgtatactagcgctgtaccaggctaccagtgctcaacgcgtaccgtctagaaatgtgacaagcgatcgaatgtgtcatacgaacaaccgattaaaatctgacgctgctgaccaacaacctacaatcatcgaattaattctgagaattctaagaatcagccagtttgaggagctgtttgaggagtttaaaattctcagaattagctggttggtaaccggcttatgagaatcggaaaaagctagatttttcagcttcttgcttttagtttatttttttcattctacaattttctagaatctggacctgaagcaagattgtttggagaaaacttttgattctggaaaaaaatgaagcagctaaaagccctctaaacacctttgcgaagcaccttgtgtatcgcgtacacacacgtgtgtgtatacgtatgcatatgctggctagctaccatacaaacatatatacttttaaaaaataaaaatttccatattagttatttatcagttatctattttatttcttttttttcagtcatctaaatttgcacaacacgatgtttttttttctcgtttatcactcaactaaacctgcaaaatgtaaatctagctt

SEQ ID NO: 51131 - DNA, 1008 bp, Oryza sativa
cataacacacatcgtctcaatcgccttgtgaaaagtactaagaaatttactatcttttcaacacactgaagctcagttaattaacaaccctgcagttcttgcgaatctggccgtcgtcaccggtgagtgggctgatgttgcccatcttcaccatggatctgccaaaatcccagaagaacttgtgggcatctgcgctgtaagtctccaccagctccttggtgttggcgatgccgtcgtcgctggagaagaggccctggtcggaggacaggaggcctttctgattgaggaggttctggtagtagcggttgtcgaaaacgtaggcggaggtgatgtccagcacggtggtctcgttgccgtctccaccggcacagaggctctggaggttggcggccatggtggcgtccagcgtcgggtcggctgagcttgaggtggtcgacaaccggttgctgaacagcgtgcaccgggctcgtccgatcgtgtgccctcctattgatgatcaatgagtttcagatttccagatcatttaaaagtttatgaaatcttgaaatgtgcaacagatcattttataattgatcaaatattatctctgacggtttccaagtttttactgtagacagtatgaaaattcggaactgacagagagcatatgttccctgaaacatgggctgccactgtacagtttcaggaagtactacagtgtaggaagaggttatcttagcatataaaccagattctgaaccattcgtgcaccatgagatggattgatcactagtgtgctacctgataggacgacaacatcggttgtgtcgaggccgacatcattgaacttctgtatgatcgatttgatgggttcgaacggtgaagggaggccgttgtcagctcctgattgatttgcgacaagaccatcccttctaccgagaagaacgtcatagtaagggcctccactctgaacaaatgatgaaattttagcatacttgagattttcaaacaaagatgtacagtatcaga

SEQ ID NO: 51132 - DNA, 6605 bp, Oryza sativa
ccgtccagaaggatggaaccgtcacacccctgaaatgcacaacaaattttcagtaattgtgacacaactagtcaatttaatatgtatgtagaacattcagataaagttcagagatgtgtgaaaagggtagttaatgtatacattgacaaagcagtcatggaaatggagccttaggagggaggcacccatcctcatctcagtcctcatggcagcataaacatgctgctggacaacggtgtacacatcaggacatatgtagtcgtagaaatcgtcggataactggcatctcgcaccccgagtattaaggcacagtacaagaacagagcatacaagcatgaacctgtagctgtaagagtactccatctctcacagaagttactgccctgctcttgtgctggttgcacagtccatgttttcttgccatgttcttataggcggttaaagcgatagatcgatgaattatactatttccgataggcgaagtcggcatgatagtgggcggctgcgcatgcactggtctgatgctgctaactagttttctatccagatattccactttctgaaaatggctactggagcctggttctcctttctgctctgcaatggtgaagtcactaactagtgtaatggagctgcacttagcatccttgcttcctagtgctaaccagctttttgtatcaaatccaaagtggtagtgggtgttccaaccagctgagaaggaattttaacgtatcgatcgcagtttcgtgtttgatttgggtattgcagatgtctgaagcatgataagataagtggattgttcacttgttcagttaagtagtggcaacggtggcatgtttgcaatgtggggaaattcatctggcctatcaaaagattcagatgaggcttaaagtgcattggtgctgcatacgagttgtctctgcattaccaattgagtccagtgcaatgatgtaatcatgcattaattcatgcagataaagcttcttcagagtcaaactgattttttttagataatggattaaactggcctctacacccagaaaaggatgtacacagcccaaatgccatcctaatcaataagcactacagcgaatgactgattgattcaaatccatgaccgagcagaaactcaaatttatctcctttgctgaaaggtacaggttttcttgtacacgctcgtactgaaaaataaaagtagcaaacaatagatcaactctttcacttgtttacaatagaaccaaactgaactaacaattttgtcttcaaatctttacataatggaagaatctattactcttcaaattaatggcatcctaatcgaaaagcattacagagaaatgattgatcgagagtcatgtgagataagaaattcggatgcacgttggtttagtttcttttctttatttacatgttatctgtcttgcaattttgccggttttgctacagtcaacgtggtcgccatttgagctgtaattctttactcccagtgaattcacagagctcttgatttctattccaaaaataacaatgagaaaacataaattttcccgtgtacagaaactaaagaacacatgagctgattacaatttacagattcacaattcgatcagcaattctcaattaattgattgaatccttgtacttgtatcgctttgcgcagcagatgaacacgacgaggttgatcgagctgaggccggcgacgagccagaagaagcggtcgaggtggccgtcgtcgatgtcgtcggcgatccaccccggcgagccgcccctcgcggtggcatgggacacgacggtgacgacgacggagctgaggtagctgccgagcgagcacgtcatgtggccgagcgccgagcagaggctcctcatggagtccggcgcctggttgtagaagaactccagctgcccgatgtgggccaacaccgcgctggcgccgagcagcacgtattgcggcacctgccacgcgatgctcacctcgccggcggccgccagtcgcctgccctcgacggtcgccgcggcggccatggcggcgacggatagcgccatgccggcgccgatgcgctgcagctcggtcagccccctctcgctgccggtgagccgccgcgccgcgggcaccaccgcggcgtcgtagagcggcacgaggacgagcatggcagcggcgtagacggagttgagcgacgccgccgggacggcgaacgcgaccccgaggcggcggcgcatggcgcggccctgcaccgggaagagcggctgctggacgagcaccatgcagtagacgatcccggtggcccacaccggcagcatccgcacgatcgccttcagctcctccacctgcgtcaccgtgcacagcctccacggctgcgccgccgccgacgacggcaccgccaccgccaccgccgccttgtccaagaaactgaactggtcggtgtgcgccatcctccgcccctcctctgccggaccatcgtagaggacgaagccgtcgtgaggcagcacgacgttcctcttcctgacggcggcgacgacgacctggcaagctcggaccacctggctgccacgaggctggtggtacctgtacatggcggagccgaggaggaagctggccatggcgaggacggtgcagagggccgggacgccgaagccgaggagccagccgaagttgtcctgcagccacaccacggcggagccggagacgagggcgccgacgtacatggcgaagtagaaccagttgaagtaggagctcttcttgggcctctccatggcgtcgccgccgtcgaactggtcggcgccgaatggccccacgcaggacttgatgcagccggcgccgatggccatgaggtacagccccagggagaagacggccggctgggtgctccggctgatgaccgccggcgacgcccccgacagcgccatcgttcccatcccctgcaatcagtgcatcgatgatcgatcacaagagaagatttcaaattcgtttgaaatttgtcagaaatcattggtcaatctctttttgttgccgtaacaaaaaattgtttaatccattgccggttatcaaaatgcctagtaagttgctacagtattatcgaaatcggtagtgggtttttttattctactctggatagcatagttattatagacttactttggttatagaatctatatgtcatttctattcaatacttcgacttatttttattgtagtatctatgtgatttctattcgatacttcagatatccaccattatattatgagggagatgaatcccataacttcaatcggagcttacttttagaactcatctgtgtgaaacattttcataatcaatattttataatgaacaattagcattgcaaatcatttatttgatgaaaattagcgtggacgttggtataagtgcatgtcactcgtgtaggccatgttgcggtatttgtgccctgaaacgattgttttgtctgatcgcgtggaggtgattcgagatcaaaccttaatcgatggcaagaaccgggactacgctgcaggaggacccgaggcttagcatggactacatgtcatgtaacaagatcgtactagagtcaggattcttgaggtcaacatcagtcataggtaggattattggaagtaaacttaggaagcaatggaggtcgtgatgagattggataaggtgtcacatggtgaatggacaccgtgcgagaagtctttgtaaatggcttttgcatgtcgtgcggtgtaagtgcatgtggttgcggagaatgttggaagaaagaagggcatccagttgcatggcagctacagtaaatggagtactgtagctaaatatacatactctctctaatattataagttgtttgacttttttctagtcaaattttgttatgttttaccaagtttatataaaaatttaataacatataaaatatcaaattagtttcattaaatttaaccttgaatatattttgataatatgtttgttttgtattgaaaatactactatatttttcaataaatttggtcaggaaaaatttctatcaacttataatataaaacggagagagtacgtaatgtggatggatggcatggtacattttttgggagagcaaattaagatgtgaactattgtcattgttaaagaaagttgtgtgaaatcaacaagaatgattaaatcaagcttacgatgatgtagatggagaagaaggcgaggatggtgcggtatcggccgaggcaggagtcggcgacgatggcaccggcgaggggagcgatgtagcaggtgccctgccacatgctgaagttcctggctgcttctgcatttccctgccgcaattgcgtcgtcaggaatgtcaccaggctgtactgcaccccgaagaacgccaactgccccaagcattccgtccctgatgaattcatatttcacaacaaaccgaatttcaatatgcaacttattacatgaacctgcagatcgatgcaactggtataagacaggttgaaatgggaatagaagataaggaaaattggtgaaaaccatgtagcatctgtaagaattcagaacatggagaaactgaacaggcagcatggccggatccgtactaccaatttcaagaaactaagtgagctaaatggtatatttcaaaatgccattttttttattttaatagcacaagtatcatttttttttcatgtaaggtgttgtatgtttaccaagaacgaaagcacatgccctccagcaaccagtagagtgtttggatgcaggattccctttgacatcaacagatccatctcctgtgtgctggcttagtttaccctgcagcaactgaacaattgttacctacgtgccactctgtaaattcttcatgtctgttcatccctagctgtcactatatagtagcatccatatcagtaaatttatatatatatatatttcaagaatttttctacaacaaaataaaataaactgttggggcacaaacatatcttctttctttgttttttttttgacaggagagaaaagcactgaactcaacgtaaccatgaacacaactttgtgacagtttggacttgggatccattctccttggaaaaaaaaaggataagtagggccgtttttaattcatacaaaaattactatgccctaccattttttttaaaaaaagaggaaatgtggtagcttcaattgaagccaaataatgtggtaccagtttcttcaccgtagtattaatatttgacttcattattgatctaactttacctacccaaaatttgtcactaccaaaaatttctggtagggctttaaaaccaaaatggcccgtcataattacttcaacatattcctcattttttgatgtgtattattccttttcacgagcataggtaaatttgtagcataccaataatattctttttagagtatttattttttattacacggtgacatatagggaagaaaacggtcagaaaatagcctcaaccatttcaataactttttttctttctgtacaacatagtcaaaaacagtaaaaattagaaatgagaacggtatctagaatatcaaaaaaatcagaaacgaacgaggacagggataaatcccaaacctcactgaattactgttgggagcacagatatatgtgtataatatttatggacaccttgattgacacgtgactttgccgtcattctactatttctttacattttcttcctcaagaactgtaaaagctgaactcaaatactctgaattacaatttgaattgtgcaggtagatttattttttcgtaaacgtgggaaaagaaaggaattaaccacatttctttggcacaaagaaatttatgttaagtgaaaagtcatctgaatattttttggaaataaaataggaaaagtgaaataaaaagaacagtgtagaaagagaagttgttcattagaaagcagaagcaggcagtcacctcattgttaagccctgcttcatctgccaaagcacccggtttgtttgtgtccatgtgtcttatcaagtgctgtatgaatgttgtctgtaaatgcacaatgcaacacaagcacacatgatgcatccatatatatactcaataatatataagcaagagaccataaaaaaaacaatgctattaagtctataaccaagagtaatgactctttccaaaaataaacaagaatgatgttgtacaggaggttacagcttcgaaggatcatgctaatgatcctcatgattgatcacctgaggacctgaaacacacgagatcgaattattgggttatttatgatactattagacttgttcacctcataattttttttctgatggaattgttcacctcatcattgatcacatagttaattaagctacacgtattgagatattcttgatcgagcttgttacaaccttgcagttttaagtagtgttcgaactgaattatgcaatatccttatcccaatcaagattttccttccccatggagaaaagtagcaaaaaatattgcagaaaacttcttgttgctgatgacataaacatatatgcaattgcaaaggctttcatctagaagatttaaccaacttgaggatatgtctgtctcaaaatgtgttgtgttgcagcactcgatattttggagacgac

SEQ ID NO: 51133 - DNA, 8737 bp, Oryza sativa
ggacagtgagggccccgcggatgtccgaaacccaggagttgttcgccaggccagaagcaaccgtgcgcgaacggaggcgctgtggcacagcgaagaggaggtcaggagccaaggaggccactgagcggctccatcaatccaatggtcagtctagaagagcatagattcaccattccccggcatgaagaaggtggacgcctcgaacatgtcggagacagactgctcgaccggggccttcaagccatcccaatagagatgcccggaacgctaaagccaaagccagcgaacgcgcagggcgaaccctgccaacctgaggttaggaattcctaacccaccgaaggccttaggacgacagacattcgtccaggacacctggcactgtcccccatgaaccgcatctgtacccgtccacaagaagacgcgtcgcttcttgtcaatagccttaacaacccaggcaggaaggccgattgccatagacacatggactggtatggaggagagaacagactggaccagcacagagccaccagcaagagtggtgagacgccccttcgaaggtggtaggcgatgagcgaccctgtccaccagtggctgaagagccgcctttggcaacttgcgaacggacagcggaatgccgaggtaggtgcaaggaaaatcagaaatcgagcaggggaagcaagagtgaaccagctccaggtcctcatccgagcagcggatcggagtaatcgagcatttggcaaaattggtgcgcagcccggatgccgcaccaaagaccgagagaatgccctggatgaactcgagatcctgccgaaccggggagaggaagaggaccaagtcatcagcgtagagggaggcgcggtgtctcaaagcgcgatcattaagcggatcatgaaatttgtcttatagttgtttcatctagtaagatcaaatcaaagaaactagcacaatgtttcttaatcatgttattcagaaacaatgagaaatattgaagggcattggaaaaatgttatttagtactcctttgaattgaaggggttctttgtttggattgaacggtttttggaggataattggatgattccatttcctatagaatttgccactattgattcatttggaattaatgaaggaatggggcatagaaaaagtggaggaaatctatctttgccatcgattccatagaaaattcataggaattttatatccattgggacctcttttattgatttcctttgagaagcccaggacaaatcaatgtttgcacctccaaatgaacatagtttagacacatcttgaacatataaaatatatattatgcacagttagcaggaattgataagtattaattgtttgttcggccagattatgttggactaattggggtaattaagtagaacaagtggattatgttatagcactgttttcatgggtaaatatattctcccgcatcaattagctaagatgatatctcttttagataatgagctaattaagaggatctgaccggaaaaaaaaacagttgaattaaaaactctaagcctagttgttccgtgtataaatatatgcatgaactggtcatttgagtatcatatatatagagcacgatttaattaatcacgttaaatatcgggtcgtgttttttatgcgtgttgtcttctaattttgtcacattaagcagctgggctatcattattctattttttctttcctttttccacaaaatgaggaaaaggatgaaatatacaatccattgatcaagcaaggacgcatttgcaaacgaccatgcctacaatctacaaagatcatataaagccagaaggtttcatcgtgtttatctatcttgcacatgtgaatccaaaatttggaataattcagaatgcagaatatggagataccctcataatagatgttgaaatatcttttcgcatgatttactctttcaattccgtccacttttactaacctagctagacttattctaatttcagataatcaaactttatacagtttgccaataattatatgtatagtagtatttagtacctacaagctataccaaattaataatagatcatatatctgattcacacaaactatatatactgaatttatcgtactctaagatacatattgcaaatcagaaatcacccatctgagcagttctttacatttttctcttttccaaaatatctttgcatattccaaagggtcatgaatttagtgcaaaacccaaaagaaccatctagtttgaaaataataagatataaacactgatacgtttgttttgcctttacggtagtctttgttggtagtagaagccaacctagacattcatcttctctaatctaatggattgtatatatttataacgggaaggctaaatggctgtcgaatgatttttgatagctaaatcattcatgttttaatatattcagaaccgttgtttcatatgttgtagtaaaatattacatgaggtgatttgattgtgtttcagtcttttaaaagattgaaacattttcgatctacttggtaaaacaacgctcgattggcttcgaaatttgcatgatggaagcctaaaaaatcatgcgaatcccatataaactttttctcgatgtactcggatttgtttcatgttttaatatatttagaaccatagtttcatatgttatgttgtagcaaaaagtttcatggggtgatttgattgtgttccagctttttaaaaagattgaaacattttcaatctacttggtgaaacattttcgctctacttgatgaaacactgcatgatggaagcctaaaaaatcatgtgaatcccatatagacagctatttataacgcacattacaattacaagaactaaatggggtttatgcagatttttgctaaccatagatgaaggtttaggaataggtcatcatttgtgcctgtaggctggtgtaggctggtgtttcagttagttctcttgttttccatcaaattgcgttgtgcaattcacaatcgttttaatgcaaacttcgtaataatttggttgtaacttattcagagcaaagactggaatggttcttccattatctaaaatgtagaattcataaatcaacaattaggatcacttttactagtgataataagcaaaggtacatgaaattggttttttagaatattacagaaattagaaaatggcaaagtatttattgttgtcctgctgttaattaaaaaaccgacgtttaaacatctaaaaaaacctccgatgaggtttacacatatcacaaatagcacatttataattgattcaaccctacactacataggcacttccaaggcaattttattactaggactaattaattaattagctgaaaacacacatacacaaaaagaaataaaaagtcaagtggtaggcagcttgcgtttgtaggtggcagcgcagcagacgaaggcgatgaggttgatgagctgcaacgccgccatcaaccagaagaatcgatcgagatgtccctcgttcagattctccgggatccatccgccatggccgccgccgccgccggtgacggagctgatgatggtgagcatggcggagaggaggtagctcccgggggtgaccatgatgagcgagcacgcctggcacaagctcctcatggcgtcggggctctgctcgtacgcgaactcgatgtacccaacgacgccgaacaccttcgccaccccgacgagcacgtactgcggcgcctgccacaggatgctcaccgccggagcatccgcctccacgctgcggaggcgcgccgtctcaacggccgcggcggcggcgagcgcgagaacggcgaagaccattccgacgccgatgcggtgcagctcggagaggccgcgcttgacgccggtgagcctgctcaccgccggcatgaggaccctgtcgtatgtcggcgcgaggacgaggatgcagacgcaggtgaaggtcgtcagcgacgccggtggcaaggcgaaggcggcggcgacgtggttgtccatggcgcctccctgctcgacgaacagcgggaagcaggcctcggcggtgttgaagattactccggtgaggaagatggggagcatcctcgcaaagatcttgagctcctccacctgcgtcaccgtgcacagcttccatggacgactagctgatgcttcatcggatgcagtgatagtggcagctcggtcaaagaacctaattgcaacaattagtgataaaaattcatcaaatttgatcttgtgttttcagttcactgaacaactcaatataggtacggtgaagattaataagtgatcaccatctgtaattttgtaagctgaaagtatgacttttagcaggattctacatttcggatttaaatttccagtttccatgctattgcattctaagatttagaaaattttgtcgaaattttgttaaacgacacctgccgttagcccgttacggcagatgatgcataatgaattgagatcagaaattgatcagaattggcagaatttagtttacctgagtccatcagtgtgcatcagcttcctgctgccaacaatggcagactccttccctggcatctcatagagcagagagctgtcacttggcacgtccacgtggaccttgcgaaacgccgccacgacaacctggcagatcctagtaagcgcgctaccgccgggtttctggtacctgtaaaacctcatactcgcaaggaatccgacaacgccgatgaccgagaacagtgtagggatcccaaaacccagtccccaaccacagttatcctgaacccacactataaccgtgctcgcgacgaagaacccgccattgacagcgaagtagtaccagttgtagaagagctccttctgcgccttctctgaaacgtcggtgtcgtcgaactgatcggctccgaatgtcggcacacatggccatatgccacccaagcccagagctgtcatgtagaggccaagagaggacaatgcctcctgaggaaaggttgccattgatctgtgcatgtttggtggaaccactgctgaaagtgtgagtagaaccattccctgaaaatgtacagtacataacacaaatgttcagacaacttaactgatattcagacaactttgctcgtattcagaaaaatatgaaaatgttgtgatctcttacaaaggtaaaggtggtcagggagacgacgattgtgcggtgccttccccaataggagtctgcgaggaacgcgccgagtattgtggtgaggtagcagttaccctgccaagcagcgatgttgctagcagcagtgacattgctctgtccctgtaccttggtcaggtagctcaccaggttggtccctactgcgtagtacgccaatgcgccgcaaaattcgccacctacatacaccgtgccaagaacatgttcttcactagttcaaaatgaacactgaaatgtgattgatgaacactgagatgttgggcagtgtgtgttattcaacctagaatagagtagcatgccttccatttcccagtgtgtgttttagatgctggattgcctttgacatcaactgatccattgcctgtgtatggacttcctcctgcaaccaagcacaagcatttgattactcctacatttgattgttaggacacctcatcagatgagcaaaagagatcatagaatgaaaagaagttgcaatggtgaattttccaggcaaatcaaggaaatcaaagaaaatgttagcaaccggctggcagccaaactccccgtccatccactgccgctgctcctcatttgccatgctctgctcgatcgccggcgacgaagcggacagtaagttttaaggagctcccacgatagcattaacaagaagcacttgccatgtcatttggcacggaaattcgtatcgttagaatataaaaagcaaactgcttgtgcgacacgatcgacagttgcagcctttgcagcagagattaaggttgattaagtacacttaataggtcgcgtgaaggttattgaagtgtaatgagtcatcgtactcaactttcagcacgccgactttcagggatcctagcaacttttgtgtcgaagtagttggacggcccgcgcaattgcgcggctagcatcaatgtaaaattatatatttttacacatgattttatttaaaattattatccccgtgactctaataattttatagtttttaaaagctatggcagtcgctaccccttacttctttggcacatttttatttgcttacccgatttaccactacttctattaatcctttttagaactttaaaaattaggccatatagtttttagagttcagtgtcttgttgggtttcgttttcataatttttagaagtatcgtcaaacatcgccaatttactattctatggcccgtctgctgacacctctctttattgtcattgggattttaaaaatcgaacacaaatattgtttgtgttcttttttactttctataagtttcaccaaatcgttagtagcttcgccactatacttctctatatcctacccgctactttccctccttattgtcattgagattttaaaaatcgagcatgattatcaattggttttatttttactcttcataagtaccgccaaccgtcgtgaccatgttgcttaacggcacacccatcgtcatttctcttaatcattattggggttctatttggggttttgtttataggttttagatatcccatcaaccgccagcactctactcctttacaagcctattgcttctcccctctttattgtcatttgttatcgttctgttctagatggactgttttttttaaacaaaattgcatatttttcattccgataatttttatttataaattatattcctacttaaactcttataattatttttctatttttgaaatatattttatttgttattttgaactttaattcatctcgccatgtgttccagattgccgcttatttcaatagtcattacgtttttattaaaacttctagttatttataaattatattctaattgagctcttatttttctttttctatcttttgaatttatttttattttatattttaattaatctcgtattgtgttctatatatactatttttaatattttttaatttttattttcaatttcaattgtttcaaaattttattcctacttgaactatctttttaatttttatttttctaattttgaattttatttgattttttattttgaattttatttaatatggtattggttttttatatggactattctttcaatatttacttatttttaatttcgaattttagttattttcaaattgtattcctacatgaactcttctctttttttctaacttcagatttaattttatttttattccgaattataatttatctcgtattgggttcttatatggattcttctttcaatattccttatttttaatttcgaatttcagtttatttttaaattgtattcctattggactcttctttttgttttctaatttcgaattttgttttatttttattccgaattttaattaatctcgtattgggttcttatatggactcttctttcactattccttatttttaattccgaatttcagctatttttaaattgtatttctacttggaatctctttttctttttctccgattaatgtgggaatttttagcccccactgcgaacgtggtgtctcttttcaaatatgttttaataatataatagatagagagatatatagatggcataaatactggctttggatctaggcagatcacattagctttcttcagtgttgtgtttcctgggctcttctgaagtcaaatcgttagtacaaatcgatatttattgattcctaattttcaaaattattaaattgacagaaagtaacgaagacttttaactctgaggtagggtttgttattccagttcaaaattttagtaatttcagaccccaccggcaaacttaaatatcccccaaaaatttcagattttttcaaatatttatgaatttgatcaaaagttattcattaaaaatacatgttaaaatttcaaataattgcgtgcaaagaaataccaaaactcctaagtagattgttttttttcgttagccttaaaacgataaattctatatttaactttcaacgtaatgtagttaatatctataatactaatgaaagagtaaagtgcacaagcgatgcaactcacatgttggcagttagtggaagctagtaatacttaagtggcaaaccgatggttgcaagggccatggaacaacaaacgtgaacttggtatcttccatggctctcttcgtccttagttcagacctcaactgattttctattcatgtatcccgcccaaggttcacaattctgacgaaaaccggtcgaattccataaaatttcgaagcttcgacaaggctcgaaagtaaaagccgtatgagatttcgatgagtttcatcgaaattcaaatttgaattgataaaaaaggaaaaaaacaaataaaatcttataaatagtatgatattcatagaacctattgggatataaatttttaaaaaaattgattattccgtgtattttactgaaatttacactgggaaagaaaagaataacgaattaaaaaaaggaaaaaaaattcagtttacctcttttctagttaacgattgaaatttcgatgatttcgctcggaatttcaccaaagccgactggttttcatgagcttatcggtaaattcaagaaatttgtattcaaat

SEQ ID NO: 51134 - DNA, 1651 bp, Oryza sativa
ttgctgtataattaaagcgagtagggcaatgactgactagagccttccatgtcagtgtctccttaaaaatgtggaggcttggtactgtttggtgatcagaaatctgtgaccagagaggaaacagatcaataaagatgtggttggtaaatatttattctatggaaatcatagatgatgtgctatttgttatttttaatttttagatgaactagtctttcgaaaatttttagatgaactataaaaacttgtggtcccctatatggatggatactcatacagtacatattgtaacgaaatatttatatatttataaggtgttgtgtgcttccaattaaacaaggtagttgccaaaatatttatgaattagtactatcaatgtatgtcctggattggaccaatatggccgtgtttagttcgtgtaccaaattttttttaagtatatgaatacacatttgaagtattaaacgtagattaataagaaaataaattacagatttcgcctgtaaaccgcgagacgaatttattaagcctaattaacctgtcattagtaaatgtttactgtagcattacagtgtcaaattatggtgtaattaggctcaaaagattcgtctcacgatttacatgcaaactgtgcaattggttttttttatattcacatttaatgctccatatatgtgttcaaatttttaatgtgatggaaaagttagcagtttgaagaaaaaatttgaatctgaacacagcaatctcaagttgttccaagattagccatacgatccgtaagctattgaatattgagtcttcgagtcattataataatatagtagtactccattagagtccccgcacccatccgttcagaaataattaatgcgatcaataatgtacggaaccaatactcataagtcacaattaatggcctaatgaccatcttgttggccccatgcccagacactttcaggatgcttaattaaacaacactgctctacttgtgttctgattggttaagctatgtttgataaagtgataaaaatcttttatacgtgtgttattagtattttagaagttaacgtaggatcgaatcacaagaactaagccaatcagagggggtgaaaagttagtatacccaaaaaccgaaaacttttaacggaaataaaagttaccatcgaattcgacggagatcggtctgaccggagttgtcctgccggtctgaccgctcagatgccgtcggtctgaccggttgaggtatagatcaaccggtctgaccgccgaagctgctcgccgcgcctgtctccgccgccggtctgaccgccgtgcttccgtcggtctgaccgccgcttgccgccggtctgaccgccggtagatcgccggttagaccgccgaaacccggtaaacacaaatcgaagaactcttaaagtagatgacgactttattgattctctctctgtttacaaagtgcaccaacagcactccttacaaaaaatttcgactaaactcgaaaccctaactcaaaactcaactcaatgctctcaaaagcgataccgggaagcctcacgctccccctctatttatacccgaggtaggcagcctaaagccacgaaccaaactcatactaggagtcctaaacaccttaggaaaccctctagtacaagaa

SEQ ID NO: 51135 - DNA, 1599 bp, Oryza sativa
aaatccaaaaaatttcacattacttctcccccttttgacaatgatttcatcaagcataggaattatattcattaatgttcaagagcttagcatacatatagcatatcatgtcatgtgttgcaataaaaagaagatgaacccatctataatataagaagcatgcattaaagtataaccatgaaccaaagattttacaattaagcttgaatcaacaaccaaaattcatgatttcatacaatttataatgcaacatcttaacaagcacataggttgaagaataaacactaaatacatatacctattgcatttatcactctttctcaaataaactttagcacaaaataaccaagagaatttttgaaccttttcttttcttgagcgtttttgctcatatttttctcttttattccgggtacgtccctgtcgtcaagactgtttccagggattcagcacccattattttgctcacatcgaatacgtccttgtcgtcaagactctttccaaggattcggtattcattttttttcatattttgtactctctttttcacaataagcaattaaagctatttgaggaataacaattcaataaagcatatatatagagcctttataaatcaaaccatatgctagcatcaacattgcatatttgcttaattcaagtatagaatttaagtgtcatgcatcatctcccttaaaaacaaaatctaaatctcatgaaaaaactagaatacatacaaactatactagagacaaataaatcttcaaagtattgctagcatgcacaagaaaataccatatgcataaacaaagctcccttttctcaattttcattgtcatattattgcttgataaaaccatgaggtacaaactccccctcaaaccgtgccaaaaggatgaattatgcccaattcaccacgaagaaaagcaaagcgattagaatccaaaggtttagtgaaaatattagcaatttgcaactttgtgtccaaaaactgcaattcaacatctcccttctcaacatgatccctcaaaaagtgaaaacgaatatcattgtgctttgtgcgtgagtgttgaacaagattcttagcaatattgatagcactagtattatcacaaaagagaggtactttctcaaaagtaagaccataatatttcaaagtagataaaagccaaagaatttgtgaacaacaactagcagcagcaacatattcagattcagcagttgattgagcaacactagattgtttcctagaagaccatgcaatcaatgatttaccaagaaaatgacatgttccactagtacttttcctatcaattctacaacctcgaaaatcagcatcagaatatccacttaagcatatagaagatgaagtagaataccaaattccaaactcaagtgtatgattcaaatacctcattattcgcttgaccgcttgacgatgtgaagcacgaggagaagcttgaaagcgtacacacaaacacacagcaaattgtatgcctggcctagaagcagttaaatacaacaaagatccaatcatacttctatattccttttgatcaacagcttcaccatcttcatcagaatccaacacaactgtag

SEQ ID NO: 51136 - DNA, 823 bp, Oryza sativa
ataagtacacgatagccacgagtatgtgcggggtaaccaagaaacaatccatcggtagaacgtgcctcaaacttatccaaatttccagatttcaagacaaagcacttgcaaccaaaaacacgcaaatgtgaaactttgggttgatgtccaaatcgaagttcataagaaatttttccaagttttgatatcaagaaaacccgatttgaaatataacaagcaatgttaatcgcctcagctcaaaattttctaggagttttatattcatccaacatcgttctagccatctcaaccaaaacacagtttttcctttcaacaacaccgttttgttgaggaacacgaggagaagaaaattcatgttcaagacctctttcattgcaaaattgttcaaaagaagcatttttaaactcacgaccattatcacttcgaattattttcaaagaaccaggaaattcaagctccaatcgaagaaacaaaccacgaaagtgttgaaaagcttcgtctttagtttccataatgaaaacccaagaatatcgagaaaaatcgtcaacaataaccaacacataccacttttctccaacagattgcactctagctggaccaacagtgtccatatgtaatagctgtcccggtgcatccgttatcacagaaacaataggagcatgtgaagtagaaaccatcttagcatgacgacacggtgtacaaaccaaatcaagatctttcttacgtttaggcaaaccatgaacaagatccaaaccacttaacctagtgagatgatgaaaaccaacatgtccaagtctacgatgccaaaacatcacatctttat

SEQ ID NO: 51137 - DNA, 1841 bp, Oryza sativa
ttggtgtagtagtggttgtcgaaggtgtccggcgtcgtcgggtccaggtcgttgagcgccgccggcggcctgttgggcgggcaccgctgcgacaggaagctccggtaggcggcgtccatggtggggtccggcctccccgtgttgctgaagttgtacagcctgtccgtcacgaactggcactgcaccctcccgaacgtgtgcccacctgcatttcgcattattgtcgtcgtcgtcagctccggcgggcatgacggcagaactgaaattgagttcgccggagaagtgatacgagtacctgagagggcgacgaggtcgacgtcgttgaggttgagggcggcgaacttttggcggaggacggtgaggttgtcggtgggggccggcaggttgagggagccattgaagtcggaggtcttgccgtcgagccgccccagcagcactccccacccgggcccacctgactgtgaccgacaaagagagatcgatccatgtcgtccaaaaattattacttgtacgctcaattcaattattcatcgatgagttgcacttgtgaaccctatatgctatatatcttagatatgatgttttgtagtgcatgcagcatgcatggtgcacacgacaagattggtttcagtacaacagtgtcgatcgatcgtcgtcttgtgtgtgtgacacacacacacatatatatatatatatatatgtatatatgtatatatgtatatatatatatatatatatgtatatatgtatatatatttatatatatatatatactagaaaaaatacccgtgcgttgcaacgggtgaaggttattttaaatttattatttttatatggtttagttaagatgaaatttaccgtggaaattcgcttggatatatatatatttagaaaatcatgagctgtagttaagagtccgttcgtcttaagttagtatacgagttttttttaagagatttcttatacagctcattatgtatcgccaaaagtgaacgaacttaaaaccaactcaactacaaatatgtatttccacaagcgatccttctgtatttctaatagcaaatggacttaaaaaccgactcaaatatgggtatatatttccacaagcgaacgaacttaaaaccgactcatacacagatgacgtatcaaagtagcggcaaaaacatcttcaatttttataatagtagatagatatatatatatatatatatatatttatatatatatatatatgtatgtatatgttgatgctgatactttgtcctgtcgtaatgttgtccatatatattatacacaaactgtacatgtatatatagtagctagctctacatgtcttcctttccttggataattaagtgtggctttgttgttagcatgtgtaatagtttacagataaggttggcgtgagccgtaaaatgtaattaagattatccaatgatatgatgaaatatatatacggcggcatacatatgcatgcatgcaagcaccgacgacgggcctgtcaaatcactgttgaatgaaaaggtggtacgactgctagacagcactccaatttgtttcttcattatggttactagacctgtctatagagttacttcctccgtctcaaaatataagggattttgtgtaaatataacacatcctagtttagtactataaatctggatagagaatgtctagattcttagtattaggatatatcatattcatccaaaatcctttatattttgagttggaggaaggatagatgcatcttgcaagcacttaattaattcgagagacacgtacaaactaccaataatcatcgatcggcccaaccatatcacacactgtattgtgca

SEQ ID NO: 51138 - DNA, 4110 bp, Oryza sativa
aactaattactccctcctattcgaaatgtttgacaccgttaactttttagcatatgtttgaccattcgtcttattcaaaaacttttgtgaaatatgtaaaattatatgcctacataaaaatatatttaacaatgaatcaaatgatagaaaaagaattaataattacttaaattttttgaataagacgaacggtcaaacatgtactaaaaagttaatggcgtcaaacatttcgaaacggagggagtattacatttactctcatcgtttttacttatttattgttacgcatcaagttgctgttcgtatttttgtgcatcgttatcggttgacatggtagaatatgtgaaggataagtatatgtaatccaaatggcttggcaataatgctagtctacagagttgtcaaacttggtctcctctagactgagacctgactatgaccagatgactacttgtgcagatacttgcaaataatacgacatgtattattcgtgtgttgggtagtgtacctactggttttttccttaatttgcttttctttaattttaagaaactaataatatatggatatatgttaatctatagctagtggtacgtgttgtttatcttatctcctctagacaaggagcagtccaattctttgcaacgaacatatcacaaccacatgcatttactaatatgtttttgggagtgaacatgataatatatatgtttaagataaaacttattacatcatgcatagtatttatggataataccttttggcccaatctcacagctataggtttagctttgcttggacaggacaatatgcaagaggcagaaaacgtcactgtcatgtcttgcaaaggccaagtaaagcttcgtttcttttctaatcattccacggcggctatacattaatttatagctttgcatgcatgcgtacatgttagctagctatgatcgatcacacgtgaaataatggagttaattaatcaaagggccatcgtttgttcatattataggtacgtaccgttgtgttttaatttgtacatatatttctcgtaccgtatgatactagtacaaataaatgtctgctaaaaatctctatattttttcccctggtccgggaaagttatcaagaaatgctactagtaaatcattacaatcacgtacaaaacaagtttctatctgaatcagtagaattgatcatatcactactacgaaacacgttttttcctaacggccaaaatacttcttttgcaggtcagcgcgcaccccgccccgcctgctaccaaagccatgtaaaaaattaatccacgatcttcatagacatgccattatcgctcgttaaaatcgattttcatagacggccaggttaagtcaaccgactgggaaaatgattttcaatgaaaaaaaaaggggaaaagattatcccccacatcccattgctctccgcatgccgcaccaattttcatagatcaaacaacaaataaagcaaaacaggaagaccaattcatcataattgaaaatcaagttgctccataaaattttgtattcacaaatccaacctaaattcacaagcaaaaaagggaagcagcctatgtggagctgatgtaacagatgcaggaatctcatggtcacaagccatgcatcacccccatcggatccacttccttcaccactgctggtggatcataagctcccaatcactaccggcaccatatccatctcctccaccaccatccacatctcccctttgctgccgctgccatgtggaaccccgtttttataacaggaatcaatcgtgtaaacagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacatttcaaaaacagaagtaggtaaggcagcggagttaaggcagcggcacgccattgccacaggcaacgaccgtaactaagacctactgagcgccatcgtcttcatctccctcctggtagtaggcatagggatcctccgaagcttcatctcccacttctgattaattttatatttgcaagggtgagtaccaaccgtactcagcaagccaccacagcaatgatgcacacgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgggtcgttatggttttctgaggacgtccatattcccgcctctcaagaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgtgaggagttctggcgctcccaggaaagagaagtctcacacatattaaattatggtttaagttaagttctctctcatacactcatggcagtcctaccaatggcgacaccgatgtagggcacgcctctcggccctacctcaacggctgtcccatcgtagcgcacctgcctcactcaggggtgaaccatctatgcagggatactgcctccgctcgactatctaatccgctaggtctatacccattcgagaagtacggttgtacgggggtcgtttcatgcttaacttcatggctcggtccttaattgaccagggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttcccaaaggtaattgcccaatcatatagcatttgataaatatgagtatgcatgattctagaatggcatttctaagcaattgtcataattgactagggactcatacgtaatcatggttacaaggattttaagggtaaacaataatcgaggcatggcataatcacaagtatgatgttcatcattgcatgcaattttatttgtaaacaaaacaatttcgcaattgggatcaacatgttcaaggaatggtgatgacttgccttgctaaaggtcttgcgggtcttggccttcacccggatccgcggctccctcggtttctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgatttcttattgaaattaccaagaataatccataatttatattaaattttgcaattctacgactataattaatctataattaaattctaattattttaaattttctaaacttccctaatctccctctaatctcctatttatttccttttcctttttctccctttcctt

SEQ ID NO: 51139 - DNA, 1739 bp, Oryza sativa
gtacggggcgcgtcgcgggccgacggggcggcgcgcggcgcagggcgcaaggccggctagggcggcgcagcagcgatggcgacggcgacaggcggcgatggcgacgtcggcgcggcggcaggcgacggcgcgacgggacggtgacggcgacggcgcggtagcggcggtgcggggctcagggaatggccgggcgcgtggcagagaagggtctagggctagggaccaaaatcgaacacctatgaggcaatgaacagtgacttttcctatttatcccgattttagtgtattttccatataaatttgattccacaattcctaattttacatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttattactatccacacctaatctttatttttaatttatatttattttaccaatttgtttttttaaggtttattcctgattaactattctttactcacgattaataatcttcaaaaaaaaatccagataaaataggcgaataagatcagcatgatgcaattaatttaaaaaagtttttgaaaatccgtatttttagagttttgattttgtcggtccaattttcagggtgttacatgccacctccccatcttcgctttgcagccgatgccgtcactagtatcctggagcgctatcgccaccacccttctctggatctctttgacggagagaagtagagaggataactctaagggagaaggagaaagagggaaagtctaatattctaggagcccgcatataaaattatttttataagcaatatttttagagggccgtatgtataaatagagttgtttttatacatggttatgctaatacgactgtctatttctacaaagtggggttttttcttagtctgcctttgaaaataaatttgaggtgctaccaaaatacttttcttatagcgtatcacattctaagacaagtttcacttactttggttaaatatataggagtatactatatatacatgaaaaactaggcacgcttgcccaatggatgcaaatacatacattttgaacgttcaacgacatgggaccagtgctttaactagatagtgctataattaataaaaccgggcaaccggccacaagctggtgaggaagaataaacgatctggatagcttaatttaattttaaatcataattcttttttatcaaattgttattcttcatccatcctagcttcatgcagtgtaacgaatatatgatccttgtcttcacgtacctcttaattaaagctaagttgtgagctgttatgttacctctctagtcaatattgttatgttacctctctggtcaatatattactccattcgttttaggttataagatgttttgactttggtcattaagtttgactaagtttatagacacatataataatatttatgttaccaaattagttttactaaattaataattaaatatatttttataataaatttatctttggtcgaaaatattattatttttttctataaacctagttaaacgtaaagctgtttaacttaaacctgaaacggaggtggtatataggagtatgtgtgtacgtactgtacgcgtgcaatgtatttttgctatga

SEQ ID NO: 51140 - DNA, 915 bp, Oryza sativa
gcagtaacaagtatatggttagcatgtgacgctttaacccatatatttttgtttcgattcctggtctactacaattttactacgacgttactgctaaaagtgcagtaacgtcctatgtattctacagtaacgtcacgtgttactgtacttttacaacaatgttactactggagcatagtaacatattatgagtttcggtagtgaaagatattagaattgataatcatattactttctcacaaaattcttgaaacaaatggcatcattagatgaattgattacaagaatgtgttttgaactatgaggtcatgggttcaagtcttgaatttggcaatttattttttatttttctagaaaagagaaaaaatgtttcggggagaaaaaaacagaataaagaaagagagagagatcgggaggagggagggggagtgacgggagagtggtcgggaggagggaaagagagagagatcgggagggggaggggaagcgagagagaagggggaacaggaggaagggggggaggggaagcgagagaaagaagggggaacatgaggaagggggtatagaatacgggtgtagaatagtcttaccctatatatatgtatatgtatatatatgtatatgtatatgtatatgtatatgtatatatacatatacatatacatgtatatgtacatatatacatatacgtacatgtatatacatatacatgtacatgtatatgtatatgtatatatatatatatgtatatgcatatatgcatatacatatatatgtatatgcatatatatgtatatgtatatatacatatatgtatataggacactcatatggggcaccatggtgcccgggcaccatggtatcaaatacaaaaaatcactcaaatttttcaaaattttcaaattgtgagtatat

SEQ ID NO: 51141 - DNA, 13035 bp, Oryza sativa
catgtatatgtatatgtatatatatatatatgtatatgcatatatgcatatacatatatatgtatatgcatatatatgtatatgtatatatacatatatgtatatatatatatatatgtatatgcatatatgcatatacatatatatgtatatgcatatatatgtatatgtatatatacatatatgtatatatgcatatacatatatacatatgtatatatatatatatatacatatatgtatataggacactcatatggggcaccatggtgcccgggcaccatggtatcaaatacaaaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaataagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatgtatatatatatatatatatgtcctctctttttgtgcgtcagcacagcacttgtttgtttgttaacatctcctagcaatgttacagctggttgtttgcttaagtttttgtctaaggtgacaaggatttacttgcttttgtttcaataaatctgtgtttggtatccttttgtaatgaatcatgtgggatgtatcaatcttattagaagtttgtgtaaagcatgtgtacaaaatcggcagtgtaagatatttttgaagctgcaattagctggtgttagaatagtagcgggtcggtccaccctagaccaaggaaaccacagcggtccacacggctagtccgcggggatcgatggtccggatcggccagggctgatcggatggccgtgaagcggcgtggccagggcacgggcacagctcaacactggcctcgccgagtgttgtgagtttcaaaagatcttagatggagagataaaaaaaagatcatagatggagagttaaaaaaaaagatcttagatggagatacaatctatatcaaaacggtagagatcaacgagacctataactttgtagatgaaagttttacatttgagattgtttatgtacctaaatatttattcactacttaaaaaaaggcacatacaagtcggcattataggtgccggaatagctaaaatcggtatctatagtacttttctcccttcaaaatatgaaaaaaaaggcacctttaatacactataggtgtcggttcttctaggtgccttttttttaaaaaaaaggtatctttaatatattatatatattatagatgtcggttaattaaaaaccgatacctataatatattatattataggtgccggttttttaataaaaccgacaccctatcaaacgagccgagcgaggtgggcggagaggcggcagtggtgggcggcgccctcccctctactagattcggcgcgaggggaggcagcggcggcggcagcagtagcgggcgacgacgggaggagaggcggcagcggcaggcggtgccctcccctccgccagatccagcgggggaggcagcggcagcgacgggctcccctccgccagatccggcaagaggggaggcagtggcagtgggctcccatgggcgacggcgggaggtggcggtagcagcgtgtggacccccgtttttataacaggaatcaatcgtgtaaacagtaccatttccctggatcaagtagtctggtacatacgaattcatagctgaaataccaaatacacatacacgaatgtgtagtacgaattattacatcataagcctgcaggcatagtcttaaatcatcggaccaagcggtccggaatacatccaaaagcagaaataggtaaggcagcagaatttaagcagcggcatgccattgccacaggcaacgaccgtactaagacctactgggcgccttcgtcttcatctccctcctggtagtaggcatagggatcctccgaagcttcatctcccgcttctaataaattttatatttgcaagggtgagtaccaaccgtactcagcaagccaccacagcaatgatgcacatgatagaggatttcaaaggatggctatggttcatttgcgcaaagcaagttttgtaattcttttcacaagcctaagacctagcaaagactaatcaagttttaataccattgttcataataaacaatgacggttctgtccaccatccattgtgatcccaaggatagcttcccgccattgagtcgttatgattttctaaggacgtccacattcccgcctctcaggaagtggctctatcagcataaaaattatcatgcaatattccatcccactcaagttaaagaatttagagtctagccaagtgtaatacatgtcccggtgctcattaaccgcgagctcggctattcgaatagatttggtttactcacactgcagtggatgtacactttacccgcactccgcgactgcccaacacatgagcctcatcccaacacatgagacgcgtcacggcaaagctttttgataaccttgcattggcagtacccgctccatgaactttacatcctcatgcactctaggcgtcatacgtttctagcagtgagaggagttctggcgctcccgggaagggaaaaacacacactcctacgttgcttcttgtcgttgaacccagtccatcatgattgttctcttatgggtatcctcatgtagtattgccaagccagcctctgaccatccggaacgggcatccgccattcacctggccatccgaaccgggcatctgccagcagactgctgccacatcacacacctaaaagaagaccactacgcatggatactgcctccgctcagctatctactccgctaggtctatacccatacgagaagtgcggttgtacggggggtcgtttcatgcttaacttcatggctcggtccttaattgaccagggacggcactagccttttccggacaccacccaaatcctccagccgccccagtcgaaaacagttgtttaactttattttcctttcacaaatcatgtcatcaatatcatggcaatgtggcgctcatgtctccacataccgcatctcaattaccttcccaaaggtaattgcccaagcatatagcatttgataaatatgagtatgcatgattctagaatagcatttctaagcaattgtcataattgactagagactcatacgtaaacatggttacgaaggaataaggggtaaacaataatcaaggcatggcataattacaagtaggatgttcataattgcatgcaattttatttgtaaacaaaacaacttcgcaattgggatcaacatgttcaaggaatagtgatgacttgccttgctcaaggtcttgcgggtcttggccttcacccggatccgcggctccctcggtctctataattatgtgcgaaagaacaatttgaattcgattagaattcaaacaaaatccaaataaatccaaatgaaagtcgaatgcgaaagttgattcctttattttaactttactattcgcgaactaaggcaaacccaatttcgattcaaactattttgcgggtataaatgttttgttgtcataagtttttaatttaatctacccgagcattatatccatataataggttagagatttttatcgcgagctaaatatcggacgaaatcctagaaatattatatgatttaatttagtctatgactagatgattaaatataatacacggctaaaatccctaggaattaaatccgaatttctaccgtgaattgattacttatagggattacccaaaaaaataatctataataatccataagaattcatctatttgtttagttattaactacatctaaattattatcgcgaattgattccttatagaaattgccaagaataatccataatttatattaaattttgcaattctatgactataattaacctataaaattccaattattttaaattttctaaacttccctaatctccctctaatttccttttttttctctttttcttttcctctctttctttctctctctctgccagcctctcttttcctctccctctttctctcggctctctctcccacccgagcagtggcggcggtggacgcgaggggaacggagggcggctcaccggcggcagcagcggcgacgacggcggcagcgacggtggcgcacggcggcgcgggagtggcggcacggcggcacgagaacggcggcgcggcggcacgggaacgacggcacgggaacggcggcgcggcagcatgaaggcggcggtacggcggcactacggcggcgccgcggtaaaaagggaggtgatggacgggaatgggtgtgggggagaagagaagggctgggggttttatagggtgtgagagagaggagagagagggggcggtgaaggagggtgaggcgacggcggcgcggcagcgcggggcgcgaggcagcgatgggacgcgcgcggcgatgggacggcgcggcgcgacggcgatggcgacggcggtgtagggctcgaggcggcgacggcaacggcacgtggcgacggcgacggcgacggcgacggtgcgcggcgcagcggcgggcgatgggacgcgcgcgtgacgggacgggtggtgacagggcggcagcggtggcgcgcggcgcgaggcgggtcgcgacggcgatggcgacagcgcggcagcggcggcacggggcgcaaggcgatgtgacgggcgagcggcgacggcgacggcggtagcggcggtgcgcggcgcgaggcgtggggcgcgggcgcggtgtcggcgcggcagcggggcagggttaggctaggggacctcgtcgaacacctagcggccgatgaatagtgccgttttctatttacccgatttaagcctatttatttatttaaaattgattctataaaccttaatttttgtacaaatgaagttcactcaatatttgtgttattccaaccaatgggtccatccttgattaattttacccatattttatttttatataattttcttgaatttaattagagttaattcttattccgacacttttcaatttaattgatacaaatatagtcgtaataatattttactcatttctatcctcactaaatattattttaaattgtactttaattatttacttagtcaatttacttttcagggtttattcctaactaattatccattattcgcgatttataaactccgaaataaaaattcaataaaataatcgaacaaaattggcatgatgcaactttatttaaaaagtttttgaagatccgtatttttagagtttagcttttgtcgtcgaatttttagggtgttacacagcgggttcccctccgccagatccggcgggctcccatgtgcagttgttgattgtgtgatgctgatgtgtagttgtcctttttggtagatttttagatgttttttttgggttgctttgatttttgcaaatcgtatacctcaaaggtgcagtgttctaatcagtgtcatcttcatggtgttggttagaaaaaccggcacctttgtggggttctcaaccggcaccaatgacattttctgtggtagtgatttaaagctcttagttcttacaatttctggttacttagaaagtttaaactccaaaatttttataggaggttggttggttcatatataaaaatcgattttcacatatattcgacttaagccgcccgcctaaaaaattctcaaaggtggatgccttaatatctacttgtgaaaatggttttctatattttcattttattaggctccaaaacaaaacaaaaaagtattttgaattttagtgggcatctatacacactcacacatccaagttgcaaccagtggcggatttaacgtgggggtcttgagaccccactacggccactgggaccactggaaccatggagatcgctctaagccctcactaaaaattatttgtatagatccatatgatatgggggctgaaggttctcctagtttgtttagccccaactattattttgttctggatccgcccctggttgcaacccacaccatttttttttgcacgaaatacgcatccgtgtgttttgtaggatttgaactccccacaccatcttttttctacacgaaagatgcatctgtgtgttgtataggatttgaactcgagacttcctagttagtctacacccatcatccttatcatctctatgtcattcttgttttttagaattaatatgctattcttttgatttcttctgtactaatataaaaaatatgagtttcatcttcaatcctttaatcttggatccacatatcacgtgggacccacctgtcatccggcccaaagaaaccacaccatcggcggaccatgcatgtcacgcacggaaaaaaagaaacgtggaaaaaaaaagaacgccaaaaaaggaaaaaagaatgcaaaaaaaaaaacaaaaagaacgtgcatctaaccccgactgctcccaacgacacctctactacgtctctgccgccgtcgacggcctccaccgctgccatcttctccctcttcaccgctcgccctaccctttgtcgccgcctcctcgtgcgctcgcgacgctggcatgatatgccggagaggcggggtcgccgttggccgcttctccactcttccccttcgccaccgcatcaccgtccaccatcttcgtgcgggcggatattgccgaatcatggcaaccgcgtccgacgctgcctccacgtgacccactgccggcgtctccctccaccgcgccgtcctccatctccaccgctccattgtcctgcctccatcatgatccaccgccgccgtcgagaccatatgcctccatctccctccatcgccatggctacagcctcttccctgtcctcacaaaatccccgtcgatgcaaaacttctccccgctaccccctaccccgtgctccacatggcatctgcgcctccgctcgccacccctccctgtgcgtcgggctaccccgcgtccgcgcctccccctcgcacctaaccgcccccctaccaccgttgggttgccacctagcagcggtgtccgctgaagatcgctgccttgattgttagagtttgtctcgaatatgtgtacaaagtcggttatagtttaggacttggagttgtactaggtgtaggactagagtaagagttggactctatcctaggatctctcataaataaaggggcgtgcttgttgtaaccgcacggcgacttagcatagcgagagggagcggctgccagcggcatccggccgtgagtcgttgtaactcggatacgctgtaatatgctggatcggggaggagcgcccataatcagtgccccggagatgaaggcttcggctgaactccgttatcaaatatcatgcctcagtgtcgttatcgtgtttggatctcctatggcgtttcttccacatttggtttccgatgtgatttcggggccggttttataacaagtggtatcagagcctgcgggagatccatggtagaggtacaagggaggtgctccacgccgtgacgactacacaaggtgtctagggacagacatagacgcaaggtggagcacggcggcgataaacggaatttgatcggtggaatcggacactttaggcggcagtctgaaccgttcgatggctattttcaacagggagatgaccagacatagtgcttgggttgatggcggcggaagcgattggcgatccaatcggtggatcggacacttcgggcgggtggctcgaactttccggtgagctactttcaacagggagatgtaaggcctcatgctcggggttgattgaagctagacgcgatcggcgttctaggttggtggaatcgaacactccaggcgaggtggcccgggcttttcgatgagctacgttcgacatggagatggcccgggcctttcgatgagctgcgttcgacatggagatggctagacatagcattcgggtcgtttggcggctgagaagacagcatggtgatttgtcggcttcggctcatggctagattgacaggcggtcaattggaggtcggagcggttttgttttcgacgaactctagtggtaggaacacggcttggtgtggtcgtcgtgtaggtgccggcgggattcaacgcaggccagctctggtcaacggaggcggcggtagctcgtacaaggatggtgtccgagggagcagttatgcgcatcacgcaggagggctgcacacaggggttctgagcaagatgtgcaagtaccatccaatggcacgtagcagtaaggaagacaaaaatatgagattgcttgagcattggattgtgggctgtcataggaagctatgcatggacgtggtgtgcgcacatgcatgagaatcatggtggccattaatgcaaagcagggatatctgaatatttttgttgtcttggaggcaactacatggtggctggtggctgggcaggcacggaaaccgaatccaatcaagcgccagaattggtagtcgaaactgtgttggtccgtctaagtagaggcatggcacagtacgtgagccaaaggcgaggaggtcggatggtagacggaacagtgcggttttttgtttgtcgctggttacggtgtgattgaggagttgttctcaactcagagtcgatgaactcgttggaggccgggtggcagaagagatgacagagtcaatttagactcaggttatctagctaagccgaaaaaggggatcgtgaattaacaacagtaattgagaactaggtttaggcgttcgcaatggattgatcggagaaggtggaggctcaggcagaggtgtacagcagtgcgtggggtccttggcaatagcgggggaaaagcgggggaaaatcgttgagggtgtcaacgtgtctgtttggcagtacaggatatatccagaatctgcggggtttgcatgatggggatatatggaatctgcgtcactgaagaggaagagcgagtgctatggtggtaatttcttcgggtgattcaagcaacggtgaattttctcaaattatcgggtactcagtctaggaatgcaagaaagcttggatgttggatctattagctcggttcattagacgacaaggaagaaatggttctcttcatgtctagtgagtttgctctgtctatttggtgatgacattggttatctggtcatgaattagataaattcaaatcaaagacggaagatgaaggtgaacatggtcttcggggagtctatgatgtgacagctagggagaaattcaattcgcttggcaagacgactgtgatcatatgagagaaggtggagcaatgttctaggtggagtcaagggaagaagttgtaaggatagcggagtctcttgtttacggtgagcctattgaaggcttgtcggggcggctcggcgtgagcggcgaaaaaggatcaactcaagtcttgtacacggagattcgagcaagtaacgaattcaggttagtgtggcatattcgccaaggtggagtttgttagagtttgtgtcgaatatgtgtataaagtcggttacagtttaggacttggagttgtactaggtgtaggactagagtaagagtcggactctatcctaggctctctcataaatagaggggcgtacctattgtaaccgcatggagacttagcatagcgagagggagcggttaccggtggcgtctggccgtgagtcgttgtaactcggatagtcagatacgctggatcggggaggagcgcccataatcagtgccccgaagattagggttgggcgttcagtcagactggaaaatttggtctcgttcttcggtttttcggttagttcggtctttgaaaactcaggaccgaatttcatccaaaaaattcggtctctgtctcagtctgaccgaatattttcacagccgctagagagaggagacggaggcgacgccgaggcggtgccggcgctggaggaggacacggcgttggaggtggaggcggaggtggagggcgctggcgctgggcggaggtggaggcggcgtgcagggcagcggcggcctgcggtagctccaccgacgccgtcggcgcaccccccaccagcacggctgcatgggggaggaggggatgtggtaaggggatgtggatgtggatggagaggatggtggtggtggtgggttggatatggataaggttttgcttgtgttgactactaaggaggtattggacctaagagcatcaccaacagattatctataattttctcctaaaaatttgtagttgggtttcctaaactgaaaataggaagtgaaaaaactcttccctccaacagatagcctaaattcaatccccaaaacttaaaagtgggtcttcctgttaaactaccaagagaaaattctgttttttttctttcacacgtagaaagatcgctatctcccacgcgcgggaacgaaggagaggcgggattgcgtgattgggagcgactttcgcgcccgcatataaacggagcgaggaacccggggaagggaactccaaaactcggataggagagtaggggatctgttgaagctgatttttagactaaaatccctcaaaattagttttgggaatcgtataggtagactgttggtaatgctctaatgggccaaagctatatttcagttttttcggtcaattcggttaaccgagcccaaaaactgaattgaccgaactaaattcggttagtagaaagtgctgaccgaatttgtgaccgaattttttggtctgggtctcgatcatttcggttcggtctttttctatccacccctaccggagatgttggtctcggctgaactccgttatcaaatatcgtgcctcggtatcgtcatcatgtttggatctcctatggtgtttcttccgcatttggtttccgatgtgatttcggggccggttttataacatcgatgactccaggaggcggggctttgatctgttgggagagcctcgcgctgtgtcgaccttctctactctccggcgctggaaggatgggatcctctccgcagggtgaggggcaccgacatccgacgcggaggttctcctcgtcctctccatgttccccagcctcctgctcctagctcctcgggctcctctctgcggtggcagcggtggcgttgggaagttcggttccttccgagcactgtgctggcttgagatcgacggaatcggagtctcttcgccgttgcggggacgtgttgttgtgcagatgagcgggtcttagctcacgacatgtttgtgttgtgatttagtacatggtatgagatttttgttctcgttttagcgtgtgataccagctcagtgaacatgaaataaatgtagaagatgtttcacaatgcagctgaggagaatgttataagcatccgggcttatgtcactgaactgaaggagagagttgcaataccaaaagcagttgctctgtcaggttctgatcgtttatcttgcacatataatcaatttgccgtgaaaaagatatgttgtttcaccactaaaatatgttttcttctgatcttcttacaacaggtcttggagttggaatcgaatgaaggcaaggcaaatgacacggaagaagattcagaggaaaatgcaggatctctacacgatatataaaatataagtcttgactgatgaaaacaactcacaatgcaagagataatgcttcttgtctatttctgattgttgtggcttgaatgctagatttatcccaatctgcttttatttgtctcattgtctgaccttcgattttgtttttgaatttctctagaacatattgtgaattgtgaaaattttcatattgctcttgaacagattgtgcttggtagtgtgaaccaatatcatgcattgcaccttattgtatgatatcagtttgatgtctattgtatgtatattgggatttggaatgaggagtactggaagcaggaagatggtggtggagcatggggcagcgtcgaggaagacgacagacaggtacattgatttctgcccatgctcccctaccgctagatgaaatgattcaatttactgctatttactctttggtagttgtaatacaatgaaagaccaagaacccgagattgcttactttagtgcatatacatgagcttctattcgcgggcttctctgttttcaatttctgttgatcaaccttactgctgtgcactgctttagctcaaacaaaccgagtgacaggagaggaaccggaagtttttgtggtttgtggtttgtagtttgtagggagaggaaccggcagtcgtgcattgatacatatgatagtttttgtgatttgtagcctgagatcaaattaaatttaccaagtcagccaaatttcagagactgcttcacctaggcaatgtaaaattatgaaggccttcacctagcctatgctatttattttatttttattctcacaataggaatgatattgttttcaatgcccctaggctgctcacaccagttgctgccgctgccagttcggacggcccaatgaggccggtgcccttgaatgacaccatatcaggtcctagcgtcagacaagataattcctccgtctgaacgttgcaattgccgttctcgccgactccacattttcttacccataacaaaccatacatgaaaactctttttgccacggcctcaattcatgagcaagtctaatacttcaccttttttcttaaatatgttatcaacgtgtaactccgactcatgtaatggttgctcatgctgaagaaaatgtaacccgtgacaaggagaatgatgcttccatagttgtacaaacctgtccaggaaccaggataagtaccatgtttgttccaaaaaattatggaaatatactctcttagccatcatgtttgtttataacaaggaagctatgcttccattgctgctgcctcaaagaaacca

SEQ ID NO: 51142 - DNA, 2263 bp, Oryza sativa
tccgaaatctgagatttttgcattcattgaagcatctagcagaatgttgttgaccttaatgtctctatgaacgatgcatgtattctgttttgctaatctgtggaggtagagaagcccctggctatgctatcaattacacggaggcgtgtagaccaatctagcagccgggattttctttcgggatctgcaagtttaatcttttcaaataatatctgaacatataactaataaaatatcgggaaaatatggatagattttagaaatcactcagtttaagtgttttcaataattaagatatatacacgcgcgctgacaaattaaaggcaaaatagtcattttagaaaaaaaatcaaactattaattcacggttaaccaacagaaaatgaatatataagtgatcaaaatgaatatatatgtaggtaacaaggcaaaatttagtggagtagaaaggattgagtgaaaacacatgatcttataaggatttttcttttcgtaatataagggttgggaacttgggatatatataccagaaaacacatcatccaagcttccgttctccatgtactcatagatgagtatgttttcttcgttttggatgcagaaacctagaagcctaactaggttcctgtgttgaagagttgccataagtttaatctcgttcataaattggtcaaaaccttggccagatgaagataccgcgagtctttttactgctacatcagttccgcttggtagtttaccctaaaaatatatgatggcaaaacacataaatttagtacatcagtccaaatttaagtctaaacaataataatcagatccttgcgattagcacagttactagtcatctgcgtcgtaagcgtattctatttacccatgctagccaaatgcccgtgctttactacggattaaaacaaattaatagtgaggttttttggacaattttgtacctatagatgttatattgtacaggtgaaatatgatagaatcatatatatgtagatgtgttattttataacataaaagtacatgggtagctagtagaaagcatgatgggtagatggtaaataaaaaaatactatacttggtgaggccaccaccattgccttattttaagggtgtgtttagttcacaccaaactttcccctaactcccaactttccatcacatcacatcatatccaaaactttcctacacacataaattctcaactttttttttcaaactaccaactttccacaaacttctccccaatttcagaaactaaacacagcctaagaagagtatagatgagactatatccggacagtttagcatttgaccacatgataatttgtactccctgctgtcatataaatatataacattaatttaacataattcttttcacaccttcaaattatacaactttgttcacaagttatatacagtaagtatataaaatatggtaagtttatgatattatgacaatattgatgctgggagtactaaataaacttaatgccacccaatgtcaaatattgttgagtggattcgggtaaaaaagaacatattgtcgaatggagggatcagtgctagctatttactgcaaaagattcagaaaagggagtatataataggtcaattggatgtttatagataagacatgtcgttacatctaatcaaattaccttgtaaacatggccaaaacctccttttccgatttcatttgagaaatcacgtgtagcttcttttatctgttgtaaagtatagcgtgaaaagagcggtccaatctcgtctatgatctcagtctcaagttttgctagtttcttttgccgttctgactcttgaattactacatgtacaggtcgaaatcacagggaaatattaattaaacgtaaaaaatcagaacctgcttaagaattagatcggtattataattaaggccatcgcaacaacttaatcacaccttctcttagtcttttgagcaatgcaagtataatcaaggagaaaattagaataacgaaggctactactccaaggacgattccgacgatcttccctgcgctcaatgaacctgcaaatgcaagcaatgtgatagaattatagcatgtaggtgcaaattaatcaccctctctattttatattacaagcaattttaacttttttcccagtcaagttttcccagttttataaaataaatatagtaatattttcactacaaaacaaatatattatttgttgtaaatgtttttctattaatttttctataaatttgttcaaatct

SEQ ID NO: 51143 - DNA, 6546 bp, Oryza sativa
gagggggacctccttaaagggggatgatgccctcctactcacttgaagcgtgtgaggtggagagaagagggggaacacgcacgctcgctcacctggcatggcatggcggcgcgcgcacgacgtgaaaccattgcccggttggtgtcctgatatctctataatactgcaccctcctctgcgccatccctcaggcgtcctgatatctctataacaacgtgctgcaccgggagaaggcagtttgcctcctcctctgcgccgtcgtggagttcggttggcgtcctgatatctctataataacatgctgcagcgggagaaggtggtttgcctcctcctctgtactgcgtcgtcgctcgtagtctactccatccagctcgccagtgtgtaccggcgatcaggagagcaggtctcctctctataataacgtcctgcaccgggagaaggcggtttgcctctgcgccgtcgtggagtccggttggcgtcctgatatctctataataacgtgctgcactgtcctgatatctctataataacgtgctgcaccgggagaaggtggtttgcctcctcctctgtactgcgccgtcgctcgtagtctactccatccagctcgccggcgtgcaccggcgatcgggagagcaggtctcctctctataataacgtcctgcaccgggagaagacggtttgcctcctcctctgcatcgtcactcaaggcagtttgcctcctcctctgtactacgtcgtcgctcgtagtctactccatccagctcgccggcatgcaccggcgatcgggagagcaggcctctctataataacgtcctacaccgggagaaggcggttggcctcctcctctatactgtgtcgtcgctcgtagtctactccatccagcttaataacgtcctgcaccgggagaaggcggtttgcctcctctgtactacgccgtcgattgggagaaggcggtttgcctcctcctctgcactgcgccgtttcttgtagtctactccatccagctcgctggcgtgcaccggcaatcgggagagcttcgacgtcctcatcctatgtgtcgcgctgtcgctcgtagtctactccatcccgcttactggcgtgcatcggcgatcgggagagcttcgatgtcctccgctgggagaaggcggaaataaggtttttgggaagcgcttcacgcaactgctccttattcgttcacgacgactcgtctttcttttcactcgcgtgctgcgcgccgagaccctctaccttcgacatcctgcacaaggagaaggcggcaataagttttttgggaagcgcttcgcacgaatactccctgttcgttcacgacgactcatcttcctctttgctcacgtgctacgcgccgtcgtcaacgcctgcaaccgtgagtaattcctgctgagcaactagtcttccggtaccctcgatacgtgttcaatatattacgcatatttgatctgttgatgctttactgcctagtatacatatgtagatctaatgatggatttatactagtttacatctacaatatcatgatttatttatggaataaattaaattattatatgcttataaattcaacagtacccgcgctgcagggaggagtgccacgccgcgtagtcagcggtcttgttgatcagctccatgacgcggccgccgaacttggcggcgccaccggcgccggtcacgttgttcatgttccacgcgacccacgccggcgcgttcgttaggttggcccggaagtcctcgccggagaaccggagcatgtactggtcgtagtagatcgtggcgtccctgaacctgtcgcagaagaggcggttctcgacggcattctcgaacgccttgcggaggccgttggcgcactcgtcgccggtgtagtcgccgcggcagagcgcgatgccgtacgccgcgtccggcgcgctgccgacggtgtgcgaggcgaagttggagaccctggccacaccgacgagccgcgcggccagcgccttgaggttgtcctcgtacgtggtgttttgaccgtagcggccaccggacaggctgcagttgtagtatagcgggttcacctccggcgaggccactgccaccgcctcatcttcaccacgggccgtccatgccgacgacgagaggacgaccaccggagagaggaagaggaggaggaggggttgcatttggcagtggagagaatatactacgtcttcggactagtgtttgattagctattatatatgcatcagtagtgctatgctgttgctagctagtgttttggtttaatggtattgctttcgctttgctgggccatatatataggcacagtagcatgcatgcaagttttgagaagtggcgtgccaatgtcaatttcttctatgttacaagacaacgcgtttgttctcggtcgaggacctaaaataactagagtaaacgattcgcgcaagaaatttcatgcccctcggctgatcgatcggtgccctatggcttttacaaaaatattatcggcttctcatgcagggggcatgcagcaagttaattacagtaatacggagtatatatgtaaaaattatgggtcgagtcttgctggttgttttcatgagatcgagtcgtttgacttgggaagatcatctttgaggataagatcgatatgtttgcgtaatcgaataacctctctgtgcggccgtgcggccgcggctgggttcgcaaggagatatatatattctgaatccttgttttacatgttcaaaaactctggctagctacatcaactttgtaattgatgacttctttactcaagattatttaggtgactaaataagcacaataagattttgagatatgaagttaaaataatagcatcttaattctaaacaataagtatttaaaacacagctcctctgacttaaaatccgagggatatgagtccctaaccggtgggaccaacctcatggacccacacatcagaaacgtatgtccctctatggtacgttagaggagcctcatcacaagtatctgatagtagttgatagtgatgatgtgtgtagactaagaagtctcaagttcaaatcttatacacggcacatgcgtgcgtatttcatgaaaaaaatagtttggcttgcaacttgggtgcgcagagtgtatagatgcttattaaaattcagaatactttttggtttttttttggcaactacaaaattaaaaaaatgatagatcttgattactatagttaacaacttattttatttgatattttttagaaggcaatttttgctacagaatactgcttatgtatggttttagtcctacgacactgcccaaactcacttttgggggaaaacactctataaacgtggtaatttgccagtggacaccgcgtcaattaaaataataatttctggttgaagatgagagagaaatcgcgtgaaatatcaaaaatgcccttggacacatatgtcagctctatctcctgtctctcttctcctctctctctctatatatgttctctctctgaggcgcatggggcggtgtcggtcgccggggcttgagctcgtcgcggcggaggagatggcaaggatggcggccggcagagtggagcagggcgtcggctgtggcggagcggagctggcggctgaagcaggcggagcggcgatgtcggccgagcgtgtggcaggcggagtagagcgccggcggcgggtgatcgcacggcaggagggaccgttgttgccacaatcttgtgccacccagcatctgccatggatgcgacggtgcggttggggccgaacggcgggggagaagcggtgcacgggcggcgagggcagaagctgcgcatgagcttcacgcgtcctcctcctcctcgaactcgtcaccatcgtcgtcgtcatccgccaccgccccgctccgcgccgccggatctgcgagccatcgcctcgccggcctgcatgctgcgccagccaccgccccgcagcggtgttgtgattcggtgattgggatgagagaagggcggcggcggctacggcggtggcaatgagtggctcggcgtagacgttggggatgcggtgcgggagctacggctcgctcgcgtcgaccgacggcgggaggaagtgcaggggcagggggtgggggtggcgaggcagcggggagaaggagcggctgcagctgctccaccgtgcactgtagctggtaggccgccggagggccggggtgctgctgctgcttgccgctgcctccgccgccgtctgtgcgggcatggccggcggccggcgggaagcgacatgcgggcaggaagaggagaagagatataggagatagagctgaaatgtgagcccaaggggcatttttgacatttcacacgatttctctctcctctttaaccggaaattattattttaatcggcgcggtatccactggcaaattatcacatttatggagtgtttccccctaaaagtgagtttaggcagtgtgctaaggctaaaaccacatataagcagtgtcctataccaaaatttgcctttttagaataggggtgaaaacggtcgtgaaacgtcttaaccatctccataactatattttttttggaaaatggtaaagttggagatggaaacaatattgaaaatatcgatcctttcaaaaaaatattgaaaatatcggaaacccggaaacggattatacggacataaacgtgtcgatatcgatcgaaagccgataaaaaatatcaaaagcattgatctttaaaagcagacatttaattttgcataattatattatataatatgataaaatatattcaaggttacacaatgtaaattccaaattgtgtactctagctagggtgtggttgagaagttgatgtgcctctaaactatagatctatttaaaaaaaagagttcattccactttgggctatgttttattaccaaaatttcactttgaaccatcctttatatccatttttttcaccaaaaggagccacagcttctagcaacctggggtatcacattgccataataagataaccagatcaagttgacccaaggaatgtttgctctgttataaaatttatgcagatgcttcataagaagagccctatttttgaactttgaggtcaataacttctagaccacctttgtcttttggcctacaaactttggaccaagcagcaagagatttcttggatgaattaaggtcatttcccctccaaagacaatgacgtctagctctatctatggaatcaatgaccgagactggcaatgacagagaacacatgtaataagttgggagcaatgagaggaccgaattcaccaatgtgagtctatcaccataagatagaaaagctgaactagcgtcagtcttctctcaattctatctgtaagtggagcaaagtctataacttttggcttggtggttccaagaggcagccccaagtaagtaaatggcagagttccaatagaacatccaaaagtttaagcaaacatctgagctttatcctctgtgagtttcaatggaatcatgcaagacttggaataattaaccttcaagcctgaagagagagcaaaagagttcaacaaggctttaagagcatgaagttgaggggccgaggcctgcataaagatgagggtgtcatctgcatactgaatcacggggaagttatcatcaccagggatcgggataggcatggacaagatccccctttgatgtgccttgttgattatggattgcaacagatctgctcccaaagcaagcaagagggagataagggaaccccctgcctgactccacgtttgcatttaaaaacttgccaggaacaccattaagaagaacagccgaagaagctaaggagaagatcactttcatccaggcattccattgggatgggaaacccattgcagccatcacattgaggatttcctcatactcaactgtgtcaaaggccttttcaaaatcaagcttcaacagcactatttccctttttgaatgcttacattgatgaatgtattcaaaggcccaagctaaacagtcctagatcgatttgccttttatgaaaccatactggttctaatgcaccaatcttaacatcaacacctgcaacctatcagcgaaaattttgcaaagaattttcaccgaaaagttcatcaaagagataggcctataatcattaggagtttgaggcgcagacatctttggaaccagggtgatgtaagaatagttgatggcagcaagatcaacagagccaccccaaaagtcagcacaaagtctgtagaaatcttgtgcaataatctcccaacaagatttataaaaacatccattgaaaccatctggccctgggccttatccacaagcattttcttgagcacatcaactatctcctttgtagaaatctgagcacagagggaggacaggtcacctttatcttcaatctgttcactaagatcaaacaccattttaggcttatcagaaactcccattctatccctgaacacactccagaagatagcagctttcctctcatgatcaaaaacttggttaccatctaaatcttggaggcaggaaatggtattgca

SEQ ID NO: 51144 - DNA, 2045 bp, Oryza sativa
gggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgacgaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacatcctcttgcatgttgagttcgtagctcgatacccggaactctaggtctgcaatcttcgcctcggtatctctcttgctcctcatccgactcctgtacgtgtggatgtcctccttgaaaacaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgctcagcctcttttatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtcta

SEQ ID NO: 51145 - DNA, 5049 bp, Oryza sativa
ggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccgattgttctcaacaaccgggactaaagatatctttagtcccggttgttgagaacaaccgggagtaaagaaaagatctttactcccggttgttctcaacaaccgggagtaaatatcttttcccgctatttcgaaattctttttaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccaatcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgatgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttttcatcccactgtcatcaatcattacgcctccaccagtcaacctaacccattggcaccggaacagagaaaacttgagaggaccatagtcaagttcccatatgtcctcgatggcaccgtaatacgtggcagttgttccatcgtgtcccatggcatcgacacgaacagcgctgttctggttcgtgctcttcatgtcttgggctctcgtgtagaatgtgtacccattgatctcatatccctggaatgtcgcgatcgacccagacggtcccctctccaggaaggcaagttgttggttgatcgactcgttacccatgagatgttgtcgtagccatgcggggaaagtatcaatgtgatgccgtgtaatccatgcatcggacttaccgatgttcctggtgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacagtacctttatgctctccaagcattcaaatatactttccttctctgccttgctaagagtgtagctggctggactcaagtaatggcttcctttctcctttggttccgggtgaaggtcgccgcgttgttccatatgcttcatatcattacgtgcttccagtgtatctttcgactttccgtatacacctaggaagccaagaaggtttactgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcgcttgacggtaggcacgagctagacaccaaagccttcatcttccaggggctcctcttctgggtttgggaaaaattgagcaagactgagtacaaccaccgtactcaacaagacacacccacaagtgcagaataaatgcaagggagtacaaaggagttatactataaagggttagggttgcggtaaacagcatttaaagatatttagttgctcaaaactatttagtaaacacgagtctagaactatacaatattatttatcaaggccgtgaacccacacgaacctgccttaacccaaggcctacgatgattcagaccgaactgtcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaagccaattccacaataaccaaaccattccatagtgtccaggtgatatgaacatcccaaagtctagagttgtaaaatcacctaatgttacctaattaaacagcgaagcatctacctaaaatcatactagtggtaacatgtgtagagtgtccactagttggagttttgtttattctagggtgaacaaggaaataataacaataataatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccatgaagagcggatcttccgaagctgcagcgtctacacgaccaatggaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaaaaaatggatttattgcgtcagccgaggggagagggcgcgcggaccgggtccacgggagtggggcccacgcggcagcctcacggcccacggtggaccgggcgcacccggctcacaccggccggcgccgtgggtcccatgcgtcagccgcacccgagggcgcgggcggctgacggccgggccccacatggcagccgaggggcgcgcccgaaggcggccacgccggcacagccgacgggaggcggcgcacccgcgccccgatggtcgctgccggcgaccaccggcgcggcggagcggcgcccgagagaggggagggaagggggaagcgagtcggcggtccacggctcaccccgggtcgacggcgacgacgggaacggcg

SEQ ID NO: 51146 - DNA, 4021 bp, Oryza sativa
cggcgatagggcacgggcgaggcggcgggaccggcgggaggtaggggatgacgggtgggccccacccgtcagcgagggtggcgggcgggcccgcccgtcagcggcacgcgcgcggggaggaggccggatgggccgcgggggagaggagagagagggagggaggtgggctgagccggcccaagagggggagggggggaaaaagactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagggtcgttttgggacgcgacatttacgcaaaggttcttagtgaggtgcatcacgtcgattgcgtggcgtacgtccaagaattcccaatatggtaactcccaaaatatagagttctttttccacatcgccgcgtgaccatcttcgctttctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgatgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacacctcccttcttccataactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttctccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgacaaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattataacttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactacagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttagcatgacctcccctcttttttgaagtaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtaacactaaccggggctaaagatcaccgggatctttagtcccgattggtaatatcaaccgggactaaagttaagatctttagtcccggttggtgttaccaaccgggactaaagatcccgggggggcctgacaggtcctgacagcattcgaaccgggactaaagatgatctttagtcccggttggtaacacaaaccgggactaaagatcaaatatgcccgtttcccttttgaaccgggactaaagatcatctttagccccggtttttattgcatccgggactattgtggaaatcggccgaccgacgaaagatggtttctccaccagtggcacgtgggcgcgtgacgtttggctgtagcgtcatcagcacgcagcacgctgcttggtacaaagtacatcgatctcacaaaaatctgaaatctctgtcttgctaaaattctgtcgttcaatttttctcttaaaattatcgatttttctaacgctaggcgcagccgaccggccgttcgtacgtacgaggcaaaagcagtgcggatatcctcgttcggtaacatgcatggagccatggactgaaaaatctaatgggcgattgatcgttcctaatgatccgaaatcgctaagagcaaggataatagtgggctataagcaagttatatgcttatgtggaagagagagataaacaaaagtgggaagtgttggctcttatgcaagagctaactgcacacaaactctaaaaaatatgcattaaattcatggtgagagaaagagagaggatgaagaaaataaagataaacttatagccaatctactatatatgttagctttaacattgactagtacgtagtgaactctactattaaacttgctctaaaaagcgatcagtcgcgcgcctcccctcccgcgcggcgcggccacgtggcacgcgtggagaggggcgctacggtggaacggcgcgggagcggtcatgtgcgcacgtttcttgttttcttttcgttctttctggtttttttccctgattcggcgtttctctttttttttctttcagtatttcttttcgtttttttctggtttttttcctggtttatttttggttttaaacttatacatatataaattttatatctgtatgtatataaagtttgtatacgtacgaatacaaagtttgtatacgtggtgcttttttgttttcg

SEQ ID NO: 51147 - DNA, 8041 bp, Oryza sativa
tgcgccgcattactttcttattttagtaaatttatacacctaaagtttgtacacctcaagtttacacacctaaagtttaaagacctaaagtttataagtcaaaagtttatatacccgattcaaagttgaatttgaattcaaatattttttatatacagtatttcctatacatctaaagtttgtagacccaatgtttataagttaaaagtttatatatcggattcaaatttgaatttgaattcaaatactttttatatatagtatttttatacacctaaagtttagagacccagaaagtttataagtcaaaagtttatatatccgattcaaatttaaatttaaattcaaattttttatataatattttctatacatctaaagtttatatacccaaagtttataagtcaaaaaattatatacccgattcaaatttggatttgaattcaaatatttttttatatatagtatttctatacataaatttttcaaactttattttttttatctttttttaaaatttatggtgtagtatgaagagaaaaaggggaggagaaagggggagaggagcgtgttagaggggatggggggtgaccgcccattagcacacccgccatggactgctacaaaaacgaccaagtgatgtcttgcatgcatcccttttctgtttctaccatacaacaaaagtgattaaatggtaactctacttattaaacatggatgagagagaaatcccttgacctccactgtgcacaaggagcagtgcttttgaaagtcatgttgttctagttacatacaaattatattatagttacatgcaaattacagtgtaattataatatatttatatttgataaacttttagtaaaaaaaattatcgacacgagcaaacgcttcaggtggattagacccaagctatcctagagccaggtgctaaactctggtccaacatgtaaagtatggtaaatgaaggtggtgctaattaagtgaaaatatagtcagccctattttaatgtgctatatgttgcccacaatgaaatttacccacagatgagcaacattttccacaaaagcatgaaacggtccgataggcatcgcccaagcacaaaagaagaggccgatgggcaaaagagctgcatgatgtaaagatacataagatcatcacatgaactgaataatattttctattttcatcggaaaaaaataccattgttgaaaacagaaagtcatcactaagaaaatcttcatgtgctacagaaaatcaaatttctgatgtttagtgaggagtactaatagaactgaaacaatatggcataggtaatttattaatcgaacagtatggcagtcatcattggattccccctgcacaccaaggtttattaatcatggcagtcaatttctgatgtttagtaaggagtactgtagtaggctcttttgttcttctcctcctccaaagccggcaactgggcaacaaccagtagcacaatcgaacaaggaagatgacgccacctctttgagctaaccccaactctccggcgaccgacgtggatgtctatgcgtatgctgcgccaatctgttcaattgcatatttatgttccctaccactcaagaaaagtgagcccgagcaaaagaatccttaagtacgcactcaaaaatctgttataggtacgctgattgtaagtacgcactttttttttctttttgcttaattatacagttatacgtacatgcatgggatattagccggttttaggtacactataaaaagtgctcttgcgttacaatggaaaaaaataatgttataataatgattatagttattttatagttacatgggtgttatatgagattgtcctggacataaacaataaattaagtctatacctaaccctaaattcattccccttctctcccaccgtgagcgatggtggcggctccttcccccaccgcaggcggagaaataaaatgatatggttagatttaatttttattaaattaaccatgattaataacactctttgaaattttgttcaaattttcagagcttaattgctaattttgataatactaattatcatttcagtatttatttaaataaaaatctgaataaaaatcctcatttctctctgagccatttttagcccatttactttctcagcccacaactaaagtataattagcgtccctcaactcctctcactgtgttatgttggacccactggcctgccctcggcccattaagcttgcgcggcccagcagttatgcggcccgacctggaggcgacatgagcagtccgatatgatggatggcttggatctccttcgcgccgctgaagatgtagacgtgggaaaaccctaaccctaaccctaactttctcaccttctctctcccaatcctctatcccgacgacgagcgtaagcctcccctaccgcgaacgacggtggcggcgccctccctcagcacgagcagaagcggtgacagcccccttcccccatcgcgagtgatggcgtcctcccgtggcttccacaggcggatctggtggtgtcgtgcggcttcccgcgggcagatccaatggtgttggcggcatcccacagccagatccggtggcgacggtgacttcccacatgcggattcggcggcattggtggcttcttgtgggactgagataagatttgtgcgctttttattatgtttcctgttctttttctctttatttggattgtccgattggatttcgatcgaacttacggatgaaaaattgttgttacagacgaaaaattgatgtgacgaacggaaagttgcaatttttttatgtagttaagatatattattctatgttttaccatctcttcgatgcgtgcacttgtagttagagaggatattggccggttttaggagggagggtttacttaatactagatctaatctattggctgataataaagggtcaccaatttaaataaaaataaatagttggatgtattttttaaactttttatatttttttctaatttattagagtaccatatgatggcgtaggagcattcgtagattgccacataaaaacttgagagcgtttgtatgacatttaatggactttaaatatataatggatagataatacgtcgtccgtttcatattataagtcattttgacttttttaagtcaaacttcttttaagtttagtcaaatttatagaaaaatttagcaatatctaaaatactaaatttgttttattaaaactaacagttaataatacgtttgttttctgttaaaaatggttctatatttttctataaacttagataaacttttaaaaaataattaaaaaaaagtcacaacgacttataaactttaaaaaacttaactagaaatgagttgatgccaggcaattcatttggatggttgaattccatcaggttcatcggaccctggtgatattaatgtggctccactggtgtaacaacaagacgtctatggtgacttcgtcaatataaaaatacattagcctagtttttaaaggtgctcataggaatacggcatgcgtgtgtttatagagctgagtgggcaccactgttcatgcccccctaaatactgtgtacgccatatatatgtgcatattcatctagttgacttcagggataagaaaactgaacttctttagataatgatttggaaatgcattggccctaattaacatgattacattgtatgtgtgcgcacctaatacatttttgacgtagaggggttgattgaatctcagtgttgaaaaaatatatcgtgtgatctgttgttatgttaccctatcaatattctacaaacaattagctcaatttttccaggacacgttataaatgaagagcaacaaagttattgagttattactgttagtgatatgccctagaggcaatcatagagatgattgtatcacatgctatgtttacatatttatccgactttgtttcttgaaatagataactcattattggttaatgaatatgtgattctttcatgagactctttattttgtttgttactatttctaaatgatccctgatcaaatatcatatgtggaacaaatatgtttagatgatcagcacatgtattaattgatgatcatgtctcatggatcatggtataaagataccaaattaataatgtggacacatgttggggaacatgttgttggatagacccaacatgagacactgcaagagccatatgtgttgtgtcatcagtgatctcatttagtgttggtgttgaatccttagacctgagattatcatggtttccaacatgtgtagtagcttacttagggactgctaaacgctactatgtaattgggtagttataaaagtagttttcgggtatgccgtgaaacatgttgtgggatatgaataatcaagatgggatttgccccttctatggagagatatctctgggcccctcgatatcatagattatgcaagtgcatggccatgccaaaggtgattgaggagtcaatcacaagttatataatctatcacaggttcgagtgaatgattgagctattagaggatggcacatatctagcctcgagcttaatcgatatcgtgaggcaaaggggttcatacaagtatacactagaggttcagtcgatatgttctttatatatgcccggtgggtcaatacgttctgctaggggccgctgttgacacgtggaccaaaaaggagttttcgggttacagccgagtgtatatgaacctacagagtcgcacgcttaatggaccggaataaggggattggatagagatccaatatgagcttaattcggatagggatccgagtaggagtcctacgggccttggaggcccgagtgatggattctatatattcgtgaggggtgtgaccagcggaggtattgcatcacgtaagaaaccctagccatcactctcctcctcgagcaaaaccatagccgcgcgcgggtgctagcacatctgcgggtggcgttccgtccttgtacgtgtggataccggtagaggcgccgctggtttgcggtgctgatcggcgtgggagtacggcgaggagaacgcacgaggaggagaaggtcgagccggtgcgatcgactacttcctctacatcgacgcgcgctacttcgcgagagttccttcgacttagcgccttcttccgctgcgcagcgtgtcgagtggtaacgatctatgatctaatacttgcatggttgctggtttacgtggtagaaaaaatttgatttatgctatcgtagcctacgcgtatcctaacaattttcttaatttgtgagtatagacctagaatataccttgtatttgaaatcagaaaaaaaatcactagagaaaattggcaaacgaaggtttgtgaattgaacaaaaagcatgtaaatcaccctaaaaaaacatgcaaattatggttcaccttaatcaaaaccaaagtaatcaaaggtagggaaatttaacaaccactaatattagtaggaaggatatatagttcctagacctaccaagtacatagcaatgccaaaagctatcattggacgaagcatactgcagaactgcacaagtatgcgagacaaattaaatataccacaacaagctaattaagcacacatatatgcagtgtggagtacttcataagagtcttcatcaaccccacgcatttagctactgcagctctattatgccagcttccaggtcgggacgtgcagtgacaaagtcgtcattatacccaagcggaacattgaggtaagccggttcctgcggttcacttagtcccagaccgttgttgctcagccacatcgtaacctcgtgcatatctggtctatcgcccggatttttctgaacgcatagcagagcaatctgaatttgcctggttagctcctcttgaaactccaccctcaaataggggtccaaaagctcattgtatctcctatttgaccaaatattccaggcctattagagcacaacaaaaagttagtaccctaggcattacacttattaatcctcctttggagtgaagaaattttaaaggaattgaagtttgtgagaattaaaatagttaacgtaaaattcatgcgctccaaatgtaatgttaactagaggaagaacttcacttacataagtaagtagatgaatgatctgccatgttggttaaatattggagaacgaaccctcctgccacttatgatctcaagaaccaaaacaccgaagcgaaaacatcgtattttggggtcaaatccccatgtatatactcaggcgccatgtaaccactagacaacagcaagtataatcatgtcaatatataaataaattagtgcttgatatgttagcgaaatctgttcaaacattgctcattacaatataatttatggatatagatataaagtagagattgttcatttaattttgtgtgagtgcgcagtgtacgcccgtgttttggttggggtggggtggggttgggttggtaagtctctgttaatccaaaacataaggaaaaaatgtaatatttagcttcccacccaatatgagattcatattgatcatatatatcgaatcttcagtttgacttaattagtttttagagtaaagtctagctaccccttcgactatcatataaatttataaatccactctcaaccatgaaaccactaaaaggaaatagatatttcttgacaggcacgaaccatcaaggaaaacatcaaaatcaccggtacattttggaggttttattttggcaaaaaaaaaattaattggtcgctatgaaaattcaaaattctgatagtattactgataattacacccatcaactatacatatcaaaactggttaaaatatccccttcacgggtaatccaatctagtattgctaagtttaatattcaagttaaatcattttattttttcgttgacatggcactcaattagaaatagatatcagtaaagaacagattatttaattactagctagacatcaaaaatattttcaccggttttgataatggaagggtgtgtaaaatttcaggttccatagctgaaggtcgattggggtgtgagttaaatggacttcactccagtttcttctctgcatataacaggctcttgactacttacggtgttcctactggatgagtcacgtatggttctgttccatttaaacaaaatttccttgcaatcccaaaatcggaaattttgggattattttcactgtccaaaagaatattgcttagcttcatgtctctatgaataattataagtccttctggagcatggttgtgaaggtagtcaagtccttgtgctatcccgttgattatatgccgtcgcatgaaccagctcagcgatgctcctctttcacgatctgaaacagataactgttgtctatgagtatatataaaatcaagtaatgttctacgaattttcaatcggtgctatctactaacgaccattatattggcttacctgacaatacatagtccaagctcctgttaggcatgtattcatagacaagtatttgttctttgcggttaacacagcaaccaagaagcctaaccagattggcgtgttgaagccgtatgataatcctaatttcattcaaaaactcctccagaccttgccaagtagtttgatcgagcctcttggctgcaatctgaaggccgttctgtaatatgccctgtaatgattcatatatttgtttcaaatgcgacatgctaataactgttttttcatctaatatatatgtcccttctttctataaagctaatacccactaaatatctaaagctcaacatgcaatcataatatttattagcattcttaaaatctaacatgcaagcataccacatcaatcctctaagcacacaaagctcaacattctaaaattaaacatacacatgctaaatcattattttcaaatcattttcactatatttcaattcaaattatttcaccatttctacaatatctaacatatatatcctgcagcaacacgcaggacaccatttagtattatatacaagtgtactgcaattaaggtacaac

SEQ ID NO: 51148 - DNA, 8721 bp, Oryza sativa
cctgggtccacatgtcagcctcactttccattcaaacaaaagtgacgtgggatccggtgatgggtgaggctgacatgtgggttcgaatagtatttgggaataaaaattttggagagtggtatttgagcactgacattttgggaagatagcaaaaactaaattctccccatgcatggttcataggaagctctactaaccaatttatcctatcacactgtgattagggattgttgcttgcttgctttgtatctctgttcaagtttttgtaagaaaaaattagttatgttacactgttggacaaagtcttagcagtaattccaataaaaaaacaaattagttatgctactgtaggatgttactgtagaaatcatatcttattactacgttttcatagtaacattatcacagaacggcagtaatattatatgttaccgtaaaatttgtaggttgttattgcacttttggcagtaacatcataataaaaattgtagaaacagagacttgtaatagtaacagtgatgctatagtactaatgcttgtgtagagctaaaatcttttaaatatcgatctttagagagcaatatctatcacatcatatcacatcatatcatgcttttctaacccgaatgcaccatgacgttcgtaaaaaagttcttaacgaaattagatcatcatgattattttttgacgtcattatggtggaaagcaatcatgttactacacattagtcatcgagttactacaccattcctacgtgacgagaacttgaaaaaaaggtaaatctaaagattaaagagcaatatctctcatgttatatcttgtttttctaatccgtttgcaccatggtgttcgtaaaaaagtgcttaacgaaactaaatctgtcatgactattttttcacgttgttgttgtaaaaagcagtcaagttacttcacattgactgtcatgttactacatcaatcctgtgagacgagaactgaactaagctgggcgtggggggagacagcgcaagcgggtttgactggggtttgtgcatagctaaatttttaaatctcaatcttgtgcaaagtacaagtgctaaaaacttcatgtgcatggtcacaagttgacacaagtgctaaaagtactcttttcccacacaaagatacataatagcaagctaaaatacaagtaatacttttaaaattatagtcttttaaacaatgatatctctcaaattacatgttagagaccttttacggtgttcgcaaggtatttagaggtacgtggaggtggaacaacgagtaccgttgatcaagataggggcaaggtaccgaaaaaaattatggtaacatgatggcagtggagtaattaactagtaaaacatgggtattatatgtgaattgaatacctacatccatctatcagtatatcgttctgcagatcagtacgccgttcatgaggaaaaaaaagtaaattacagatacgacgttgattctgttccaaattaaataaacagaaagatctaatctcctttcttctttcccttcgtttcgttcttgttctggggtttgattggttaaccggaaggagacaaaggaaaaaaaaaatgtctacatggttgagggttgaagaggagatgggattgcccggtcgacgactagacgcaagctagcacatctgtaaattatcatatgcttatttgcacagttgatttgttatttatgtagttcataacaagttcataatatatgtcattttgatgttactgtagatctcatgttactatagtaatatatatcatgttactataataacaagttcataatatatgtcattcaaaaaaggtatagatcatgctgcctccattctataatataaagtacaaccacttttttagatgttccataatatatggcatgcatacaagcatgcaattaactgtggcatcttcttcattaaattataacttttttaaatcctccactctcatattatctaatcttattggatgcatgcattatatttatgtggatgatctaaactacaagatgataataattgtttcttggtctttgggttaagggtggttgtgtcttatattttatattttagaataaaggaagtaatagatatatgtggtgtgtctcatgttactatagtaatatattcatgctgatgttacactgtagccgtgtgataaaagatttgctataatgcagtaattaagacagtttagagtgtgcagtaatagctatcatagtgtcggtactacattttgtgccaaatactgtatttattagcacatgttataagataaaatttttctaagaaatatctatgacagttcagacatagtctacaggttaataatttgttggaattgaattaaaggtcttgggtttaattcccattgaatgtatattttaaatttattttgtctcttttgcatctccaaatagaagagatagtagggtgccggcactactacagaactcatttttccatgcgggcatatccatttttccatacggtcgtttggcccgcatgcgaaaatcagtattttcacgtgcgggcgggccgaccgcacaggataattgattatcccgtgcgatcaaattataataccacctgcatgaaaacaaaaaaaccaaaaataaaaaaaaagtgaaaatcgccgcccacccgcggccggcacgcaaccggccgccgcaactcgtcgtcgccgtcgtcgcgccgccacacgcacccggccgccccggtcgccgcctcgcccggtcacctcgaccagccacggccgcccggtcgccgccgcaaccagccacggccacctagtcacgtcgccgttgatgccgcccgccgccgccgaatccaggggggggacggcaaccgctgccggatccaggcgcggaggctggttgccgtcacgtccacagtcgtgccggccgccaccgctgccaaatccgtgcaggggatggccgccgcctccggatccgggcgcgagggggccggttgaagtcgcccctcgccgctgcccggtcgccgcgccgctcgccaacgtgcacggtcgccgccgcctcgcctcgtcgacaacgaaagtcaagagaggagaggagtgaaagtcgggagaggagaggagaggaagtgagagagatagaggggaggaaagtgaaaataaaaaggaagagagacgaggtgtgaaaattttaaaatgattgagagggagaggaggtgtgaaaattttgaagtgagtggagggagatgtattttcgcgtgcggtcggcttatgtcgcacgcacgggaaaatgcattatccggtgcggtcagggatcgcatggaaacaaaagggggcggcatccaggaaaatctatcatgtagtagtgcgaattgagagggagggcgcgtgtgagagggggagtgggagagagtggatggcggattgggagggagggcgcgagaaagagagagagagaggtagggaggatggcgagagagagagaggaggggacggacactaagcatatatagagggggcgaggaggggacatattttatgacattgttttagcacaagtttgtacatgacatattaaaatttatcttgtacaaggatattatgtacttttaaaaaaaaaggaaactaagcaatatcaggaagttcaattagaggttatgtaatattatcaacttactcggtaaacttgaccgaaagatccatgcccaagtctattttctgctgagaaattttctgtggcatctcttatcatggagaaaggataaagtgaaaacctttcatcaatttcttcggtaacggtcttctcccagtcacctaattctcttcttagcttgcaatctgcttttacatgtatataaccaggaaaaggttaggatttaatatttaagataaattttggtatgccatatgttgcaacttaacaatatatatataccatacatatgtatcccattcattagaaaaacaacattgagccacatatatatatgatatgttaactttcctgtggtgcgtaaaaaaaaccctgataaatacatctccttaattagtcaatcgagagaataaaaactttaatatcgccagacgccagcaagaacggtacaccttatacctcgtattttctttacgatgaatccaattagaatcaaaggaagaacaggagtaacaactccagaaatggtgatcaatgcgatatccgttttgctcatgccccctgcacacacacatatatatatatatgaaaattgagcacaacattttgaaaaggtaaactgagtgctgcactttgcatgagtgagattctcagaaaacttctgcaagttaaattttaaattacatgcttgtaaagtgatacaagcaacgagacgacgtctcctcgagagtttaaaattcactctcgtttagtttcggacgtacgtacctttctgttttggcatatgaatcttgatcgtctcgttgctttctaggaagaagcgatcgacctcgtacctcaggttgcaccggaccccgagaatccggccgccgaggcggtagtcggcggcgccagtgaaccacctcggcatctgcgaggcgatgccggagaggcagctcaggcagccggccggcgagaggtccggcgtgcactgcacgagcgcgaagatgacgaggtcggggctgcttctgcactgctgctcaaccagcccgaggcgggtcgcgcccacgtccagctccccgaacccggcctcccccgtcgcgtacccgcgcttcgacgagttccacgcggcgaactcggcggtggtgttgatcagctccatgacgcggtcgccgaacgcggcggcgccggccacgccgttcatgttccacgtgacccacgccggcgcgttggtcaggctggcgcggaagtcctcgccggagaaccggaacatgtgctcgtcgtagtagacggtcacgtccctgaagccggcgcagaagacgccgtggtcgatggcgtccctgaacgccttgcggaggccgccggcgcaggcgtcgccggcgtagtcgccgcggcagagcgcgatgccgtagaccgcgtctggcgcggcgccgaagctgtcggaggcgaaggcggtggccctcgcctccgcgaggagcagcgaggccagcgccctgaggttggcctcgtacgtgctgttcggctcgtacttgccgccggacaggctgcagttgtagtgcagcgggttcacctcctgcgaggccaccgcctgatcttcaccgccggccgccgcccatgtcggcgacgagaggagtactgtgacagcaaggaggaggaggaggatgtggagttgcatggcactggagagtgtgtagagaaattattagagggctttactcttgagagcaagttgtatgtgtgctacgtatgaatgctcctttgtgagcgtcctaccttgcattatatataggagcaatggagcatgtatagaaaatttcctacaatcccggcggcgctacaacacacaccacacatcgaactttcttaatccttttatgcgtctgaattttgtcttattttctacgtaatctccatgcctatttcgttagttttaactgtaagttaatcgataaatttattttctaaaaatgactacatgtccctcctttcttatacttttgtgttacatacttcataaatctcatgtcaaaaattttaatttagagaaaatttcataaaaccatagatactttgaccaaactatcacaaaactacaaatttaagaatgtatatcataaaactacaaatctagagcgaaatttatcacaaaactacatatttaaatcattgtatcataaaactacagatttagtaatgaagttatcaaaaaactacagattttagagtttatatccatagcacttgtgacatcatggtccaattaggaaaaggcttgtgtggcctatgtgagctgtgtgcgcatgtttagtactaccttgctagtttaccatgagtagaaccaacttataaggcctcttccttctaaccatatcactcccgggttaatcctttcacacgaagtgatgacgtaagtgtagttttgtgatagatagattaaagtatatatagtttaatgaaatttactcctcaatttacaataaaatcaaatggatatgattatttcaacaaaaaatgataaatgaattttatcaatttgaatatttaattaaattagtataagggtttcggctagcaattgagaaccaaatttatttattatttggttttaaatatttgtgaaaatttattcaaatttcgtcaaaattaatttaaaatttatttaaaagtttcaattttattcatttcaatttgtggtcaaataatttagaccctttttttttagaaataaatgttcttttttacttgaggattgagtttttatcactgatgtagcacaataaatatatatgagagaggaataatatagtcactttgaaaaattaatagccaacgcacgttcaactaaccgaacaagtatacagggagcaaaataaaattttagagaaactagaaaaatgcccatgcgttgcaacgagtgaaggctattttaatcttattattgttatacggtttagctacggtgaaattcactgtgggaattcgcttgatattctttttacaaaattatgagctgcaattaggggtccgatcgtctcaagttagcatgaagttttttaaagagatttcttatacgactccttctgtatttttaaaaataaacaaaattaaaaaccgattcaaacatgtatctgtatttgcaaaagcgattgaacttaaaaaccaattcaaacacgaatgacgtaccaaacgtaccgacaaaaacatcttcaatttttataatattagagatataacaaatgaggtaaaatttaggaacatatataagggaattgagcaaatttttatgtgcacgtaaggaattttctcataagagtaatatacgaattagatgcttttagaagtttacggtatcaacatcaaaatttcctataaatatatgtcgatgcgcgtgttcaatgggccgacatattcgtggattagtcattagtgtatgctgcgggatcgcagcaacggatgcttgtgctgttgtgcatattccctgtagtaatagagataacggattttgttaagaggacagctgttgagcaacctatggtttagtaaaatgtgttctactacactgtcgaatttacagctgtgttggcttaaccggctctgtaagccttagggcatgttcaacaacagagtcaatcttagacaatatatatttatttttagagactatgcttgctattataatagttaagaaaataaatactttaaccattattaatcccaaaaatatttttcattaccccttccatgccccatccccaccccatcctaaaatacagcagaacttccatttaagcctttgttgagccattgttaccataacaataatgtcagtggccgagtggcggagctagtgtgattcacgggtaaatatgtgcccctaaaattttagcaaagtacccattatttacccatatttatacacaagtgtatgcaaaattgaactgaaacaaattaaaggcccgttgcagaaaactcattgaacttttacagtatctatgccatttgaattatctttacccacaacgaatggcatcggcgagcgagacactagggatagagagctgccgaatttaggtcgagaggatccggttgaagggaaaggcagggtggcaaaagagatagtcataggtggatagaaagcggatgcgtgggacagcgtatcaagatcgactcagtgcggttttagtgtggcagggcttatcatgcaacataagggccgaagcttagctttctagtttgtttttctttgtctttgttgttaagtatacataaacattttagatgtgtatatcaatttatacatatagagaccggatttctattcattatttaaaaattgtcaattgaattatctcgtcgatttgttggaacgtgtcgctggcttaaattgttggttagtcatataagtgaacctccactttgaataagtgaacccccatcttctctctcttccatgtattagcagatgatactaattagaaaatctaagagccttctattaataattattgtacatgcactatgtttaaaacgtaccatatgtataattatatactatatagaatcagtgttcttggagattgtcacgccccgaactagccccgagcggaactagcccgtgacgctccaaattaacctgttaatcaataccagtcccaagaaacaatgctggtatcacaggaagacagtatatcatagcagcagaggtctctttattatagagtaggagtacagtcatgttgggctgcggacagatcccgagctcataactacattataatagggaaagcggaagccaagacttggaccaatcatcacaagcgtgacttgggaactaggccgaaaccctaaaactcatcgtaaccgacttgctcctggaagaactcctcgtcagcgggatccacatcatcttcttcagcgctggggggggattatttatatagagcaagggtgagtacaggagtactcagcaagccatgggaattaagtgtttaatgcaggcttcaaaggaaaggctgttgtttttgcaattgattttatttaaactcctttttgaaacaactaagtgagtgcttctcaaacgacacggatgagacagtg

SEQ ID NO: 51149 - DNA, 13530 bp, Oryza sativa
aagaaatacttagatttaaattataggtgcaagatgatgaaaggtgacttgccttgctcgagatcttgagcttgatcctcgaaatcctcgcactgcgggtcttcgggctccgaaactacacgcgaaacgggacaactcaacaaacggcgaaaataagccctattattgacctctaagcgtgccattagatagatctcgagatttgaggaattttggaagttgaacggagtcaaacggacttacggttgggtagatattgaatttctaagattattggatttttgatctaaaggaaaaaggatttaattaaacccttttgaaaaagaaaagaaaaaggaaggggaaatagactttcctcgggcggctagggcgtggcccgagagaaaaaggggcggctcggccgagcttaatgggccggccggcccgagaaggcggcccaaggcacgcgcgggaggggaggagagagggagccggtgggccgggtccatctcgcgtggtcccgagtgggacccgcttgtcggcggctcggctcaccgtgagcgaggagcacgcgacgcggcgctagggtttgggcgggcgcggtgcacgcgcgaggctcgcgggtgcggcgggcccacgcgcagcctcaccgcccaccgtggaccacgcgcacggggagggtggaacggagggagcggctgaccgggtcagccgactcggttgtgccgaggtggcaccgacgtggcgtctacgtggctgccacgcgggccggctggaggaagacgaaggcgccggccgcgaatggacggcgggcggtggcggtttctccgggacgccgtgcgacgacgaggggcgacggggtgtacaccggaatgacaagggggaacgagagggagtgagccaatggcttggattcaccggaggatgctcgacggtggcgatttgcggcggcggccaccggcggcaggaaaagagggaaacggcgacgagacgactagggttcaattcctccggactagagcatctacgcgacctcgggattcattcctagcaccggattgggcggagctacgccaagagaagctggcgacgagcggcggtttgcggcggcgagcggcaacggcggcgaggccgcgccaggcggtgggaaggtcttgggcggcgcctgcgagcttctaggggaactacgagtgctaccatacagtctaaggggaggaggaggagcgaagagggagaacggggagatgcactaccgtgcgggcgggcgcagtaacgagagccgacggtgcggaaacgtgatcgtttcggcctcgagccgaggaagaggagggggagggcgcgtctgaagtccccttccgcgtcctcgctcgtgccggctcctccgacacgcacgacgatgaacggcgacgacagaacaggggcgacagtggcgtggcggcgagagacgaaaacgagggagattggaggagggaggagcttgggtttataagggcgacaatgtcggtttgggataggggaaccgacattggacggtcaagccggcgagctggtgcccggctagcggccaaaacgacgacaggaggtgacgccggcgatgggaggaaaaagaagaaaggaagagggaaagggggcttgcctccttgcttctttgggaaacgaaagagggagagagggcgacgcggcagaaggaggaggagctctgcctccgtcccttggaagctagcgcgcggaggtggcggggccgggtcgtgacgacggcgatgacggtagacgcggggcaggcgcggcaggcgctgacggcggcggcgactggccggtcggccaccacggggcgcacgcgcgggaagcaacggcgcgcggcgatttgagcggcggcgagagcggagaggaagggcgctcggcttggcgcggctcacgtgcacgcgcacgcgcggacagagcgagggagagagggagagagagagggagagagagagaaggagaaagagaaagatgagccgagagggaatcggcccaccgaacctaagggaggcaaaatagacttttgtggaggaattgaattgggaaggaaaattgagattagggatttgaattcgacgatggatcggggattcgagatccggaatggcacggagactgactgcaagcgaagaaacaattttcgcaattagggtttttagaatttaaattttcccgttaggcgccacgacggaacgggcgctacagagatcgacttggatacactagttaaaataaagggtattcgcagcttctaggcattcctttctacgtatagacggttgaaaagttcagctatctatggtaatgcctaggctacctgtaggatcaaggatcgcctgctgaaatatatctattaacagtttataaaaaaaatacatatactagaaaataggtgtgcgcagttgacgcgtctaacactttaaaccctgtgtgtagtgtacatttctttcgaaatagtagtatatacaattttagtttttttacataaattagtttgatttctataaattactataaaatattctacatttgtcaccctcacgttgttgcctcgttgctgccctccaagccgttgtttcctgtcgtagctcggcattggtagccaatgttggcactcacgcacaaggtgagtgggaccttgctcacccaccaggtctactacaggggtaagggcaggtgaggttttccacccggttggctctgcagagctaggggtgaggggagaatgtggggagcgggaacacggtgttcctttcctacccagccccatcccgccccattgccaccacctctactaattgtttggtttttcgattttgatattttgatgaaccaatgaatataccattaataaaacatcctcaaatatgtttattattttaatttaaaatgaaaaaaattgtgaagaatttattatgaatttgattttgtgctatccatattcattttttatggaatttatttatatgttacttgtgaactgtataaatatgccctgattattttggaagacaatatttattttgatgaaagtgtcgacgggggatacccgtagatcggagaaatagggtattgggctatacgacatcaaaacaggcaaaagacaagggttatactggttcagacccctcataagataatagccctgatccagtttatatgagattgatatgaaaaatcacatagtacaaagagaacaaatgaattcgacaatactggcgagatccttgtagagatggttcgacgggatctcccggtggcttcggcttgcgtcctccggcttcgtagactatggtgggtgtgttgatgctatgattcgatgatcccgaacccctcccggggtgtgccttctataccatgagttgccttagtctccaagtagaactcggaggcaacaaaccctgcacgatatagaataatccctatcctcttcgagtaggactctgataatcgccagcccatgaggatactttccataatatattgtatactttcttatcgcataatgaaatatatagtatagaagatggtatgtcaatcttgcatattcggtaaatcgtaggataggaggtatgcctaggggtgggcaaaataagaccgaaccgaagaaccgaaccaaaaagaccgagaccgagaccaagaccgaaaagaccgagatcgagaaattctgttagtagttcggttccagccatcaaaagaccgaatttatttcggatatttcgatcattgggctctgttaaccaaattaaccaagaaaaccaaattgtggcccaataggcctaggaggcccattaagcccaataaattgcaaaaccctaaaagtccctactacctcagtccctcacttaccagcgccgcctccatccatccccaccccatccatcatgccgccttccgcctcggcgccgatccagcctccgccgaccgccacggtcccgagtcgacctcgacgagcgccgcctccatcctccgccggccgccgcggccctgacgagcaccacctcccgcctccgtcgaggtcccgacgagcgccgccgtttgcctcggcgccgcctcccgcctccgccgcgtccccgacgagcatcgctgtccgcctccagcctgcgctgcggccacgaggaccgccgccgtccgcctccagcctccgctgcggccacgaggaccgccgccgtccgcctcggcgccgcctccagtctctgccacggccacaaggagcgccgccgtccacgtcggcgctgcctccagcctccgccgcggccacgacgagcgccgccatccgcggcgcgcctggctagcggtggcgtggcgccgttgcgatagccatagccatggcctcgccaccagctctcgctgcccacacctgcgctgttcaagaattaggttagaccgagaccgagacggaaaaaaccgagaccgaatttaccggtcctgagtcggtcttgagttttcaaagaccgaaatgacctaagacagagaccgattttttcggttagaccgaacgcccacccctaggtatgctttatccgtaaccttgacagaaattatcactgaattcacatcaatattccctacttggtatctagaaaaaaaaagtggtagaccaatactgtatgtctacaatagtagagatatttaactatttatcatttttagatgtgacaattaactatttaccactgaacgcatgtgtctatgcatttactgcttatagcctacttagaacctctgtacctccacattcttttttttttctactgacacgtgtcgacattctatttctgattatctcagccaatcagctcgcacagaagctgccagagtaattgattgattgatatatgatgctgaccgattgttgacgtttaagtgcgtacgtatggaattccatatctctatcggtccaacaatcgatctcgcactattttatattagctgaatgtacatataggagacagatcaagcaatatgcccactggatacgctatatatattcctttcttttttcttagaagaaggggacgaccgccccccgggtccccgggcattatgcaattcactgttcttaattgtcgcagttcagccattgtttgacttgataggtcgttcgccttcttggataagcaacgcagagagtcagccgtatgcagataaaaattacacgagctgttcgattcgacgagataaaaattacacgcattgttgcgggacacgtagaaagatagataccaaattgagtgcgcgggtcaagctaagcaattggtcgaagaatcactaaaaggtcaatatgttctggaagtgaaagctaattaagcagagcagtccttccgttttaagttacttgtcagttgtcatcattctatttatcataagtctttgactatcaacttttataaactctgaaactcatgtagtttaacactacgagttttatattatatcataagaattatatatctttataatatgtaattcacatgttgttaaactacatgaatttctaaaatttaatggtcaaagataaatatgtttttatttaggataaacataaaaacgacaagtaatttaggaggaagtaatatttgttggagtttagcaagtgaaaagtaaactgcatagcacaccgaaggcactgcacagaaaatgcataaatcctgctgatatacttcatccgttccacaatataagaagttttagagttggatatggttattaagaaaactagaaaggtagcccgcgcattcgtgcaggcatgtagaagatggtttaaaagaacattgattggatatttattatagatcttaacttaactaaatatatatatttgtgaagtaatatattttacctttatattgtagaaaatcatattttaaataccgttgatttttatgaatgtatgcttattctgtctttttttatgtacatgtatatgttttttttccagtgaagattaggaaagttttgttttcaatcatgtacaatgtttgtatgtacggaaagaaagcagtggcatttgtaacgtaccaactcatacgtgtacctgaggaagtcattattttttaataatagatctaatctaatggtgtaaaataacgggtccaccaatttaagtgaaaatcaacggtgagattaaatagtgccatgtggcgactttagagcgtttgtagaagtgccacgtggcagcataagagtgtttgtaggaagtttaatggacttttattaaataataataaatagatatgtagaagtgaatggtggagggttgagattgaatgagcagtggaagtaggtgggaaaaatgaatggtggatgattgtgataggttgggaagaaaatattggtggagaagttgtaatattttaagacaaattttgatggctaaaagttgttatattttagaacggcgggagcagctagcaaggcaacgaaagtttgctggtctatcgcggcagctttagaaaagggcctatcgtggcagctttccaaacgatatcaatgtcggttatcgtattcgccagtatcgctgtcggttcagctgaaacggctatgatactcatttacacgaaaaagaataataaacgcactcgccaccatcacctgccatgtttgtcatctcccttcagctgcgcctcctatattcctctcatcgatctacttccacctccacccttaaggatgattgtggtggcatcgctggtggtgtgggtggcggactggcggtaagcgctgccaggtagatcagtgaattaatgagaggaaagaggggttagagaggatcgagggagagtccgggaagccattcagtggggatgggtgggggcatttagtttttttttttttttacaaaatttgctacaggacatataaaaaattttgtgtaattagctatgggacacggtaataaaatgtgtaatttgcatcctccattgcatgcaggacgtccctgctgctgccctccaccgcctacatgctctccctactgctggcccacgcctcctctgtacgccctccaccattgccttccacactccttctcagctagctccagctccatcctcaccatcttcctcacgtgctccacgtacgcctggtgtgccgacgcttgctgcatctgcatcaatagtaatagtagcagcacggcgagcgtcactggccactcctctacgttcacgtacgctcgacatgcccgccaccaccacgccatcctctgtaggatcgaatcacaagaactaagccaaccagagggggggtgaatggttggtatacccaaataccgaaaacttttagtggaaataaaagttacccttgaaatcgacggagatcggtctgactgagattgatctgtcggtctgaccgagtggatgccgccggtctgaccggtgttgaatctccggtctgaccgccgaagtcgcctgccgcgcctgtcgcctccgctggtctgaccgccgcttgccgccggtctgaccgccgcttgccgccggtctgaccgccgaaacccggtaaacacaaatcgaagaactcttaaagtggatgacgactttattgattctctctgtgtttacaaagtgcatcaacagcactcacaaaaatttcgactagactcgaaaccctaactcaaaactcaactcaattactctctaaagcgataccgggaagcctcacgctccccctctatttatacatgaggtaggcagcctaaagccacgaaccaaactcatactaggagtcctaaacaccttagtaaaccctctagtacaaaaaagaaactttacataaccaatcgtatcaaatttggactccttccaaattcgactccgcatcctatacgcacacaataactccatcgtatgccatatggaatctccatcaaccacgtgcatcaactctagcctaagtatcccacatgatctctgaccaccacggacgtcgtcttatccccaagccgactcccagtccatcactgcaaatactctcccgagacatcgagtcacctacacatggaacaaacaaagaaaccatattccgagaccaagctatctccaacttgactcattagcagcaaacaatagtattacatacgtatactatccatctagaagccataattatgaaataatcacggatatccaaataaacaacccgaaatcgaaaccgacacagcgtcggccggtcagaccgcgggctggccggtctgacggctaccagagcccggtctgaccggtcacataaaataacgaatcctgcgatcacctgtgaatccaatcatctccaaaaccacttcgtgaataaattccaaatatcaaaaccaataatctccaatgcccaattgttcatcacaaaacaataatcaaaaaacacctttgattttacatcctcctccccaccagacccgtaccatgcggccgacgtcgcctgggcgcccatccgtgccgctgctgcgccgtttggcaagaagggcaagctggagttctgccccgacggcgacctccactcgctccaccaccgtatgcccgacagccgcttgcccgcttcctcgtcgcgtcctccaggttctatgccgtcaaggttctcctcttgcttgagtatctgcacatgatggctaggttcaagtccagcagcagggatgacctgtagcggtggaggccgcgaactgaccgaaagaagggggaagaagacaagggcaaaactatcattttacatggttttctctcatcaattcagtggatattatctctatctctacctctactattataaaaattgttgtaaatgtttccgcggggatttcagtatgtcatctgtgtttgagttggtttctaattttatctttatctattttctccatcttcccttttttcgctgtttttttttcgatttggttttttccgtcttttttcgcttttttcatccggttttttgtcgctgttttttttccatccagttttttttttatctcatccgatctgttgcaaaccaccgccgcttgaccaaaccctagcgccatctcactttgatatgtctcccccatgaacctccaattgattgcaaaagtcgattccccacaattgattgcaaaagtcgattccccactcctcccttatcattttttctcaccgttttcctttcaattcggctttagttcactggatttagtcttagtcgccgatgatagccgaccgacctttttaacccgaattttgtggatacgttccgatttagggaaaaacaaaaggaggagatcgagtggatcaaaagacctcaaccaattttgggatataaaaaacatttggctagatttgatggggaggattgactccggcgtacgggcacatgactatctagaggttgaagacgctagatgtgcgagctgggcctataactccacttatgagatggatcggagagagtcagggtagtcgactgtgcgagttgggcatgtagctccacttgtgggctggatcggagagagtcaggtcaagtaaagggaggtagcgaactgggttgggactgaaaatgaaggaaaggatgggctttcggcccaaaccaaggaacatgttttattaactttttcaattacaatgtatatatatagtgatcctaacgattcaactcattgctcagttcctaattgcggttctaccactgaaaaacgtttttacccgttgcaacgcacgggcattttttctagtattttaatacgttcagtgtcctgcaacaatttaccacacttttaaagtgttctagggcaaattcacgtctttacggtgttttacagctaattacattttttttttgttgtcctatagcaaattttgtctagattttttgatgccccatgctcacttattggtcaaatgcccttttttttttcctaatttcctatcttgagactctatttttagtgaacctgcagtgattggccgatagtattagctttttgttttgtaatatatatgctcgtttcttgtgcatacggggagttaaaatctgcatgtttctttattctcccccaccatattgtcacgatcgccacagaatttggaacttctagagggatcgtgaggaaatcaggaagcacgagaggaagaagaaggtagttgcgacagaatattgagcaggaagagagaagatttgaattgagtttgagatattttctattacaagtcatctctctccactgccgactttatatagcatatcattattaggtctcactcactgaaattgggcccagccgatagctactggacccacactcctcccacatatcgtgggcatcactagcgtcctgtcagctgatgtatccaccatgacacatatactcacattaaataaaatatatgctagttaagtttttattggtcttgatgaaaaaaaagttactatatcaagagacgaaatggtttgttgagattcgcggcttgcttggaatgctattaattagttctgaacctggtacagcaaaaatacaacaatagactcgaattttccttttctaataattttacgccaagtggtatgtttgaaaaagaatcggaataggtaaactttaaatattacgaaccttcttttccttggaaattaacatgttgcgttggacaatgacgaacggcagcatcactgtaattgctttagagaaaaaaggttttttcaccctatgagtccattgtaactcaacaatcgaaaaggttgtttgcactagaatagggttccggttctaactaaggtaatactatctccgtaataaataaccatgcaagaacgaagaaatctccataaaacaaacccactaagcaaaagggcactcctccaaaggcttagaaatttctcatcctaatcaaacaagaatatacaccggtcaatcatgattgattaaaaatatatgagttgagattaattcgaactcaatacatacgttctaggaactgacgaggtgataataccatatcaagattcagtttttccttttgagaaaattggaactgtatttgggaccaatcctgaagaaacaaaaataggaacactatgatctactccctccatccagtatatcactaataatgattatctaatccatattcatagtaagagccagaggttgtatctgatctaatattatcgaggcacttttgtagcttagtctgtctgtaagaactattatggctttttaatgaaaattgggcgcaagcctttcctccaaaatattatcgaggcaactacaaatcgcactgctagctctgaactgagcctatcactgaccgcgtccactccgtcgtgaagcgggggctgctgatccgcgaccagtcgcacgctgccgcgcgcgcgcgatcagctgccccctctagtctgatctcttacctatataaacgtactatatgccatatatacatacgtataaactttatatacgtatatacaaagtttatacgtgtatatatatagtatatacatacgtgtgtacatatacataattttttatatgcatgcacttttaatgtataaaaagatatacacatgtatataaagtttgtgtgtatatacgtatgaaaaacctaaaaaaatacatgtatacaaactttatatatgtgtatacaaactttgtatacgtgtatataaatttggtatacgtatgtataaaaacccaaaaaatacacatatacaaactttgtatacaagtatatagaagtttgcatacatgtatacaaagtttatatacgtgtatataaagtttgtatttatacgtatacaaagtttgcatacatacgtattaaaaaacggacaaagagaaaaatatacgggaggaaaaaaaaaagaaaaaaacgaaaaccggaaaagatacggaaggaaaaaaacagaaaaaacaaacaaaaaaaagaaccgtacgcccgtacgcgacgtccgaaagatacggaaggaaaaaaaaacagaaaaaaccaaaaaaaaaaggaaccgtacgtccgtacgcaacgtccgccgccttctctatcgtgtcgcgcgcgggagggctattagcccacaacacgaggaagccaaaaaaaaaaacagaggcccgtgggtttatagaaacagtttgggctagaagtagtaggggtgaactcgccgcgcgactaatagcgatttcgtcgtgaagcggcacctcgatcgatcaatcacttgctcggtgctgtaaaatccgcaacacccgtgaatcatatcgctgaagcgcgctgctgccgcggcaagcgatcgatggtgtacgtggtgacaggtgagaaatcacacgagggctgcatggactcgatcgagcacatggaggcagatggatcatatctcgtcggcctgattaacagcaaccatagacgggacaggccagcccaccacttgcaggggcagatctaggggtggtgctgggtatgcaccggcatacccaaaaaaatcaccaaagatccaggatgtataattgtattagtatgctgtatgcagtgagcctaaacaatatatgggtatcttattgaacgaagaacaaggaccaatagatatgtgcgtttgtgttcctgttggggattggccagtgaaattagtaacttttgcggagtcacagtagggctttcgcgtgcgggcaacaacgagcaagcacgacgtacggccgcaagagctagaaggtgtagcgcggctacctgctggctgtgctacaacggcagtagcaaatttacaaatttgcagggctagctgttgcggtgtcgctgctgcctgctggctagttagtggctacgtacgcacgctggcggaggagccgcacagacggatcggatcggaggaggcggtgctagctggtgcatgcatggacgatcgatggacggcggaagacctcaccggcctgtgcacgccgcgcgcgcgcgctccactgcttgctgtcgatcgagtggaagaggcgggcgggccgggacggggacggcgcggccacggacaacgcgacgctccggccggcctccgagaagaggtgtggttggtgcggcaattaattaacggaggaaactccaatcagatacgcagacggacaaaaatcggtagaacattgagatcaacgtacgtacaccaatctccgatccggaacgacgcgcgcgacgtgcgatatggaagctcgaacacgatatcgattaggatgcgatcgatggatcggagagaagatatataacgagagagatagagatctatcgcatcgcatgtgtttttcgacctagctaggaaaagaccaatccctctcgtttctcgtcgcccgcccggtggatccactgccagccactagcgaaagtacccatggatccaggacccatgctggccgatccaacacttatggtgagggcggatcaacgaggaccaccccacatggtattggtggaccgctacgttgcactcgtggacgacatacaagaggtgatcgacgaaataggaggtgtgtcgttcgatgtgagcttgaaggcagccctcgacgccctcccgaagtgcagcgacggcaagagtgggacgaacaacaacagtccgccatcagggcag

SEQ ID NO: 51150 - DNA, 3414 bp, Oryza sativa
ccatcttccgagaccgtaaagcctgccgccctgcagcgcctggcacgatgcgtaaggagcccatggcctcccggtgcaactccggctcctactaccgtgaggtactggacggcatcgaccctcgcttttctcacctcaccggcggtgccatcgtgaattctctgaccattggggtctcctggccacccagccatgacctatggaatcaccccttgtccgcctccatctccagctgccatgactgcttgcttgtgctctactttggcaactaccgtcccgggatctcttcgccagggtgttactttgtgctcaacacctgggccaactcggtcgctatcgtcccgcctctgcgcgccacctgcgtcatcaccatgtcgcactgcggcattgggaccggggtcgccatcctacgccataacgactactacgactatgtcctcgttgagctcttcccccatcaggacagccggacccacctcgcctccaacaaagccactcttttcttgtggtggtctcctagctctagcccgctcgccgatggccagtggatacggaaagaggtgctgctccccatccctgcaacttccaatcaagataaggacgacgcgacacggccgcccacctactcctttcgtgaaaacatggtgttcgctgtttcgaccacctcgcttttgctgggttgatcttaggacaggaatcttggtttgcgatattgacaagctcaacaccagcactgacgacgaggatgatcgcttgttgttccgcttcatcccattgcctgaggaatgcgtgatgaagcctggccttctatctcgggagaggccagcggaggagcaccgcaccatgatctgtatggacccggagaccatcctgttcgtctccatggatagctacatccaaggcctccccattggcgatacagtgctcatgacatggactctcaagttcccactcacgaaccactggacctgggagaagcactctgcgccatccttgtgcgtgggagacctcctaaatgatcttccagtcttaaaagaatccaagaatgacgggaagacgcagcacattgccaactgcccggttagtagcattgacaggcaaaaccatcttatcactagcctcactattaccaagtatgagaggaagcatgagaacgggcaatggggagtcgtggaattgtacgaggtcagcattgacatggaccgtagaacggtcttggagttgtcttctctcgaaagtcgccattcaaatatatttgcagctgactttagttgctgcttacaacaggtacccctctttgatatgtccatttaaagtgtatattattttgatacgggcaactcttggaaagtaaatttagcctttaatttctcttacattgtattgttggttggtagaaaatcatcattgtggaagcactttgaaaaaaaaatgataatggtactatgtaagcatgcttataatttgcttacgaagtttacattttcaaactgaacacgactcgtaaaagtggacaggcggtggacaggtcccgaatttcttgtactgctgtagttcactagttaaaagtttgatgtttgatctaaattagacaaatttgttgaactacttgctaatggggaaaaaccaaccggtgcagtgagcatagaactaggaaaatttgtcctcgatttgaaaatgttggtgatgggaatgatgaaagcatatccacagttcatctgcttggacgaccaatattttcgattagtagttcttctactcaaaattaatattaggagtaatattttatcaatctgatctattagtttgtgcgggtatagtaaatttaaattcctaaacatcaaatgagaagccgagccttaaaattaaagagcaccacagatttgctggcacaattaataagcaaacacctctttttttgtgttttctttagcatcagggtgatctccacatcgtcgaccgcattaacagtttgatcttccccttttttccccttctatttctgatattgcccgaactttttctcttttatgaattttctttcttcgagacaatgtcgtgggaaagcttacagcggagtcgctcaacattgaagtcgcctaacgaggaagaagtggttgataaggatgatgaatattgggagtgggtgttccccgatgaagtgggtgaggatgaatatcaacatggcccagacctgtcatgttaattttgcgccaagatggaatcagaatatcaactctttatggttagaacttggaactttcaaaaggtagtgggtttgaaatgtgcgccggattatcttgagatctaggtttattatattagttatgttacaaggaaatcccctcttttgtgaggaggaaactctctatctcgagaacttttcttttcctttttttacataaaaattttgtacagaaacaagtctgtcatctcagctaataaaaaaaagatattgaaaatgaagtgagtttcaagtggattttaattgaagaacggtacttttcaaataaccgccaaaacatgtttagtccctgtattagtaggtcagatcagtatttcataaattatccgttaaaatctactatgtcaaagctccagccatctttaaaagtttatgattcaagttgtcagcctaccccaggtgggttggaatttaaaacctgtttggttaaaaccaggtggggttggaatttactacgctgaacaacatctgcctgaccggatgcatgccggagatacgcctgcacctgcctgacctgagcttgttcggcgacttcatcattagcctggctcagatgcacgaaatgggtggccggagctaaggcgtcttgctaatcacgattacagcaacaatcgcgcgcgattactcaccacgggcacgaaccgctgcaccagtacgcgcgtgaggctctagctcgtcgaccaccaccacccagtgtcccagtcccaagcaagagaccacagatgatttgaggaatagaccgaggattagaaaaggattgcattatgttgatgggggattaacggagttaatcacttctttacctaaacacacgtcttttttactactgattttgtcaggcacgtttagtccaggccttcaatcgaacataagcaaactcaggatatgcctcatctggcaaaaagcataaaaaaatcagaagtctcaggcacaacttttgcgcaggcatatcaaaccggaaaagtccacttggaatcccttaactagcggccaaatcttattaagattcctaaaccatagtatcggatatcttgaaccaaaaaataaaaaataaaatagacggttttgaagaacggtttcatgacatggagcatacatggcagtgtttacttgtcttcgtcccacatgacgtttatgtgatactagtaatagtgcagggctgcaggaat
